US008101349B2

(12) United States Patent
Garcia et al.

(10) Patent No.: US 8,101,349 B2
(45) Date of Patent: Jan. 24, 2012

(54) GENE PRODUCTS DIFFERENTIALLY EXPRESSED IN CANCEROUS CELLS AND THEIR METHODS OF USE II

(75) Inventors: Pablo Dominguez Garcia, Oakland, CA (US); Altaf Kassam, Oakland, CA (US); George Lamson, Soda Springs, CA (US)

(73) Assignee: Novartis Vaccines and Diagnostics, Inc., Emeryville, CA (US)

( * ) Notice: Subject to any disclaimer, the term of this patent is extended or adjusted under 35 U.S.C. 154(b) by 1042 days.

(21) Appl. No.: 10/779,543

(22) Filed: Feb. 12, 2004

(65) Prior Publication Data

US 2005/0227917 A1    Oct. 13, 2005

Related U.S. Application Data

(60) Provisional application No. 60/532,830, filed on Dec. 23, 2003.

(51) Int. Cl.
*C12Q 1/68* (2006.01)
*C12P 19/34* (2006.01)

(52) U.S. Cl. ...... 435/6.1; 435/6.11; 435/6.12; 435/6.14; 435/6.17; 435/91.2

(58) Field of Classification Search .................. None
See application file for complete search history.

(56) References Cited

U.S. PATENT DOCUMENTS

| 4,959,314 | A | 9/1990 | Mark et al. |
| 5,712,381 | A | 1/1998 | Lin et al. |

FOREIGN PATENT DOCUMENTS

| WO | WO 92/20798 | 11/1992 |
| WO | WO 96/30389 | 10/1996 |
| WO | WO 97/40151 | 10/1997 |
| WO | WO 98/11220 | 3/1998 |
| WO | WO 99/33982 | 7/1999 |
| WO | WO 99/54631 | 12/1999 |
| WO | WO 99/64594 | 12/1999 |
| WO | WO 99/64631 | 12/1999 |
| WO | WO 01/02568 | 11/2001 |

OTHER PUBLICATIONS

Feng et al. Molecular biomarkers for cancer detection in blood and bodily fluids. Critical Reviews in Clinical Laboratory Sciences (2006) 43(5-6): 497-560.*
Mitas et al. Quantitative real-time RT-PCR detection of breast cancer micrometastasis using a multigene marker panel. International Journal of Cancer (2001) 93: 162-171.*
Reinholz et al. Evaluation of a panel of tumor markers for molecular detection of circulating cancer cells in women with suspected breast cancer. Clinical Cancer Research (2005) 11(10): 3722-3732.*
Russo et al. Advantages and limitations of microarray technology in human cancer. Oncogene (2003) 22: 6497-6507.*
Srinivas et al. Trends in biomarker research for cancer detection. The Lancet (2001) 2: 698-704.*
Lucentini et al. Gene association studies typically wrong. The Scientist. vol. 18, 6 printed pages.*
Wei et al. Sample size for detecting differentially expressed genes in microarray experiments. BMC Genomics. (2004) 5: 87-96.*
Chen et al. Alteration of Gene Expression in Normal-Appearing Colon Mucosa of APCmin Mice and Human Cancer Patients. Cancer Research (2004) 64: 3694-3700.*
Polley et al. Proteomic Analysis Reveals Field-Wide Changes in Protein Expression in the Morphologically Normal Mucosa of Patients with Colorectal Neoplasia. Cancer Research (2006) 66: 6553-6562.*
Abstract XP-002177024; EMBL; DOE Joint Genome Institute: Retrieved form EBI GENBank Accession No. AC016619; (Dec. 14, 1999).
Abstract XP-002177025; EMBL; Retrieved from GEN Bank Accession No. AQ568048; (Jun. 3, 1999).
Accession No. AL135937 Entry HS AL135937 Phillimore, B. Human DNA Sequence from Clone RP1-278022 on chromosome 20.
Accession No. XM_104316 Homo Sapiens LOCI Entry LOC164325 NCBI Annotation Project.
Accession No. Z98752 Human DNA Sequence Entry HS 138B7 Ramsey et al. Human DNA Sequence from Clone RP1-138B7 on chromosome 20q13.12 . . .
Acker et al., GenBank Accession No. HSRNAP14K (Jun. 8, 1995).
Adam, et al., "Identification of Blomarkers in Benign Prostate Hyperplasia and Prostate Carcinoma by Differential Display" Proc. Annual Ming American Assoc. For Cancer Research, vol. 36 Toronto (XP002923792) (Mar. 1995).
Alberte et al., Molecular Biology of the Cell, $3^{rd}$ Ed. New York p. 465 (1994).
Attwood, Science, 290:471-473, (2000).
Azzi, A. et al., "The Protein Kinase C Family," *Eur. J. Biochem.* 208(e):547-557 (Sep. 1992).
Baldi et al., "Differential Expression of the Retinoblastoma Gene Family Members pRB/p105, p107, and pRb2/p130 in Lung Cancer." *Clin. Cancer Res.* vol. 2(7):1239-45 (1996).
Baltz et al., "A LIM Motif Is Present in a Pollen-Specific Protein," *Plan Cell* 4(12(:1465-1466 (Dec. 1992).
Bandziulis et al., "RNA-Binding Proteins as Developmental Regulators," *Genes & Development* 3(4):431-437 (Apr. 1989).
Bazan J.F., "Structural Design and Molecular Evolution of a Cytokine Receptor Superfamily," *Proc. Natl. Acad. Sci. USA* 87(18):6934-6938 (Sep. 1990).
Bennett et al, "Association between Ankyrin and the Cytoplasmic Domain of Band 3 Isolated from the Human Erythrocyte Membrane," *J. Biol. Chem*.255(13):6424-6432 (Jul. 10, 1980).

(Continued)

*Primary Examiner* — Young J Kim
*Assistant Examiner* — Angela M Bertagna
(74) *Attorney, Agent, or Firm* — Mei Hong; Patricia Tsao

(57) ABSTRACT

The present invention provides polynucleotides, as well as polypeptides encoded thereby, that are differentially expressed in cancer cells. These polynucleotides are useful in a variety of diagnostic and therapeutic methods. The present invention further provides methods of reducing growth of cancer cells. These methods are useful for treating cancer.

10 Claims, 3 Drawing Sheets

OTHER PUBLICATIONS

Berg, J.M., "Proposed Structure for the Zinc-Binding Domains From Transcription Factor IIIA and Related Proteins," *Proc. Natl. Acad. Sci. USA* 85(1):99-102 (Jan. 1988).

Bork, P., "Hundreds of Ankyrin-Like Repeats in Functionally Diverse Proteins: Mobile Modules that Cross Phyla Horizontally?," *Proteins:Struture, Function, and Genetics* 17(4):363-374 (1993).

Bowie et al., Science 247:1306-1310 (1990).

Breeden et al., "Similarity Between Cell-Cycle Genes of Budding Yeast and Fission Yeast and the *Notch* gene of *Drosophila*," *Nature* 329(6140):651-654 (Oct. 15-21, 1987).

Brennen et al., J. Autoimmunity, 2:177-186 (1989).

Brenner, S., "The Molecular Evolution of Genes and Proteins: A Tale of Two Serines," *Nature* 334(6182):528-530 (Aug. 11, 1988).

Brinkley et al., Variations in cell form and cytoskeleton in human breast carcinoma cells in vitro, *Cancer Research* vol. 40, pp. 3118-3129 (1980).

Burd et al., "Conserved Structures and Diversity of Functions of RNA-Binding Proteins," *Science* 265(5172):615:621 (Jul. 29, 1994).

Burgess et al., *J. Cell Bio.* 111:2129-2138 (1990).

Bürglin, *Guidebook to the Homeobox Genes*, Oxford University Press, Oxford, 1994, Chapter 3, "A Comprehensive Classification of Homeobox Genes," pp. 27-71.

Cailleau et al, "Breast Tumor Cell Lines From Pleural Effusions," *J. Natl. Cancer Inst.* 53(3):661-674 (Sep. 1974).

Careers et al., Gut, 44:550-551 (1998).

Carmeci et al., "Identification of a Gene (GPR30) with Homology to the G-Protein-Coupled Receptor Superfamily Associated with Estrogen Receptor Expression in Breast Cancer," *Genomics* Vo. 45:607-617 (1997).

Chabert et al., Cell culture of tumors alters endogenous poly(ADPR) polymerase expression and activity *Int. J. Cancer* vol. 53 pp. 837-842 (1993).

Chandrasekaran et al, "Glycosaminoglycans of Normal and Malignant Cultured Human Mammary Cells," *Cancer Research* 39(3):870-880 (Mar. 1979).

Charbonneau et al., "1002 Protein Phosphatases?," *Annu. Rev. Cell Biol.* 8:463-493 (1992).

Chariello et al., Oncogene 16:541-545 (1998).

Chen et al., "Androgen-Independent Human Prostate Cancer Progression: The Isolation of Novel Stage-Specific Sequences Using Differential Mrnadisplay" J. of Urology, p. 267A (XP002923791) (Apr. 1995).

Clarke et al., "Engineered Disulfide Bonds as Probes of the Folding Pathway of Barnase: Increasing the Stability of Proteins Against the Rate of Denaturation," *Biochemistry* 32(16):4322-4329 (Apr. 27, 1993).

Clarke et al., Progression of human breat cancer cells from hormone-dependent to hormone-independent growth both in vitro and in vivo. Proc. Natl. Acad. Sc. USA vol. 86, pp. 3649-3653 (1989).

Confalonieri et al., "A 200-Amino Acid ATPase Module in Search of a Basic Function," *BioEssays* 17(7):639-650 (1995).

Cosman et al, "A New Cytokine Receptor Superfamily," *Trends Biochem. Sci.* 15:265-270 (Jul. 1990).

D'Andrea et al, "Erythropoietin Receptor and Interleukin-2 Receptor β Chain: A New Receptor Family," *Cell* 58(6):1023-1024 (Sep. 22, 1989).

D'Andrea et al., "A New Hematopoietic Growth Factor Receptor Superfamily: Structural Features and Implications for Signal Transduction," *Curr. Opin. Cell Biol.* 2(4):648-651 (Aug. 1990).

Database EMBL Online Human DNA Sequence form Clone RP11-427L15, Feb. 16, 2000, retrieved from EBI Database Accession No. AL139407 (XP002223603).

Database EMBL Online RPCI11-126H19. TV Homo Sapiens Genomic Clone, Jan. 25, 1999, retrieved from EBI Database Accession No. AQ348278 (XP002223604).

Database EMBL online Jul. 6, 2000 Birren B. et al., "Homo sapiens chromosome 2, clone RP11-265B3" Database accession No. AC 073025 XP002208136.

Database EMBL online Jun. 9, 2000 Birren B. et al., "Homo sapiens, clone RP11-12010" Database accession No. AC068959 XP002208137.

Database Record AA743908 (Feb. 19, 1998).

Database Record AI459918 (Mar. 1, 1999).

Davletov et al., "A Single $C_2$ Domain from Synaptotagmin I Is Sufficient for High Affinity $Ca^{2+}$/Phospholipid Binding," *J. Biol. Chem.* 268(35):26386-26390 (Dec. 15, 1993).

Dermer, Another Anniversary for the War on Cancer, *Bio/Technology*, 12:320 (1994).

Dhanasekaran et al., "Signaling by Dual Specificity Kinases," *Oncogene* 17(11):1447-1455 (Sep. 17, 1998).

Drexler, Leukemia and Lymphoma 9:1-25 (1993).

Dreyfitss G. et al, "Heterogeneous Nuclear Ribonucleoprotein Particles and the Patheway of mRNA Formulation," *Trends Biochem. Sci.* 13:86-91 (Mar. 1988).

Drmanac et al., "Gene-Representing cDNA Clusters Defined by Hybridization of 57,419 Clones from Infant Brain Libraries with Short Oligonucleotide Probes," *Genomics* 37(1):29-40 (Oct. 1, 1996).

Eklund et al., "Structural and Functional Relations Among Thioredoxins of Different Species," *Proteins: Structure, Function, and Genetics* 11(1):13-28 (1991).

Ellenberger, "Getting a grip on DNA Recognition: Structures of the Basic Region Leucine Zipper, and the Basic Region Helix-Loop-Helix DNA-Binding Domains," *Curr. Opin. Struct. Biol.* 4:12-21 (1994).

Erdmann et al., "*PAS1*, a Yeast Gene Required for Peroxisome Biogenesis, Encodes a Member of a Novel Family of Putative ATPases," *Cell* 64(3):499-510 (Feb. 8, 1991).

Eriksson et al., Diabetologia, 35:143-147 (1992.

Evans et al., "Zinc Fingers: Gilt by Association," *Cell* 52(1):1-3 (Jan. 15, 1988).

Everett et al., Pendred syndrome is caused by mutations in a putative sulphate transporter gene (PDS). *Nature Genetics*, vol. 21, pp. 440-443 (1999).

Fischer et al, "Protein Tyrosine Phosphatases: A Diverse Family of Intracellular and Transmembraine Enzymes," *Science* 253(5018):401-406 (Jul. 26, 1991).

Freshney, Culture of Animal Cells, A Manual of Basic Technique, Alan R. Liss, Inc., New York p. 4 (1983).

Freyd et al., "Novel Cysteine-Rich Motif and Homeodomain in the Product of the *Caenorhabditis elegans* Cell Lineage Gene *lin-II*," *Nature* 344(6269):876-879 (Apr. 26, 1990).

Frölich et al., "Yeast Cell Cycle Protein CDC48p Shows Full-Length Homology to the Mammalian Protein VCP and Is a Member of a Protein Family Involved in Secretion, Peroximsome Formation, and Gene Expression," *J. Cell Biol.* 114(3):443-453 (Aug. 1991).

Fu et al., EMBO J. 15:4392-4401 (1996).

Fukuda et al., "Inositol-1,3,4,5-tetrakisphosphate Binding to C2B Domain of IP4BP/Synaptotagmin II," *J. Biol. Chem.* 269(46):29206-29211 (Nov. 18, 1994).

Gastpar et al., "Methoxy-Substituted 3-Formyl-2-phenylindoles Inhibit Tubulin Polymerization," *J. Med. Chem.* 41(25):4965-4972 (Dec. 3, 1998).

Gehring et al., "Homeotic Genes and the Homeobox," *Ann Rev. Genet.* 20:147-173 (1986).

Gehring, *Guidebook to the Homeobox Genes*, Oxford University Press, Oxford, 1994, Chapter 1, "A History of the Homeobox," pp. 3-10.

Gehring, W.J., he Homeobox in Perspective, *Trends Biochem. Sci.* 17:277-280 (Aug. 1992).

Genbank Accession No. 2914385, deposited Oct. 14, 1997.

Genbank Accession No. A42286, deposited Aug. 13, 1999.

Genbank Accession No. AC004067, Nov. 8, 1998.

Genbank Accession No. R09152, Apr. 5, 1995.

Genbank Accession No. 525299, deposited Jul. 21, 2000.

Genbank Accession No. 581083, deposited Jun. 12, 2000.

Genbank Accession No. AA050390 (Sep. 9, 1996).

Genbank Accession No. AA068559 (Feb. 6, 1997).

Genbank Accession No. AA114761, deposited Nov. 15, 1996.

Genbank Accession No. AA131908 (May 14, 1997)•.

Genbank Accession No. AA444267, deposited Aug. 4, 1997.

Genbank Accession No. AA544005 (Aug. 1, 1997).

Genbank Accession No. AB012917, deposited Sep. 30, 1998.

Genbank Accession No. AB013730, deposited Jun. 20, 2000.

Genbank Accession No. AB023201, published Jun. 16, 1999.

Genbank Accession No. AB041036, deposited Jun. 20, 2000.

Genbank Accession No. AB041542, deposited Jun. 30, 2000.
Genbank Accession No. AB056389, deposited Mar. 1, 2001.
Genbank Accession No. AC000028, deposited Nov. 21, 2000.
Genbank Accession No. AC002315, deposited Feb. 20, 1998.
Genbank Accession No. AF015926, deposite Jun. 15, 1998.
Genbank Accession No. AF036241, deposited Oct. 27, 2000.
Genbank Accession No. AF038957, deposited Jul. 20, 1998.
Genbank Accession No. AF039029, deposited Nov. 4, 1998.
Genbank Accession No. AF047695, deposited Jun. 2, 1998.
Genbank Accession No. AF068116, deposited Jun. 10, 1998.
Genbank Accession No. AF068117, deposited Jun. 10, 1998.
Genbank Accession No. AF116910, deposited May 11, 1999.
Genbank Accession No. AF155117, deposited Jan. 5, 2000.
Genbank Accession No. AF155826, published Jun. 16, 1999.
Genbank Accession No. AF164623, deposited Jun. 26, 2000.
Genbank Accession No. AF176555, deposited Nov. 10, 1999.
Genbank Accession No. AF189011, deposited Feb. 6, 2001.
Genbank Accession No. AF202892, deposited Dec. 12, 1999.
Genbank Accession No. AF179308, published Aug. 30, 1999.
Genbank Accession No. AF241316, published Sep. 15, 2000.
Genbank Accession No. AF271782, deposited Jan. 2, 2001.
Genbank Accession No. AF273437, deposited Aug. 17, 2000.
Genbank Accession No. AF277375, published Jul. 18, 2000.
Genbank Accession No. A.1250839, deposited Mar. 17, 2000.
Genbank Accession No. AJ250840, deposited Mar. 17, 2000.
Genbank Accession No. AJ271784, published Feb. 16, 2000.
Genbank Accession No. AJ278133, deposited Mar. 19, 2001.
Genbank Accession No. AK000059, deposited Feb. 22, 2000.
Genbank Accession No. AK000638, published Feb. 22, 2000.
Genbank Accession No. AK001121, deposited Feb. 22, 2000.
Genbank Accession No. AK001197, deposited Feb. 22, 2000.
Genbank Accession No. AK001468, deposited Feb. 22, 2000.
Genbank Accession No. AK001472, deposited Feb. 22, 2000.
Genbank Accession No. AK002717, deposited Feb. 8, 2001.
Genbank Accession No. AK001402, deposited Feb. 22, 2000.
Genbank Accession No. AK003515, deposited Feb. 8, 2001.
Genbank Accession No. AK005163, deposited Feb. 8, 2001.
Genbank Accession No. AK007403, deposited Feb. 8, 2001.
Genbank Accession No. AK007686, deposited Feb. 8, 2001.
Genbank Accession No. AK012674, deposited Feb. 8, 2001.
Genbank Accession No. AK013151, deposited Feb. 8, 2001.
Genbank Accession No. AK014691, deposited Feb. 8, 2001.
Genbank Accession No. AK018516, deposited Feb. 8, 2001.
Genbank Accession No. AK019525, deposited Feb. 8, 2001.
Genbank Accession No. AK022518, deposited Sep. 29, 2000.
Genbank Accession No. AK023964, published Sep. 29, 2000.
Genbank Accession No. AK024266, published Sep. 29, 2000.
Genbank Accession No. AK025674, published Sep. 29, 2000.
Genbank Accession No. AK026563, deposited Sep. 29, 2000.
Genbank Accession No. AK026581, deposited Sep. 29, 2000.
Genbank Accession No. AK027065, deposited Sep. 29, 2000.
Genbank Accession No. AL008734, deposited Nov. 23, 1999.
Genbank Accession No. AL050269, published Feb. 18, 2000.
Genbank Accession No. AL117475, deposited Feb. 18, 2000.
Genbank Accession No. AL117496, deposited Mar. 10, 2001.
Genbank Accession No. AL136791, deposited Mar. 10, 2001.
Genbank Accession No. BC003582, deposited Apr. 18, 2001.
Genbank Accession No. BC004195, published Apr. 18, 2001.
Genbank Accession No. BC004203, deposited Apr. 18, 2001.
Genbank Accession No. BC004225, published Apr. 18, 2001.
Genbank Accession No. BC005392, deposited Apr. 18, 2001.
Genbank Accession No. BC005874, deposited Apr. 18, 2001.
Genbank Accession No. CAB02036, deposited Jun. 17, 1998.
Genbank Accession No. D28778, deposited Aug. 5, 1997.
Genbank Accession No. H43467, deposited Jul. 31, 1995.
Genbank Accession No. H93085 (Nov. 30, 1995).
Genbank Accession No. K03332, deposited Aug. 2, 1993.
Genbank Accession No. L24774, deposited Jul. 19, 1994.
Genbank Accession No. M14505, deposited Feb. 28, 1994.
Genbank Accession No. M15796 (Apr. 27, 1993).
Genbank Accession No. M60857, deposited Nov. 2, 1994.
Genbank Accession No. M88458 (Apr. 27, 1993).
Genbank Accession No. NM_000075, deposited Oct. 31, 2000.
Genbank Accession No. NM_000943, deposited Oct. 31, 2000.
Genbank Accession No. NM_001919, deposited Oct. 31, 2000.
Genbank Accession No. NM_002592, deposited Oct. 31, 2000.
Genbank Accession No. NM_004252, deposited Nov. 1, 2000.
Genbank Accession No. NM_004846, deposited Nov. 1, 2000.
Genbank Accession No. NM_005701, deposited Jan. 11, 2001.
Genbank Accession No. NM_006853, deposited Nov. 2, 2000.
Genbank Accession No. NM_006854, deposited Nov. 2, 2000.
Genbank Accession No. NM_012310, deposited Feb. 3, 2001.
Genbank Accession No. NM_012773, deposited Nov. 1, 2000.
Genbank Accession No. NM_013235, deposited Feb. 3, 2001.
Genbank Accession No. NM_015654, deposited Nov. 2, 2000.
Genbank Accession No. NM_016195, deposited Nov. 2, 2000.
Genbank Accession No. NM_016248, deposited Nov. 2, 2000.
Genbank Accession No. NM_016705, deposited Nov. 1, 2000.
Genbank Accession No. NM_018062, deposited Nov. 2, 2000.
Genbank Accession No. NM_018131, deposited Nov. 2, 2000.
Genbank Accession No. NM_018401, deposited Nov. 2, 2000.
Genbank Accession No. NM_021302, deposited Nov. 1, 2000.
Genbank Accession No. NM_022082, deposited Dec. 5, 2000.
Genbank Accession No. NM_022183, deposited Dec. 6, 2000.
Genbank Accession No. NM_023314, deposited Apr. 14, 2001.
Genbank Accession No. NM_024535, deposited Mar. 18, 2001.
Genbank Accession No. NM_024653, deposited Mar. 18, 2001.
Genbank Accession No. NM_025841, deposited Mar. 20, 2001.
Genbank Accession No. P08563, deposited Jul. 15, 1998.
Genbank Accession No. P26332, deposited Dec. 15, 1998.
Genbank Accession No. P40651, deposited Feb. 1, 1995.
Genbank Accession No. P41880, deposited Nov. 1, 1995.
Genbank Accession No. S71018, deposited Sep. 23, 1994.
Genbank Accession No. S82472 (Dec. 3, 1996).
Genbank Accession No. U01137, deposited Aug. 23, 1994.
Genbank Accession No. U14990, deposited Oct. 8, 1994.
Genbank Accession No. U36478, deposited Dec. 13, 1995.
Genbank Accession No. U37022, deposited Jun. 5, 1996.
Genbank Accession No. U48288, deposited Aug. 23, 1996.
Genbank Accession No. U58766 (Nov. 1, 1996).
Genbank Accession No. U79269, deposited Nov. 28, 2000.
Genbank Accession No. U95094, deposited Apr. 15, 1999.
Genbank Accession No. W66607, deposited Jun. 14, 1996.
Genbank Accession No. W89528 (Sep. 12, 1996).
Genbank Accession No. W94391, deposited Oct. 17, 1996.
Genbank Accession No. X63745, deposited Jul. 12, 1996.
Genbank Accession No. XM_002264, deposited Apr. 16, 2001.
Genbank Accession No. XM_002688, deposited Apr. 16, 2001.
Genbank Accession No. XM_003725, deposited Apr. 16, 2001.
Genbank Accession No. XM_004631, deposited Apr. 16, 2001.
Genbank Accession No. XM_004854, Apr. 16, 2001.
Genbank Accession No. XM_005803, Apr. 16, 2001.
Genbank Accession No. XM_005908, Apr. 16, 2001.
Genbank Accession No. XM_006669, deposited Nov. 17, 2000.
Genbank Accession No. XM_007118, deposited Apr. 16, 2001.
Genbank Accession No. XM_007595, deposited Nov. 16, 2000.
Genbank Accession No. XM_007926, deposited Nov. 16, 2000.
Genbank Accession No. XM_008187, deposited Apr. 17, 2001.
Genbank Accession No. XM_008188, deposited Nov. 16, 2000.
Genbank Accession No. XM_009005, deposited Feb. 10, 2001.
Genbank Accession No. XM_010399, deposited Apr. 16, 2001.
Genbank Accession No. XM_012951, deposited Apr. 16, 2001.
Genbank Accession No. XM_014892, deposited Apr. 16, 2001.
Genbank Accession No. XM_014893, deposited Apr. 16, 2001.
Genbank Accession No. XM_017983, deposited Apr. 16, 2001.
Genbank Accession No. XM_017986, deposited Apr. 16, 2001.
Genbank Accession No. XM_018155, deposited Apr. 16, 2001.
Genbank Accession No. Y15054, deposited Jul. 28, 1999.
Genbank Accession No. Z25820, deposited Apr. 13, 1994.
Genbank Accession No. Z25823, deposited Jul. 17, 1996.
Genbank Accession No. Z27113, deposited Jun. 8, 1995.
Genbank Accession No. Z46372, deposited Oct. 27, 1994.
Genbank Accession No. Z48970, deposited Feb. 17, 1997.
Genbank Accession No. Z48975, deposited Mar. 25, 1997.
Gerhold et al., BioEssays, 18(12):973-981 (1996).

Gilman, "G Proteins: Transducers of Receptor-Generated Signals," *Ann. Rev. Biochem.* 56:615-649 (1987).
Gleason et al., "Thioredoxin and Related Proteins in Procaryotes," *FEMS Microbial. Rev.* 54(4):271-298 (Dec. 1988).
Gō et al., "Relationship Between Mutability, Polarity and Exteriority of Amino Acid Residues in Protein Evolution," *Int. J. Peptide Protein Res.* 1592):211-224 (Feb. 1980).
Guo et al., J. Pharra Exp. Thera., 300 (2002).
Haezebrouck et al., "Stability Effects Associated With the Introduction of a Partial and a Complete $Ca^{2+}$-Binding Site Into Human Lysozyme," *Protein Eng.* 6(6):643-649 (Aug. 1993).
Hanks et al., "Protein Kinase Catalytic Domain Sequence Database: Identification of Conserved Features of Primary Structure and Classification of Family Members," *Meth. Enzymol.* 200:38-62 (1991).
Hanks et al., "The Protein Kinase Family: Conserved Features and Deduced Phylogeny of the Catalytic Domains," *Science* 241(4861):42-52 (Jul. 1, 1988).
Hanks, "Eukaryotic Protein Kinases," *Curr. Opin. Struct. Biol. I*:369-383 (1991).
Hanks, et al., "The Eukaryotic Protein Kinase Superfamily: Kinase (Catalytic) Domain Structure and Classification," *FASEB J>* 9(8):576-596 (May 1995).
Harosh et al., "The RAD3 Gene is a Member of the DEAH Family RNA Helicase-Like Protein," *Nucleic Acids Res.* 19(22):6331 (Nov. 25, 1991).
Haynes et al., "The Bromodomain: A Conserved Sequence Found in Human, *Drosophila* and Yeast Proteins," *Nucleic Acids Res.* 20(10):2603 (May 25, 1992).
Hell et al., Lab. Invest., 73:492-496 (1995).
Heller et al., "Discovery and Analysis of Inflammatory Disease-Related Genes Using cDNA Microarrays" Proc. Natl Acad Sci., vol. 94, pp. 2150-2157 XP002076789) (Mar. 1997).
Hill, "Signalling to the Nucleus by Members of the Transforming Growth Factor-β (TFG-β) Superfamily," *Cell Signal* 8(8):533-544 (1996).
Hill, The Basic Science of Oncology, Tannock et al, Eds. McGraw Hill, New York, pp. 178-195 (1992f).
Hillier et al., GenBank Accession No. H43467 (Jul. 31, 1995).
Hillier et al., GenBank Accession No. W94391 (Oct. 17, 1996).
Hillier et al., the WashU-Merck EST Project. GenBank Accession No. R87679 (Aug. 16, 1995).
Hodgman, "A New Superfamily of Replicative Proteins," *Nature* 333(6168):22-23 (May 5, 1988).
Hodgman, "A New Superfamily of Replicative Proteins," *Nature* 333(6173):578 (Jun. 9, 1988).
Holmgren, "Thioredoxin and Glutaredoxin Systems," *J. Biol. Chem.* 264(24):13963-13966 (Aug. 25, 1989).
Holmgren, "Thioredoxin," *Annu. Rev. Biochem.* 54:237-271 (1985).
Hu et al., GenBank Accession No. HSU36478 (Dec. 13, 1995).
Hunter, "Protein Kinase Classification," *Meth. Enzymol.* 200:3-37 (1991).
Hunter, "Protein-Tyrosine Phosphatases: The Other Side of the Coin," *Cell* 58(6):1013-1016 (Sep. 22, 1989).
Jang et al., Clin. Exp. Metastasis, 15:469-483 (1997).
Kelner et al., "Nonresponsiveness of the Metastitic Human Lung Carcinoma MV522 Xenograft to Conventional Anticancer Agents," *Anticancer Res.* 15(3):867-872 (May-Jun. 1995).
Kerr et al., "Signal Transduction: The Nuclear Target," *Current Op. Cell Biol.* 4(3):496-501 (Jun. 1992).
Kiefer et al., "Regulation of Transcription and Translation," *Biochem. Soc. Trans.* 25(2):491-498 (May 1997).
Klug et al., "'Zinc Fingers': A Novel Protein Motif for Nucleic Acid Recognition," *TIBS* 12(12):464-469 (Dec. 1987).
Knighton et al., Crystal Structure of the Catalytic Subunit of Cyclic Adenosine Monophosphate-Dependent Protein Kinase, *Science* 253(5018):407-414 (Jul. 26, 1991).
Koonin et al, "Vaccinia Virus Encodes Four Putative DNA and/or RNA helicases Distantly Related to Each Other," *J. Gen. Virol.* 73(4):989-993 (Apr. 1992).
Kuang et al., "Differential Screening and Suppression Subtractive Hybridization Identified Genes Differentially Expressed in an Estrogen Receptor-Positive Breast Carcinoma Cell Line," *Nucleic Acids Res.* 26(4):1116-1123 (Feb. 15, 1998).

Kunau et al, "Two Complementary Approaches to Study Peroxisone Biogenesis in *Saccharomyces cerevisiae*: Forward and Reversed Genetics," *Biochimie* 75(1 /2): 209-224 (1993).
Kuriyan et al., "Structures of SH2 and SH3 Domains," *Curr. Opin. Struct. Biol.* 3:828-837 (1993).
Lambert et al., "From Anemia to Cerebellar Dysfunction: A Review of the Ankyrin Gene Family," *Eur. J. Biochem.* 21191/2):1-6 (Jan. 1993).
Lazar et al., Mol. Cell. Bio. 8:1247-1252 (1988).
Lester et al., GenBank Accession No. RRU48288 (Aug. 23, 1996).
Liao et al., Structure of Wheat Serine Carboxypeptidase II at 3.5-ÅResolution, *J. Biol. Chem.* 265(12):6528-6531 (Apr. 25, 1990).
Linder et al., "Birth of the D-E-A-D Box," *Nature* 37(6203):121-122 (Jan. 12, 1989).
Lopez et al., Molecular Biology, 32:881-891, 1999.
Marengere et al., "Structure and Function of SH2 Domains," *J. Cell Sci. Supplement* 18:97-104 (Dec. 1994).
Marra et al., GenBank Accession No. AA114761 (Nov. 15, 1996).
Marra et al., GenBank Accession No. AA444267 (Aug. 1997).
Marra et al., GenBank Accession No. W66607 (Jun. 14, 1996).
Masui et al., "Stabilization and Rational Design of Serine Protease AprM Under Highly Alkaline and High-Temperature Conditions." *Appl. Env. Microbiol.* 60(10):3579-3584 (Oct. 1994).
Matsuno et al., "Suppressor of Hairless-Independent Events in Notch Signalizing Imply Novel Pthway Elements," *Development* 124(21):4265-4273 (1997).
Mayer et al., "A Novel Viral Oncogene With Structural Similarity to Phospholipase C," *Nature* 332(6161):272-275 (Mar. 17, 1988).
Mayer et al., "Signaling Through Sh2 and SH3 Domains," *Trends Cell Biol.* 3:8-13 (Jan. 1993).
McClean et al., Eur. J. Cancer, 29a:2243-2248 (1993).
Meldrum et al., "The PtdIns-PLC Superfamily and Signal Transduction," *Biochem. Biophys. Acta* 1092:49-71 (1991).
Michelsen et al., "The LIM Motif Defines a Specific Zinc-Binding Protein Domain," *Proc. Natl. Acad. Sci. USA* 90(10):4404-4408 (May 15, 1993).
Miller et al., "Repetitive Zinc-Binding Domains in the Protein Transcription Factor IIIA From *Xenopus* oocytes," *EMBO J.* 4(6):1609-1614 (Jun. 1985).
Milner et al., "The G9a Gene in the Human Major Histocompatibiility Complex Encodes a Novel Protein Containing Ankyrin-Like Repeats," *Biochem. J.* 290(2):811-818 (Mar. 1, 1993).
Mordret, "MAP Kinase Kinase: A Node Connecting Multiple Pathways," *Biol. Cell* 79(3):193-207 (1993).
Morikawa et al., "Influence of Organ Environment on the Growth, Selection, and Metastasis of Human Carcinoma Cells in Nude Mice," *Cancer Research* 48(23):6863-6871 (Dec. 1, 1988).
Morissey, J.H., "Human Tissue Factor Gene," *EMBL Databank*, ID HSTFPB (Feb. 20, 1989.
Morton et al., "SH3 domains. Molecular 'Velcro'," 6 *Current Biology* 4(7):615-617 (Jul. 1, 1994).
Musacchio et al., "SH3—an abundant protein domain in search of a function." *FEBS Lett.* 307(1):55-61 (Jul. 27, 1992).
Neto et al., "Shotgun Sequencing of the Human Transcriptome with ORF Expressed Sequence Tags" PNAS vol. 97 No. 7 3491-3496 (X000996193) (Mar. 28, 2000).
Nishida et al., "The MAP Kinase Cascade is Essential for Diverse Signal Transduction Pathways," *TIBS*. 18:128-131 (Apr. 1993).
Nishizuka, Yasutomi, Discovery and prospect of protein kinase C research: epilogue. *J. of Biochem.* (Tokyo, Japan) vol. 133, pp. 155-158 (2003) abstract. CAPLUS [online] [retrieved on Jul. 7, 2003]. Retrieved from: STN Intern'l, Columbus, OH, USA. Accession No. 2003-342536.
Northwestern University, Oligonucleotide Properties Calculator [online] [retrieved Jul. 7, 2003]. Retrieved from the internet:URL:http://www.basic.nwu.edu/biotools/oligocalc>.
Nusse, "The *int* Genes in Mammary Tumorigenesis in a Normal Development," *TIG.* 4(10):291-295 (Oct. 1988).
Odum et at, Limitations of the MCF-7 Cell Proliferation Assay for Detecting Xenobiotic Oestrogens, *Toxicology in Vitro*, vol. 12, pp. 273-278 (1998).
Okamura et al., "Endogenous Basic Fibroblast Growth Factor-dependent Induction of Collagenase and Interleukin-6 in Tumor Necrosis Factor-treated Human Microvascular Endothelial Cells." *The Jour. of Biol. Chem.* vol. 266(29):19162-19165 (1991).

Olsen et al., "Improvement of Bacterial β-glucanase Thermostability by Glycosylation," *J. Gen. Microbial.* 137(3):579-585 (Mar. 1991).

Pawson, "Protein Modules and Signaling Networks," *Nature* 373(6515):573-580 (Feb. 16, 1995).

Payre et al., "Finger Proteins and DNA-Specific Recognition: Distinct Patterns of Conserved Amino Acids Suggest Different Evolutionary Modes," *FEBS Lett.* 234(2):245-250 (Jul. 1988).

Peters et at, "An Abundant and Ubiquitous Homo-Oligomeric Ring-Shaped ATPase Particle Related to the Putative Vesicle Fusion Proteins Sec 18p and NSF," *EMBO J.* 9(6):1757-1767 (Jun. 1990).

Punting, "Evidence for PDZ Domains in Bacteria, Yeast, and Plants," *Protein Sci.* 6(2):464-468 (Feb. 1997).

Powell, et al. Pharmacogenesis, 8:411-421 (1998).

Product No. O4128, Sigma Catalog, p. 776 (1990).

Querol et al, "Analysis of Protein Conformational Characteristics Related to Thermostability," *Prot. Eng.* 9(3):265-271 (Mar. 1996).

Radinsky et al., "Level and Function of Epidermal Growth Factor Receptor Predict the Metastiatic Potential of Human Colon Carcinoma Cells." *Clinical Cancer Res.* vol. 1:19-31 (1995).

Raether et al., GenBank Accession No. HSU14990 (Oct. 8, 1994).

Ranson et al., "Increased Plasminogen Binding Is Associated With Metastatic Breast Cancer Cells: Different Expression of Plasminogen Binding Proteins," *Br. J. Cancer* 77(10):1586-1597 (May 1998).

Rhee et al., "Multiple Forms of Phospholipase C Isozymes and Their Activation Mechanisms," *Adv. Second Messenger Phosphoprotein Res.* 26:35-61 (1992).

Rhee et al., "Regulation of Inositol Phospholipid-Specific Phospholipase C Isozymes," *J. Biol. Chem.* 267(18):12393-12396 (Jun. 25, 1992).

Rosenfeld et al., "Zinc Fingers: Conserved Properties that Can Distinguish Between Spurious and Actual DNA-Binding Motifs," *J. BlomoL Struct. Dyn.* 11(3):557-570 (Dec. 1993).

Ruderman, "MAP Kinase and the Activation of Quiescent Cells," *Curr. Opin. Cell. Biol.* 5(1):207-213 (Feb. 1993).

Russell et al., "Conservation Analysis and Structure Prediction of the SH2 Family of Phosphotyrosine Binding Domains," *FEBS Lett.* 304(1):15-20 (Jun. 1992).

Russell et al., Journal of Molecular Biology 244:332-350 (1994).

Sadowski et al., "A Noncatalytic Domain Conserved Among Cytoplasmic Protein-Tyrosine Kinases Modifies the Kinase Function and Transforming Activity of Fujinami Sarcoma Virus P130$^{gag-fps}$," *Mol. Cell. Biol.* 6(12):4396-4408 Dec. 1986).

Sánchez-Garcia et al., "The LIM Domain: A New Structural Motif Found in Zinc-Finger-Like Proteins," *Trends Genet.* 10(9):315-320 (Sep. 1994).

Schmid et al., "D-E-A-D Protein Family of Putative RNA Helicases," *Mol. Micorbiol.* 6(3):283-292 (Feb. 1992).

Schofield, P.N., "Patterns, Puzzles and Paradigms: The Riddle of the Homeobox," *Trends Neurosci.* 10(1):3-6 (Jan. 1987).

Scott et al., The pendred syndrome gene encodes a chloride-iodide transport protein, *Nature Genetics* vol. 21, pp. 440-443 (1999).

Shantz, et al., Int. J. Biochem Cell Bio., 31:107-122 (1999).

Simon et al., "Diversity of G Proteins in Signal Transduction," *Science* 252(5007):802-808 (May 10, 1993).

Sorimachi et al, "Structure and Physiological Function of Calpains," *Biochem. J.* 328(3):721-732 (Dec. 15, 1997).

Stabel, "Protein Kinase C—An Enzyme and Its Relatives," *Seminars Cancer Biol.* 5(4):277-284 (Aug. 1994).

Sterweis et al., "Regulation of Phospholipase C by G Proteins," *Trends Biochem. Sci.* 17:502-506 (Dec. 1992).

Tamkun et al., "brahma: A Regulator of Drosphila Homeotic Genes Structurally Related to the Yeast Transcriptional Activator SNF2/SWI2," *Cell* 68(3):561-572 (Feb. 7, 1992).

Tamkun, "The Role of brahma and Related Proteins in Transcription and Development," *Curr. Opin. Genet. Dev.* 5(4):473-477 (Aug. 1995).

Temeles et al., GenBank Accession No. U01137 (Aug. 23, 1994).

Tockman et al., Cancer Res., 52:2711s-2718s (1992).

Torna et al., Grafting of a Calcium-Binding Loop of Thermolysin to *Bacillus subtilis* Neutral Protease, *Biochemistry* 30(1):97-106 (Jan. 8, 1991).

Tonks et al., "Protein Tyrosine Desphosphorylation and Signal Transduction," *Trends Biochem. Sci.* 14:497-500 (Dec. 1989).

Trowbridge, "A Prototype for Transmembrane Protein Tyrosine Phosphatases," *J. Biol. Chem.* 266(35):23517-23520 (Dec. 15, 1991).

Valencia et al., "The *ras* Protein Family: Evolutionary Tree and Role of Conserved Amino Acids," *Biochemistry* 30(19):4637-4648 (May 14, 1991).

Vallejo et al., Biochimie, 82:1129-1133 (2000).

Varki et al., "Cloned Low Metastatic Variants From Human Lung Carcinoma Metastases," *Anticancer Res.* 10(3):637-644 (May-Jun. 1990).

Varki et al., "Microscopic Metastasis of a Human Lung Carcinoma Cell Line in Athymic Nude Mice: Isolation of a Metastatic Variant," *Int. J. Cancer* 40(1):46-52 (Jul. 15, 1987).

Varki et al., "Spontaneously Metastasizing Variants of a Human Lung Carcinoma Cell Line: Monoclonal Antibody Characterization," *Tumor Biol.* 11:327-338 (Nov.-Dec. 1990).

Wakarchuk et al., "Thermostabilization of the *Bacillus circulans* Xylanase by the Introduction of Disulfide Bonds," *Protein Eng.* 7(11):1379-1386 (Nov. 1994).

Wassarman et al., "Alive with DEAD Proteins," *Nature* 349(6309):463-464 (Feb. 7, 1991).

Wasylyk et al., "The Ets Family of Transcription Factors," *Eur. J. Biochem.* 211(1/2):7-18 (Jan. 1993).

Wells et al., Journal of Leukocyte Biology 61(5):545-550 (1997).

Yang et al., Protein-peptide interactions analyzed with the yeast two-hybrd system. *Nucl. Acids Res.* vol. 23, pp. 1152-1156 (1995).

Yeatrnan et al., "Identification of a Differentially-Expressed Message Associated With Colon Cancer Liver Metastasis Using an Improved Method of Differential Display," Nucl. Acids, Res. 23(19):4007-4008 (Oct. 11, 1995).

Yeatman et al., "Identification of Genetic Alterations Associated With the Process of Human Experimental Colon Cancer Liver Metastasis in the Nude Mouse," *Clin. Exp. Metastasis* 14(1):246-252 (Jan. 1996).

Zhang et al., "Anti-Tumor Efficacy and Biodistribution of Intravenous Polymeric Micellar Paclitaxel," *Anti-Cancer Drugs* *:696-701 (1997).

Zimmer, Cell Motility and the Cytoskeleton, 20:325-337 (1991).

Martoglio, et al., Changes in Tumorigenesis- and Angiogenesis-related Gene Transcript Abundance Profiles in Ovarian Cancer Detected by Tailored High Density cDNA Arrays, *Molecular Medicine* 6(9) 750-765 (2000).

Backert, et al., Differential Gene Expression in Colon Carcinoma Cells and Tissues Detected with a cDNA Array, Int. J. Cancer, 82, 868-874 (1999).

Gariboldi, et al., SCCA2-like Serpins Mediate Genetic Predisposition to Skin Tumors, Cancer Research 63, 1871-1875 (Apr. 15, 2003).

* cited by examiner

```
  1  GCCAGATTCGGCACGAGGGGCGTAGGACCCTCCGAGCCAGGTGTGTGGATATAGTCTCGGTGGTGCGCCGTGTTTTTAAGCCG      80
 81  GTCTGAAAAGCGCAATATTCGGGTGGAGTGACCCGATTTTCCAGGCTGCTATCCATGTCCAGGCCCAAACATGAATCCT        160
161  ATTGCTCTTGGGAGCCGCTGGCTTGCTTATGCAGAAAACAAGTTGATTCGATGTCATCAGTCCGTGGTGGAGCCTGTGG        240
241  AGACAACATTCAGTCTTATACTGCCACAGTCATTAGTGTCTGCTAAAACATTGAAAAGTGCCTGACAATGTAGGAAAG         320
321  TGGTGACTCAGCTGACAGGCACACTGCCTTCAGGTGTGATGACAGAAGATGTTGCCATCACACAGTAATTCACGGCGAGT       400
401  CCTTTGGTCCCAGGCATCATCACAGTTATTGACACGAAACCGTTGGAGAGGGCCAGGTCTTGTGAGTGAGGATTCTGA         480
481  CAGTGATGGCATTGTGGCCACTTCCCTGCCCATGAGAAGCCAGTGTCTGCATGGCTTTAATACAAGTGAATGCTTC           560
561  TAGTCACAGACATCGTATATCTTCATGTCTTCAAATTCTGACTCCTTGTCTCCTCATCCTTGTCCTCTATCACAATGTGCT      640
641  GTCCACCATCTGTATACTCTTCAGAGGGAGAAACTGAAGCCAAAGTACACAGACATCTGCTTCAGCCATGACTGTGCTG        720
721  GGTTGTGGTCAGTACTCTCCGGGTACTTCCCAGTTTCCCCATCAACCCTTATGGTGCCAGCCTTGTTGTTCGTACAC          800
801  ATATGTCACCAGAGTAGTGAATCGCATGAATGCTGGACTGGAAGAGATTGAACAGAACTGACG                        880
881  TCTAAGCAAGGAGGTCGCTGTAGCCCTGTTCCAGGTCTATCAAGCAGCCCTTCGGGTCACCCTTGCATGGGAAACTGAA        960
961  CAGCCAAGACTCCTATAACAATTTTACCAACAACCCTGCCAACCTGGCTCTCTCTTCCCAGCTTGATGTAG               1040
1041 TGATGCCTCTTGCACAAATCAAGCAGCCAATTGGGACCATCACCCAAACGAACCGGGCCTTATCTCTTGGAGCG           1120
1121 GGGTGTTTTTCCATAAAGCCCATGCAAAGTTAAACCTCCTCCACAAATTCACCCAGCAAATTGATGGGGAGAATT          1200
1201 TTGTGTGGCTGCTATCTTCGGAACATCCAGGTCATGGTTGCAAATAAGCAGGTCTGAAAAGAGAAAAGATCAGTCCA        1280
```

```
  1   CGAGAACTCTGAGTAACAGCTCAGGCTCCACCAGCGGCAGCATACCAAGAAACTTGATGGCTACCGATCTCCGCTGCCC     0
  1                                                                                   80

1       GCCAGCCCCTCAGCCCTTCCGACTGGCTTCCGGTAGTACCAGCAACCTGCTTCTGACTGGCCAGCCC            70
 81   ACCAATGAGAGCCAGCCCCTCAGCCCTCTCAGCCCTTCCGACTGGCTTCCGGTAGTACCAGCAACCTGCTTCTGACTGGCCAGCCC   160
      ***********************************************************

71   CCTCCCCTGCTGGAGGGGAGAGCCCCGCTCTGTCCTACCCTTCAGTCTCTGCTCTTCTTCCATCAACCACTTCC            150
161   CCTCCCCTGCTGGAGGGGAGAGCCCCGCTCTGTCCTACCCTTCAGTCTCTGCTCTTCTTCCATCAACCACTTCC           240
      **********************************************************

151   CCAAGCTTAGTGACAGCAGCCGCAGCCCCATCCTACCTGGATGGAGAGAGACCCTTCTCCAAGCACCTCAGCGCACTTGCCCT   230
241   CCAAGCTTAGTGACAGCAGCCGCAGCCCCATCCTACCTGGATGGAGAGAGACCCTTCTCCAAGCACCTCAGCGCACTTGCCCT   320
      **********************************************************

231   CTGCCACACCTGTCGGTGTGAGGCTGTGCCAGGAGACTGTAGAAGCTCGGTCCTGTGTATGTTTGCA                  300
321   CTGCCACACCTGTCGGTGTGAGGCTGTGCCAGGAGACTGTAGAAGCTCGGTCCTGTGTATGTTTGCATATGACATCC         400
      ******************************************************

301   TGCATTGGATCCGCTTTTGTATTTTTAACCATACCCACGGTGGGGGAGCCTGAACAGTGACCAGATCT                  300
401                                                                                       480

301   GGGGGCCTGAGTGGGACAGAGTTGATCGTCCACTGGCCATTTGACCCTGAGTGACAGTCACAGCCTCAGCTCATGT          300
481                                                                                       560

301   CTGGCTGTGACACACTGCCCCCAGCTTCCCTTGTCAGCCCCACTCCAGCACGGGTGAACGGAGCCCAGAGTACTA           300
561                                                                                       640

301   GGGAAGGAGGAAGGGAGGAGGACATGCCTCTTCTCCCATCGTTCCTGGAAGAGTTGTCTTCTTAT                     300
641                                                                                       720

301   CTTTAAGCCCCTTTACCCTGGTCCCTGTACTGATCAGTGAACCGTGGTTACTCAGGCCCTGTTGAAAAGTGCACGT          300
721                                                                                       800

301   CTTGTCCAATAAATCACGCTGCAGTTGAAAAAAAAAAAAGATCTTTAATTAAGCGGCCGCAAGCTTATT                 300
801                                                                                       880

301   CCCTTTAGTGAGGGTTAATTTTAGCTTGGCCACTGGCCGTCGTTTTACAACGTCGTGACTGGTAAACCCTGGCGTTACCCA     300
881                                                                                       960

301   ACTTAATCGCCTTGCAGCACATCCCCCTTTCGCCAGCTGGCGTAATAGCGAAGAGGCCCGCACCGATCGCCCTTCCCAAC      300
961                                                                                      1040

301   AGTTGCGCAGCCTGAATGGCGAATGGGACGCGCCCTGTAGCGGCGCATTAAGCGCGGCGGGTGTGGTGGTTACGCGCAG       300
1041                                                                                     1120

301   CGTGACCGCTACACTTGCCAGCGCCCTAGCGCCCGCTCCTTTCGCTTTCTTCCCTTCCTTTCTCGCCACGTTCGCCGGC       300
1121                                                                                     1200

301   TTTCCCCGTCAAGCTCTAAATCGGGGGCTCCCTTTAGGGTTCCGATTTAGTGCTTTACGGCACCTCGACCCCAAAA         300
1201                                                                                     1280

301   AACTTGATTAGGGTGATGGTTCACGTAGTGGGCCATCGCCCTGATAAGCGGTTTTTCGCCCTTTGACGTTGGAGTCCAC       300
1281                                                                                     1360

301   GTTCT                                                                               300
1361                                                                                     1365
```

FIG. 2

GENE PRODUCTS DIFFERENTIALLY EXPRESSED IN CANCEROUS CELLS AND THEIR METHODS OF USE II

SEQUENCE LISTING AND TABLES

A Sequence Listing is provided as part of this specification on triplicate compact discs, filed concurrently herewith, which compact discs named "Copy 1", "Copy 2", and "CRF" each of which compact discs contain the following file: "SEQLIST.TXT", created Feb. 10, 2004, of 18 Megabytes, which is incorporated herein by reference in its entirety.

The present application also incorporates by reference Tables 2, 17, 18, 41A, 41B, 70A, 70B, 83, 84, 85, 86, 106, 107A, 107B, 110, 114, 130, 131A, 131B, 133, 134, 141, 143, 151 and 162 contained on duplicate compact discs filed concurrently herewith, which compact discs are labeled "Atty Docket 21302.001 Tables Copy 1" and "Atty Docket 21302.001 Tables Copy 2". The details of these Tables are further described later in this disclosure. These compact discs were created on Feb. 10, 2004. The sizes of the Tables are as follows: Table 2: 147 kilobytes; Table 17: 344 kilobytes; Table 18: 372 kilobytes; Table 41A: 98 kilobytes; Table 41B: 41 kilobytes; Table 70A: 90 kilobytes; Table 70B: 72 kilobytes; Table 83: 60 kilobytes; Table 84: 94 kilobytes; Table 85: 251 kilobytes; Table 86: 232 kilobytes; Table 106: 148 kilobytes; Table 107A: 193 kilobytes; Table 107B: 138 kilobytes; Table 110: 278 kilobytes; Table 114: 11 kilobytes; Table 130: 395 kilobytes; Table 131A: 569 kilobytes; Table 131B: 354 kilobytes; Table 133: 40 kilobytes; Table 134: 8 kilobytes; Table 141: 402 kilobytes; Table 143: 98 kilobytes; Table 151: 8 kilobytes; and Table 162: 684 kilobytes.

the genetic factors that are responsible for the phenotypes associated with development of, for example, the metastatic phenotype. Identification of gene products that are differentially expressed at various stages, and in various types of cancers, can both provide for early diagnostic tests, and further serve as therapeutic targets. Additionally, the product of a differentially expressed gene can be the basis for screening assays to identify chemotherapeutic agents that modulate its activity (e.g. its expression, biological activity, and the like).

Early disease diagnosis is of central importance to halting disease progression, and reducing morbidity. Analysis of a patient's tumor to identify the gene products that are differentially expressed, and administration of therapeutic agent(s) designed to modulate the activity of those differentially expressed gene products, provides the basis for more specific, rational cancer therapy that may result in diminished adverse side effects relative to conventional therapies. Furthermore, confirmation that a tumor poses less risk to the patient (e.g., that the tumor is benign) can avoid unnecessary therapies. In short, identification of genes and the encoded gene products that are differentially expressed in cancerous cells can provide the basis of therapeutics, diagnostics, prognostics, therametrics, and the like.

For example, breast cancer is a leading cause of death among women. One of the priorities in breast cancer research is the discovery of new biochemical markers that can be used for diagnosis, prognosis and monitoring of breast cancer. The prognostic usefulness of these markers depends on the ability of the marker to distinguish between patients with breast cancer who require aggressive therapeutic treatment and patients who should be monitored.

LENGTHY TABLES

The patent contains a lengthy table section. A copy of the table is available in electronic form from the USPTO web site (http://seqdata.uspto.gov/?pageRequest=docDetail&DocID=US08101349B2). An electronic copy of the table will also be available from the USPTO upon request and payment of the fee set forth in 37 CFR 1.19(b)(3).

FIELD OF THE INVENTION

The present invention relates to polynucleotides of human origin in substantially isolated form and gene products that are differentially expressed in cancer cells, and uses thereof.

BACKGROUND OF THE INVENTION

Cancer, like many diseases, is not the result of a single, well-defined cause, but rather can be viewed as several diseases, each caused by different aberrations in informational pathways, that ultimately result in apparently similar pathologic phenotypes. Identification of polynucleotides that correspond to genes that are differentially expressed in cancerous, pre-cancerous, or low metastatic potential cells relative to normal cells of the same tissue type, provides the basis for diagnostic tools, facilitates drug discovery by providing for targets for candidate agents, and further serves to identify therapeutic targets for cancer therapies that are more tailored for the type of cancer to be treated.

Identification of differentially expressed gene products also furthers the understanding of the progression and nature of complex diseases such as cancer, and is key to identifying While the pathogenesis of breast cancer is unclear, transformation of non-tumorigenic breast epithelium to a malignant phenotype may be the result of genetic factors, especially in women under 30 (Miki, et al., Science, 266: 66-71, 1994). However, it is likely that other, non-genetic factors are also significant in the etiology of the disease. Regardless of its origin, breast cancer morbidity increases significantly if a lesion is not detected early in its progression. Thus, considerable effort has focused on the elucidation of early cellular events surrounding transformation in breast tissue. Such effort has led to the identification of several potential breast cancer markers.

Thus, the identification of new markers associated with cancer, for example, breast cancer, and the identification of genes involved in transforming cells into the cancerous phenotype, remains a significant goal in the management of this disease. In exemplary aspects, the invention described herein provides cancer diagnostics, prognostics, therametrics, and therapeutics based upon polynucleotides and/or their encoded gene products.

SUMMARY OF THE INVENTION

The present invention provides methods and compositions useful in detection of cancerous cells, identification of agents that modulate the phenotype of cancerous cells, and identification of therapeutic targets for chemotherapy of cancerous cells. Cancerous, breast, colon and prostate cells are of particular interest in each of these aspects of the invention. More specifically, the invention provides polynucleotides in substantially isolated form, as well as polypeptides encoded thereby, that are differentially expressed in cancer cells. Also provided are antibodies that specifically bind the encoded polypeptides. These polynucleotides, polypeptides and antibodies are thus useful in a variety of diagnostic, therapeutic, and drug discovery methods. In some embodiments, a polynucleotide that is differentially expressed in cancer cells can be used in diagnostic assays to detect cancer cells. In other embodiments, a polynucleotide that is differentially expressed in cancer cells, and/or a polypeptide encoded thereby, is itself a target for therapeutic intervention.

Accordingly, the invention features an isolated polynucleotide comprising a nucleotide sequence having at least 90% sequence identity to an identifying sequence of any one of the sequences set forth herein or a degenerate variant thereof. In related aspects, the invention features recombinant host cells and vectors comprising the polynucleotides of the invention, as well as isolated polypeptides encoded by the polynucleotides of the invention and antibodies that specifically bind such polypeptides.

In other aspects, the invention provides a method for detecting a cancerous cell. In general, the method involves contacting a test sample obtained from a cell that is suspected of being a cancer cell with a probe for detecting a gene product differentially expressed in cancer. Many embodiments of the invention involve a gene identifiable by or comprising a sequence selected from the group consisting of SEQ ID NOS: 1-23767, contacting the probe and the gene product for a time sufficient for binding of the probe to the gene product; and comparing a level of binding of the probe to the sample with a level of probe binding to a control sample obtained from a control cell of known cancerous state. A modulated (i.e. increased or decreased) level of binding of the probe in the test cell sample relative to the level of binding in a control sample is indicative of the cancerous state of the test cell. In certain embodiments, the level of binding of the probe in the test cell sample, usually in relation to at least one control gene, is similar to binding of the probe to a cancerous cell sample. In certain other embodiments, the level of binding of the probe in the test cell sample, usually in relation to at least one control gene, is different, i.e. opposite, to binding of the probe to a non-cancerous cell sample. In specific embodiments, the probe is a polynucleotide probe and the gene product is nucleic acid. In other specific embodiments, the gene product is a polypeptide. In further embodiments, the gene product or the probe is immobilized on an array.

In another aspect, the invention provides a method for assessing the cancerous phenotype (e.g., metastasis, metastatic potential, aberrant cellular proliferation, and the like) of a cell comprising detecting expression of a gene product in a test cell sample, wherein the gene comprises or is identifiable using a sequence selected from the group consisting of SEQ ID NOS: 1-23767; and comparing a level of expression of the gene product in the test cell sample with a level of expression of the gene in a control cell sample. Comparison of the level of expression of the gene in the test cell sample relative to the level of expression in the control cell sample is indicative of the cancerous phenotype of the test cell sample. In specific embodiments, detection of gene expression is by detecting a level of an RNA transcript in the test cell sample. In other specific embodiments detection of expression of the gene is by detecting a level of a polypeptide in a test sample.

In another aspect, the invention provides a method for suppressing or inhibiting a cancerous phenotype of a cancerous cell, the method comprising introducing into a mammalian cell an expression modulatory agent (e.g. an antisense molecule, small molecule, antibody, neutralizing antibody, inhibitory RNA molecule, etc.) to inhibit expression of a gene identified by a sequence selected from the group consisting of SEQ ID NOS: 1-23767. Inhibition of expression of the gene inhibits development of a cancerous phenotype in the cell. In specific embodiments, the cancerous phenotype is metastasis, aberrant cellular proliferation relative to a normal cell, or loss of contact inhibition of cell growth. In the context of this invention "expression" of a gene is intended to encompass the expression of an activity of a gene product, and, as such, inhibiting expression of a gene includes inhibiting the activity of a product of the gene.

In another aspect, the invention provides a method for assessing the tumor burden of a subject, the method comprising detecting a level of a differentially expressed gene product in a test sample from a subject suspected of or having a tumor, the differentially expressed gene product identified by or comprising a sequence selected from the group consisting of SEQ ID NOS: 1-23767. Detection of the level of the gene product in the test sample is indicative of the tumor burden in the subject.

In another aspect, the invention provides a method for identifying agents that modulate (i.e. increase or decrease) the biological activity of a gene product differentially expressed in a cancerous cell, the method comprising contacting a candidate agent with a differentially expressed gene product, the differentially expressed gene product corresponding to a sequence selected from the group consisting of SEQ ID NOS: 1-23767; and detecting a modulation in a biological activity of the gene product relative to a level of biological activity of the gene product in the absence of the candidate agent. In specific embodiments, the detecting is by identifying an increase or decrease in expression of the differentially expressed gene product. In other specific embodiments, the gene product is mRNA or cDNA prepared from the mRNA gene product. In further embodiments, the gene product is a polypeptide.

In another aspect, the invention provides a method of inhibiting growth of a tumor cell by modulating expression of a gene product, where the gene product is encoded by a gene identified by a sequence selected from the group consisting of: SEQ ID NOS:1-23767.

These and other objects, advantages, and features of the invention will become apparent to those persons skilled in the art upon reading the details of the invention as more fully described below.

BRIEF DESCRIPTION OF THE FIGURES

FIGS. 1A-1B is a comparison of SEQ ID NO:15951 and clone H72034 (SEQ ID NO:15983).

FIG. 2 is a comparison of SEQ ID NO:15982 and clone AA707002 (SEQ ID NO:15984).

DETAILED DESCRIPTION OF THE INVENTION

The present invention provides polynucleotides, as well as polypeptides encoded thereby, that are differentially expressed in cancer cells. Methods are provided in which these polynucleotides and polypeptides are used for detecting and reducing the growth of cancer cells. Also provided are methods in which the polynucleotides and polypeptides of the invention are used in a variety of diagnostic and therapeutic applications for cancer. The invention finds use in the prevention, treatment, detection or research into any cancer, including prostrate, pancreas, colon, brain, lung, breast, bone, skin cancers, etc.

Before the present invention is described, it is to be understood that this invention is not limited to particular embodiments described, as such may, of course, vary. It is also to be understood that the terminology used herein is for the purpose of describing particular embodiments only, and is not intended to be limiting.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, the preferred methods and materials are now described. All publications and patent applications mentioned herein are incorporated herein by reference to disclose and describe the methods and/or materials in connection with which the publications are cited.

It must be noted that as used herein and in the appended claims, the singular forms "a", "and", and "the" include plural referents unless the context clearly dictates otherwise. Thus, for example, reference to "a polynucleotide" includes a plurality of such polynucleotides and reference to "the cancer cell" includes reference to one or more cells and equivalents thereof known to those skilled in the art, and so forth.

The publications and applications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

Definitions

The terms "polynucleotide" and "nucleic acid", used interchangeably herein, refer to polymeric forms of nucleotides of any length, either ribonucleotides or deoxynucleotides. Thus, these terms include, but are not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. These terms further include, but are not limited to, mRNA or cDNA that comprise intronic sequences (see, e.g., Niwa et al. (1999) Cell 99(7):691-702). The backbone of the polynucleotide can comprise sugars and phosphate groups (as may typically be found in RNA or DNA), or modified or substituted sugar or phosphate groups. Alternatively, the backbone of the polynucleotide can comprise a polymer of synthetic subunits such as phosphoramidites and thus can be an oligodeoxynucleoside phosphoramidate or a mixed phosphoramidate-phosphodiester oligomer. Peyrottes et al. (1996) Nucl. Acids Res. 24:1841-1848; Chaturvedi et al. (1996) Nucl. Acids Res. 24:2318-2323. A polynucleotide may comprise modified nucleotides, such as methylated nucleotides and nucleotide analogs, uracyl, other sugars, and linking groups such as fluororibose and thioate, and nucleotide branches. The sequence of nucleotides may be interrupted by non-nucleotide components. A polynucleotide may be further modified after polymerization, such as by conjugation with a labeling component. Other types of modifications included in this definition are caps, substitution of one or more of the naturally occurring nucleotides with an analog, and introduction of means for attaching the polynucleotide to proteins, metal ions, labeling components, other polynucleotides, or a solid support. The term "polynucleotide" also encompasses peptidic nucleic acids (Pooga et al Curr Cancer Drug Targets. (2001) 1:231-9).

A "gene product" is a biopolymeric product that is expressed or produced by a gene. A gene product may be, for example, an unspliced RNA, an mRNA, a splice variant mRNA, a polypeptide, a post-translationally modified polypeptide, a splice variant polypeptide etc. Also encompassed by this term is biopolymeric products that are made using an RNA gene product as a template (i.e. cDNA of the RNA). A gene product may be made enzymatically, recombinantly, chemically, or within a cell to which the gene is native. In many embodiments, if the gene product is proteinaceous, it exhibits a biological activity. In many embodiments, if the gene product is a nucleic acid, it can be translated into a proteinaceous gene product that exhibits a biological activity.

A composition (e.g. a polynucleotide, polypeptide, antibody, or host cell) that is "isolated" or "in substantially isolated form" refers to a composition that is in an environment different from that in which the composition naturally occurs. For example, a polynucleotide that is in substantially isolated form is outside of the host cell in which the polynucleotide naturally occurs, and could be a purified fragment of DNA, could be part of a heterologous vector, or could be contained within a host cell that is not a host cell from which the polynucleotide naturally occurs. The term "isolated" does not refer to a genomic or cDNA library, whole cell total protein or mRNA preparation, genomic DNA preparation, or an isolated human chromosome. A composition which is in substantially isolated form is usually substantially purified.

As used herein, the term "substantially purified" refers to a compound (e.g., a polynucleotide, a polypeptide or an antibody, etc.) that is removed from its natural environment and is usually at least 60% free, preferably 75% free, and most preferably 90% free from other components with which it is naturally associated. Thus, for example, a composition containing A is "substantially free of" B when at least 85% by weight of the total A+B in the composition is A. Preferably, A comprises at least about 90% by weight of the total of A+B in the composition, more preferably at least about 95% or even 99% by weight. In the case of polynucleotides, "A" and "B" may be two different genes positioned on different chromosomes or adjacently on the same chromosome, or two isolated cDNA species, for example.

The terms "polypeptide" and "protein", interchangeably used herein, refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

"Heterologous" refers to materials that are derived from different sources (e.g., from different genes, different species, etc.).

As used herein, the terms "a gene that is differentially expressed in a cancer cell," and "a polynucleotide that is differentially expressed in a cancer cell" are used interchangeably herein, and generally refer to a polynucleotide that represents or corresponds to a gene that is differentially expressed in a cancerous cell when compared with a cell of the same cell type that is not cancerous, e.g., mRNA is found at levels at least about 25%, at least about 50% to about 75%, at least about 90%, at least about 1.5-fold, at least about 2-fold, at least about 5-fold, at least about 10-fold, or at least about 50-fold or more, different (e.g., higher or lower). The comparison can be made in tissue, for example, if one is using in situ hybridization or another assay method that allows some degree of discrimination among cell types in the tissue. The comparison may also or alternatively be made between cells removed from their tissue source.

"Differentially expressed polynucleotide" as used herein refers to a nucleic acid molecule (RNA or DNA) comprising a sequence that represents a differentially expressed gene, e.g., the differentially expressed polynucleotide comprises a sequence (e.g., an open reading frame encoding a gene product; a non-coding sequence) that uniquely identifies a differentially expressed gene so that detection of the differentially expressed polynucleotide in a sample is correlated with the presence of a differentially expressed gene in a sample. "Differentially expressed polynucleotides" is also meant to encompass fragments of the disclosed polynucleotides, e.g., fragments retaining biological activity, as well as nucleic acids homologous, substantially similar, or substantially identical (e.g., having about 90% sequence identity) to the disclosed polynucleotides.

"Corresponds to" or "represents" when used in the context of, for example, a polynucleotide or sequence that "corresponds to" or "represents" a gene means that at least a portion of a sequence of the polynucleotide is present in the gene or in the nucleic acid gene product (e.g., mRNA or cDNA). A subject nucleic acid may also be "identified" by a polynucleotide if the polynucleotide corresponds to or represents the gene. Genes identified by a polynucleotide may have all or a portion of the identifying sequence wholly present within an exon of a genomic sequence of the gene, or different portions of the sequence of the polynucleotide may be present in different exons (e.g., such that the contiguous polynucleotide sequence is present in an mRNA, either pre- or post-splicing, that is an expression product of the gene). In some embodiments, the polynucleotide may represent or correspond to a gene that is modified in a cancerous cell relative to a normal cell. The gene in the cancerous cell may contain a deletion, insertion, substitution, or translocation relative to the polynucleotide and may have altered regulatory sequences, or may encode a splice variant gene product, for example. The gene in the cancerous cell may be modified by insertion of an endogenous retrovirus, a transposable element, or other naturally occurring or non-naturally occurring nucleic acid. In most cases, a polynucleotide corresponds to or represents a gene if the sequence of the polynucleotide is most identical to the sequence of a gene or its product (e.g. mRNA or cDNA) as compared to other genes or their products. In most embodiments, the most identical gene is determined using a sequence comparison of a polynucleotide to a database of polynucleotides (e.g. GenBank) using the BLAST program at default settings For example, if the most similar gene in the human genome to an exemplary polynucleotide is the protein kinase C gene, the exemplary polynucleotide corresponds to protein kinase C. In most cases, the sequence of a fragment of an exemplary polynucleotide is at least 95%, 96%, 97%, 98%, 99% or up to 100% identical to a sequence of at least 15, 20, 25, 30, 35, 40, 45, or 50 contiguous nucleotides of a corresponding gene or its product (mRNA or cDNA), when nucleotides that are "N" represent G, A, T or C.

An "identifying sequence" is a minimal fragment of a sequence of contiguous nucleotides that uniquely identifies or defines a polynucleotide sequence or its complement. In many embodiments, a fragment of a polynucleotide uniquely identifies or defines a polynucleotide sequence or its complement. In some embodiments, the entire contiguous sequence of a gene, cDNA, EST, or other provided sequence is an identifying sequence.

"Diagnosis" as used herein generally includes determination of a subject's susceptibility to a disease or disorder, determination as to whether a subject is presently affected by a disease or disorder, prognosis of a subject affected by a disease or disorder (e.g., identification of pre-metastatic or metastatic cancerous states, stages of cancer, or responsiveness of cancer to therapy), and use of therametrics (e.g., monitoring a subject's condition to provide information as to the effect or efficacy of therapy).

As used herein, the term "a polypeptide associated with cancer" refers to a polypeptide encoded by a polynucleotide that is differentially expressed in a cancer cell.

The term "biological sample" encompasses a variety of sample types obtained from an organism and can be used in a diagnostic or monitoring assay. The term encompasses blood and other liquid samples of biological origin, solid tissue samples, such as a biopsy specimen or tissue cultures or cells derived therefrom and the progeny thereof. The term encompasses samples that have been manipulated in any way after their procurement, such as by treatment with reagents, solubilization, or enrichment for certain components. The term encompasses a clinical sample, and also includes cells in cell culture, cell supernatants, cell lysates, serum, plasma, biological fluids, and tissue samples.

The terms "treatment", "treating", "treat" and the like are used herein to generally refer to obtaining a desired pharmacologic and/or physiologic effect. The effect may be prophylactic in terms of completely or partially preventing a disease or symptom thereof and/or may be therapeutic in terms of a partial or complete stabilization or cure for a disease and/or adverse effect attributable to the disease. "Treatment" as used herein covers any treatment of a disease in a mammal, particularly a human, and includes: (a) preventing the disease or symptom from occurring in a subject which may be predisposed to the disease or symptom but has not yet been diagnosed as having it; (b) inhibiting the disease symptom, i.e., arresting its development; or (c) relieving the disease symptom, i.e., causing regression of the disease or symptom.

The terms "individual," "subject," "host," and "patient," used interchangeably herein and refer to any mammalian subject for whom diagnosis, treatment, or therapy is desired, particularly humans. Other subjects may include cattle, dogs, cats, guinea pigs, rabbits, rats, mice, horses, and the like.

A "host cell", as used herein, refers to a microorganism or a eukaryotic cell or cell line cultured as a unicellular entity which can be, or has been, used as a recipient for a recombinant vector or other transfer polynucleotides, and include the progeny of the original cell which has been transfected. It is understood that the progeny of a single cell may not necessarily be completely identical in morphology or in genomic or total DNA complement as the original parent, due to natural, accidental, or deliberate mutation.

The terms "cancer", "neoplasm", "tumor", and "carcinoma", are used interchangeably herein to refer to cells which exhibit relatively autonomous growth, so that they exhibit an aberrant growth phenotype characterized by a significant loss of control of cell proliferation. In general, cells of interest for detection or treatment in the present application include pre-cancerous (e.g., benign), malignant, pre-metastatic, metastatic, and non-metastatic cells. Detection of cancerous cells is of particular interest.

The term "normal" as used in the context of "normal cell," is meant to refer to a cell of an untransformed phenotype or exhibiting a morphology of a non-transformed cell of the tissue type being examined.

"Cancerous phenotype" generally refers to any of a variety of biological phenomena that are characteristic of a cancerous cell, which phenomena can vary with the type of cancer. The cancerous phenotype is generally identified by abnormalities in, for example, cell growth or proliferation (e.g., uncontrolled growth or proliferation), regulation of the cell cycle, cell mobility, cell-cell interaction, or metastasis, etc.

"Therapeutic target" generally refers to a gene or gene product that, upon modulation of its activity (e.g., by modulation of expression, biological activity, and the like), can provide for modulation of the cancerous phenotype.

As used throughout, "modulation" is meant to refer to an increase or a decrease in the indicated phenomenon (e.g., modulation of a biological activity refers to an increase in a biological activity or a decrease in a biological activity).

Polynucleotide Compositions

The present invention provides isolated polynucleotides that contain nucleic acids that are differentially expressed in cancer cells. The polynucleotides, as well as any polypeptides encoded thereby, find use in a variety of therapeutic and diagnostic methods.

The scope of the invention with respect to compositions containing the isolated polynucleotides useful in the methods described herein includes, but is not necessarily limited to, polynucleotides having (i.e., comprising) a sequence set forth in any one of the polynucleotide sequences provided herein, or fragment thereof, polynucleotides obtained from the biological materials described herein or other biological sources (particularly human sources) by hybridization under stringent conditions (particularly conditions of high stringency); genes corresponding to the provided polynucleotides; cDNAs corresponding to the provided polynucleotides; variants of the provided polynucleotides and their corresponding genes, particularly those variants that retain a biological activity of the encoded gene product (e.g., a biological activity ascribed to a gene product corresponding to the provided polynucleotides as a result of the assignment of the gene product to a protein family(ies) and/or identification of a functional domain present in the gene product). Other nucleic acid compositions contemplated by and within the scope of the present invention will be readily apparent to one of ordinary skill in the art when provided with the disclosure here. "Polynucleotide" and "nucleic acid" as used herein with reference to nucleic acids of the composition is not intended to be limiting as to the length or structure of the nucleic acid unless specifically indicated.

The invention features polynucleotides that represent genes that are expressed in human tissue, specifically polynucleotides that are differentially expressed in tissues containing cancerous cells. Nucleic acid compositions described herein of particular interest are at least about 15 bp in length, at least about 30 bp in length, at least about 50 bp in length, at least about 100 bp, at least about 200 bp in length, at least about 300 bp in length, at least about 500 bp in length, at least about 800 bp in length, at least about 1 kb in length, at least about 2.0 kb in length, at least about 3.0 kb in length, at least about 5 kb in length, at least about 10 kb in length, at least about 50 kb in length and are usually less than about 200 kb in length. These polynucleotides (or polynucleotide fragments) have uses that include, but are not limited to, diagnostic probes and primers as starting materials for probes and primers, as discussed herein.

The subject polynucleotides usually comprise a sequence set forth in any one of the polynucleotide sequences provided herein, for example, in the sequence listing, incorporated by reference in a table (e.g. by an NCBI accession number), a cDNA deposited at the A.T.C.C., or a fragment or variant thereof. A "fragment" or "portion" of a polynucleotide is a contiguous sequence of residues at least about 10 nt to about 12 nt, 15 nt, 16 nt, 18 nt or 20 nt in length, usually at least about 22 nt, 24 nt, 25 nt, 30 nt, 40 nt, 50 nt, 60 nt, 70 nt, 80 nt, 90 nt, 100 nt to at least about 150 nt, 200 nt, 250 nt, 300 nt, 350 nt, 400 nt, 500 nt, 800 nt or up to about 1000 nt, 1500 or 2000 nt in length. In some embodiments, a fragment of a polynucleotide is the coding sequence of a polynucleotide. A fragment of a polynucleotide may start at position 1 (i.e. the first nucleotide) of a nucleotide sequence provided herein, or may start at about position 10, 20, 30, 50, 75, 100, 150, 200, 250, 300, 350, 400, 450, 500, 600, 700, 800, 900, 1000, 1500 or 2000, or an ATG translational initiation codon of a nucleotide sequence provided herein. In this context "about" includes the particularly recited value or a value larger or smaller by several (5, 4, 3, 2, or 1) nucleotides. The described polynucleotides and fragments thereof find use as hybridization probes, PCR primers, BLAST probes, or as an identifying sequence, for example.

The subject nucleic acids may be variants or degenerate variants of a sequence provided herein. In general, a variants of a polynucleotide provided herein have a fragment of sequence identity that is greater than at least about 65%, greater than at least about 70%, greater than at least about 75%, greater than at least about 80%, greater than at least about 85%, or greater than at least about 90%, 95%, 96%, 97%, 98%, 99% or more (i.e. 100%) as compared to an identically sized fragment of a provided sequence. as determined by the Smith-Waterman homology search algorithm as implemented in MPSRCH program (Oxford Molecular). For the purposes of this invention, a preferred method of calculating percent identity is the Smith-Waterman algorithm. Global DNA sequence identity should be greater than 65% as determined by the Smith-Waterman homology search algorithm as implemented in MPSRCH program (Oxford Molecular) using an gap search with the following search parameters: gap open penalty, 12; and gap extension penalty, 1.

The subject nucleic acid compositions include full-length cDNAs or mRNAs that encompass an identifying sequence of contiguous nucleotides from any one of the polynucleotide sequences provided herein.

As discussed above, the polynucleotides useful in the methods described herein also include polynucleotide variants having sequence similarity or sequence identity. Nucleic acids having sequence similarity are detected by hybridization under low stringency conditions, for example, at 50° C. and 10×SSC (0.9 M saline/0.09 M sodium citrate) and remain bound when subjected to washing at 55° C. in 1×SSC. Sequence identity can be determined by hybridization under high stringency conditions, for example, at 50° C. or higher and 0.1×SSC (9 mM saline/0.9 mM sodium citrate). Hybridization methods and conditions are well known in the art, see, e.g., U.S. Pat. No. 5,707,829. Nucleic acids that are substantially identical to the provided polynucleotide sequences, e.g. allelic variants, genetically altered versions of the gene, etc., bind to the provided polynucleotide sequences under stringent hybridization conditions. By using probes, particularly labeled probes of DNA sequences, one can isolate homologous or related genes. The source of homologous genes can be any species, e.g. primate species, particularly human;

rodents, such as rats and mice; canines, felines, bovines, ovines, equines, yeast, nematodes, etc.

In one embodiment, hybridization is performed using a fragment of at least 15 contiguous nucleotides (nt) of at least one of the polynucleotide sequences provided herein. That is, when at least 15 contiguous nt of one of the disclosed polynucleotide sequences is used as a probe, the probe will preferentially hybridize with a nucleic acid comprising the complementary sequence, allowing the identification and retrieval of the nucleic acids that uniquely hybridize to the selected probe. Probes from more than one polynucleotide sequence provided herein can hybridize with the same nucleic acid if the cDNA from which they were derived corresponds to one mRNA.

Polynucleotides contemplated for use in the invention also include those having a sequence of naturally occurring variants of the nucleotide sequences (e.g., degenerate variants (e.g., sequences that encode the same polypeptides but, due to the degenerate nature of the genetic code, different in nucleotide sequence), allelic variants, etc.). Variants of the polynucleotides contemplated by the invention are identified by hybridization of putative variants with nucleotide sequences disclosed herein, preferably by hybridization under stringent conditions. For example, by using appropriate wash conditions, variants of the polynucleotides described herein can be identified where the allelic variant exhibits at most about 25-30% base pair (bp) mismatches relative to the selected polynucleotide probe. In general, allelic variants contain 15-25% bp mismatches, and can contain as little as even 5-15%, or 2-5%, or 1-2% bp mismatches, as well as a single bp mismatch.

The invention also encompasses homologs corresponding to any one of the polynucleotide sequences provided herein, where the source of homologous genes can be any mammalian species, e.g., primate species, particularly human; rodents, such as rats; canines, felines, bovines, ovines, equines, yeast, nematodes, etc. Between mammalian species, e.g., human and mouse, homologs generally have substantial sequence similarity, e.g., at least 75% sequence identity, usually at least 80%%, at least 85, at least 90%, at least 95%, at least 96%, at least 97%, at least 98%, at least 99% or even 100% identity between nucleotide sequences. Sequence similarity is calculated based on a reference sequence, which may be a subset of a larger sequence, such as a conserved motif, coding region, flanking region, etc. A reference sequence will usually be at least about a fragment of a polynucleotide sequence and may extend to the complete sequence that is being compared. Algorithms for sequence analysis are known in the art, such as gapped BLAST, described in Altschul, et al. *Nucleic Acids Res.* (1997) 25:3389-3402, or TeraBLAST available from TimeLogic Corp. (Crystal Bay, Nev.).

The subject nucleic acids can be cDNAs or genomic DNAs, as well as fragments thereof, particularly fragments that encode a biologically active gene product and/or are useful in the methods disclosed herein (e.g., in diagnosis, as a unique identifier of a differentially expressed gene of interest, etc.). The term "cDNA" as used herein is intended to include all nucleic acids that share the arrangement of sequence elements found in native mature mRNA species, where sequence elements are exons and 3' and 5' non-coding regions. Normally mRNA species have contiguous exons, with the intervening introns, when present, being removed by nuclear RNA splicing, to create a continuous open reading frame encoding a polypeptide. mRNA species can also exist with both exons and introns, where the introns may be removed by alternative splicing. Furthermore it should be noted that different species of mRNAs encoded by the same genomic sequence can exist at varying levels in a cell, and detection of these various levels of mRNA species can be indicative of differential expression of the encoded gene product in the cell.

A genomic sequence of interest comprises the nucleic acid present between the initiation codon and the stop codon, as defined in the listed sequences, including all of the introns that are normally present in a native chromosome. It can further include the 3' and 5' untranslated regions found in the mature mRNA. It can further include specific transcriptional and translational regulatory sequences, such as promoters, enhancers, etc., including about 1 kb, but possibly more, of flanking genomic DNA at either the 5' and 3' end of the transcribed region. The genomic DNA can be isolated as a fragment of 100 kbp or smaller; and substantially free of flanking chromosomal sequence. The genomic DNA flanking the coding region, either 3' and 5', or internal regulatory sequences as sometimes found in introns, contains sequences required for proper tissue, stage-specific, or disease-state specific expression.

The nucleic acid compositions of the subject invention can encode all or a part of the naturally-occurring polypeptides. Double or single stranded fragments can be obtained from the DNA sequence by chemically synthesizing oligonucleotides in accordance with conventional methods, by restriction enzyme digestion, by PCR amplification, etc.

Probes specific to the polynucleotides described herein can be generated using the polynucleotide sequences disclosed herein. The probes are usually a fragment of a polynucleotide sequences provided herein. The probes can be synthesized chemically or can be generated from longer polynucleotides using restriction enzymes. The probes can be labeled, for example, with a radioactive, biotinylated, or fluorescent tag. Preferably, probes are designed based upon an identifying sequence of any one of the polynucleotide sequences provided herein. More preferably, probes are designed based on a contiguous sequence of one of the subject polynucleotides that remain unmasked following application of a masking program for masking low complexity (e.g., XBLAST, RepeatMasker, etc.) to the sequence, i.e., one would select an unmasked region, as indicated by the polynucleotides outside the poly-n stretches of the masked sequence produced by the masking program.

The polynucleotides of interest in the subject invention are isolated and obtained in substantial purity, generally as other than an intact chromosome. Usually, the polynucleotides, either as DNA or RNA, will be obtained substantially free of other naturally-occurring nucleic acid sequences that they are usually associated with, generally being at least about 50%, usually at least about 90% pure and are typically "recombinant", e.g., flanked by one or more nucleotides with which it is not normally associated on a naturally occurring chromosome.

The polynucleotides described herein can be provided as a linear molecule or within a circular molecule, and can be provided within autonomously replicating molecules (vectors) or within molecules without replication sequences. Expression of the polynucleotides can be regulated by their own or by other regulatory sequences known in the art. The polynucleotides can be introduced into suitable host cells using a variety of techniques available in the art, such as transferrin polycation-mediated DNA transfer, transfection with naked or encapsulated nucleic acids, liposome-mediated DNA transfer, intracellular transportation of DNA-coated latex beads, protoplast fusion, viral infection, electroporation, gene gun, calcium phosphate-mediated transfection, and the like.

The nucleic acid compositions described herein can be used to, for example, produce polypeptides, as probes for the detection of mRNA in biological samples (e.g., extracts of human cells) or cDNA produced from such samples, to generate additional copies of the polynucleotides, to generate ribozymes or antisense oligonucleotides, and as single stranded DNA probes or as triple-strand forming oligonucleotides. The probes described herein can be used to, for example, determine the presence or absence of any one of the polynucleotide provided herein or variants thereof in a sample. These and other uses are described in more detail below.

Polypeptides and Variants Thereof

The present invention further provides polypeptides encoded by polynucleotides that represent genes that are differentially expressed in cancer cells. Such polypeptides are referred to herein as "polypeptides associated with cancer." The polypeptides can be used to generate antibodies specific for a polypeptide associated with cancer, which antibodies are in turn useful in diagnostic methods, prognostics methods, therametric methods, and the like as discussed in more detail herein. Polypeptides are also useful as targets for therapeutic intervention, as discussed in more detail herein.

The polypeptides contemplated by the invention include those encoded by the disclosed polynucleotides and the genes to which these polynucleotides correspond, as well as nucleic acids that, by virtue of the degeneracy of the genetic code, are not identical in sequence to the disclosed polynucleotides. Further polypeptides contemplated by the invention include polypeptides that are encoded by polynucleotides that hybridize to polynucleotide of the sequence listing. Thus, the invention includes within its scope a polypeptide encoded by a polynucleotide having the sequence of any one of the polynucleotide sequences provided herein, or a variant thereof.

In general, the term "polypeptide" as used herein refers to both the full length polypeptide encoded by the recited polynucleotide, the polypeptide encoded by the gene represented by the recited polynucleotide, as well as portions or fragments thereof. "Polypeptides" also includes variants of the naturally occurring proteins, where such variants are homologous or substantially similar to the naturally occurring protein, and can be of an origin of the same or different species as the naturally occurring protein (e.g., human, murine, or some other species that naturally expresses the recited polypeptide, usually a mammalian species). In general, variant polypeptides have a sequence that has at least about 80%, usually at least about 90%, and more usually at least about 98% sequence identity with a differentially expressed polypeptide described herein, as measured by BLAST 2.0 using the parameters described above. The variant polypeptides can be naturally or non-naturally glycosylated, i.e., the polypeptide has a glycosylation pattern that differs from the glycosylation pattern found in the corresponding naturally occurring protein.

The invention also encompasses homologs of the disclosed polypeptides (or fragments thereof) where the homologs are isolated from other species, i.e. other animal or plant species, where such homologs, usually mammalian species, e.g. rodents, such as mice, rats; domestic animals, e.g., horse, cow, dog, cat; and humans. By "homolog" is meant a polypeptide having at least about 35%, usually at least about 40% and more usually at least about 60% amino acid sequence identity to a particular differentially expressed protein as identified above, where sequence identity is determined using the BLAST 2.0 algorithm, with the parameters described supra.

In general, the polypeptides of interest in the subject invention are provided in a non-naturally occurring environment, e.g. are separated from their naturally occurring environment. In certain embodiments, the subject protein is present in a composition that is enriched for the protein as compared to a cell or extract of a cell that naturally produces the protein. As such, isolated polypeptide is provided, where by "isolated" or "in substantially isolated form" is meant that the protein is present in a composition that is substantially free of other polypeptides, where by substantially free is meant that less than 90%, usually less than 60% and more usually less than 50% of the composition is made up of other polypeptides of a cell that the protein is naturally found.

Also within the scope of the invention are variants; variants of polypeptides include mutants, fragments, and fusions. Mutants can include amino acid substitutions, additions or deletions. The amino acid substitutions can be conservative amino acid substitutions or substitutions to eliminate non-essential amino acids, such as to alter a glycosylation site, a phosphorylation site or an acetylation site, or to minimize misfolding by substitution or deletion of one or more cysteine residues that are not necessary for function. Conservative amino acid substitutions are those that preserve the general charge, hydrophobicity/hydrophilicity, and/or steric bulk of the amino acid substituted.

Variants can be designed so as to retain or have enhanced biological activity of a particular region of the protein (e.g., a functional domain and/or, where the polypeptide is a member of a protein family, a region associated with a consensus sequence). For example, muteins can be made which are optimized for increased antigenicity, i.e. amino acid variants of a polypeptide may be made that increase the antigenicity of the polypeptide. Selection of amino acid alterations for production of variants can be based upon the accessibility (interior vs. exterior) of the amino acid (see, e.g., Go et al, *Int. J. Peptide Protein Res.* (1980) 15:211), the thermostability of the variant polypeptide (see, e.g., Querol et al., *Prot. Eng.* (1996) 9:265), desired glycosylation sites (see, e.g., Olsen and Thomsen, *J. Gen. Microbiol.* (1991) 137:579), desired disulfide bridges (see, e.g., Clarke et al., *Biochemistry* (1993) 32:4322; and Wakarchuk et al., *Protein Eng.* (1994) 7:1379), desired metal binding sites (see, e.g., Toma et al., *Biochemistry* (1991) 30:97, and Haezerbrouck et al., *Protein Eng.* (1993) 6:643), and desired substitutions with in proline loops (see, e.g., Masul et al., *Appl. Env. Microbiol.* (1994) 60:3579). Cysteine-depleted muteins can be produced as disclosed in U.S. Pat. No. 4,959,314. Variants also include fragments of the polypeptides disclosed herein, particularly biologically active fragments and/or fragments corresponding to functional domains. Fragments of interest will typically be at least about 10 aa to at least about 15 aa in length, usually at least about 50 aa in length, and can be as long as 300 aa in length or longer, but will usually not exceed about 1000 aa in length, where the fragment will have a stretch of amino acids that is identical to a polypeptide encoded by a polynucleotide having a sequence of any one of the polynucleotide sequences provided herein, or a homolog thereof. The protein variants described herein are encoded by polynucleotides that are within the scope of the invention. The genetic code can be used to select the appropriate codons to construct the corresponding variants.

A fragment of a subject polypeptide is, for example, a polypeptide having an amino acid sequence which is a portion of a subject polypeptide e.g. a polypeptide encoded by a subject polynucleotide that is identified by any one of the sequence of SEQ ID NOS 1-499 or its complement. The polypeptide fragments of the invention are preferably at least about 9 aa, at least about 15 aa, and more preferably at least about 20 aa, still more preferably at least about 30 aa, and even more preferably, at least about 40 aa, at least about 50 aa, at least about 75 aa, at least about 100 aa, at least about 125 aa or at least about 150 aa in length. A fragment "at least 20 aa in length," for example, is intended to include 20 or more contiguous amino acids from, for example, the polypeptide encoded by a cDNA, in a cDNA clone contained in a deposited library, or a nucleotide sequence shown in SEQ ID NOS: 1-23767 or the complementary stand thereof. In this context "about" includes the particularly recited value or a value larger or smaller by several (5, 4, 3, 2, or 1) amino acids. These polypeptide fragments have uses that include, but are not limited to, production of antibodies as discussed herein. Of course, larger fragments (e.g., at least 150, 175, 200, 250, 500, 600, 1000, or 2000 amino acids in length) are also encompassed by the invention.

Moreover, representative examples of polypeptides fragments of the invention (useful in, for example, as antigens for antibody production), include, for example, fragments comprising, or alternatively consisting of, a sequence from about amino acid number 1-10, 5-10, 10-20, 21-31, 31-40, 41-61, 61-81, 91-120, 121-140, 141-162, 162-200, 201-240, 241-280, 281-320, 321-360, 360-400, 400-450, 451-500, 500-600, 600-700, 700-800, 800-900 and the like. In this context "about" includes the particularly recited range or a range larger or smaller by several (5, 4, 3, 2, or 1) amino acids, at either terminus or at both termini. In some embodiments, these fragments has a functional activity (e.g., biological activity) whereas in other embodiments, these fragments may be used to make an antibody.

In one example, a polynucleotide having a sequence set forth in the sequence listing, containing no flanking sequences (i.e., consisting of the sequence set forth in the sequence listing), may be cloned into an expression vector having ATG and a stop codon (e.g. any one of the pET vector from Invitrogen, or other similar vectors from other manufactures), and used to express a polypeptide of interest encoded by the polynucleotide in a suitable cell, e.g., a bacterial cell. Accordingly, the polynucleotides may be used to produce polypeptides, and these polypeptides may be used to produce antibodies by known methods described above and below. In many embodiments, the sequence of the encoded polypeptide does not have to be known prior to its expression in a cell. However, if it desirable to know the sequence of the polypeptide, this may be derived from the sequence of the polynucleotide. Using the genetic code, the polynucleotide may be translated by hand, or by computer means. Suitable software for identifying open reading frames and translating them into polypeptide sequences are well know in the art, and include: Lasergene™ from DNAStar (Madison, Wis.), and Vector NTI™ from Informax (Frederick Md.), and the like.

Further polypeptide variants may are described in PCT publications WO/00-55173, WO/01-07611 and WO/02-16429

Vectors, Host Cells and Protein Production

The present invention also relates to vectors containing the polynucleotide of the present invention, host cells, and the production of polypeptides by recombinant techniques. The vector may be, for example, a phage, plasmid, viral, or retroviral vector. Retroviral vectors may be replication competent or replication defective. In the latter case, viral propagation generally will occur only in complementing host cells.

The polynucleotides of the invention may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

The polynucleotide insert should be operatively linked to an appropriate promoter, such as the phage lambda PL promoter, the E. coli lac, trp, phoA and tac promoters, the SV40 early and late promoters and promoters of retroviral LTRs, to name a few. Other suitable promoters will be known to the skilled artisan. The expression constructs will further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

As indicated, the expression vectors will preferably include at least one selectable marker. Such markers include dihydrofolate reductase, G418 or neomycin resistance for eukaryotic cell culture and tetracycline, kanamycin or ampicillin resistance genes for culturing in E. coli and other bacteria.

Representative examples of appropriate hosts include, but are not limited to, bacterial cells, such as E. coli, Streptomyces and Salmonella typhimurium cells; fungal cells, such as yeast cells (e.g., Saccharomyces cerevisiae or Pichia pastoris (ATCC Accession No. 201178)); insect cells such as Drosophila S2 and Spodoptera Sf9 cells; animal cells such as CHO, COS, 293, and Bowes melanoma cells; and plant cells. 5 Appropriate culture mediums and conditions for the above-described host cells are known in the art.

Among vectors preferred for use in bacteria include pQE70, pQE60 and pQE-9, available from QIAGEN, Inc.; pBluescript vectors, Phagescript vectors, pNHSA, pNH16a, pNH18A, pNH46A, available from Stratagene Cloning Systems, Inc.; and ptrc99a, pKK223-3, pKK233-3, pDR540, pRITS available from Pharmacia Biotech, Inc. Among preferred eukaryotic vectors are pWLNEO, pSV2CAT, pOG44, pXT1 and pSG available from Stratagene; and pSVK3, pBPV, pMSG and pSVL available from Pharmacia. Preferred expression vectors for use in yeast systems include, but are not limited to pYES2, pYD1, pTEF1/Zeo, pYES2/GS, pPICZ, pGAPZ, pGAPZalph, pPIC9, pPIC3.5, pHIL-D2, pHIL-S1, pPIC3.5K, pPIC9K, and PAO815 (all available from Invitrogen, Carload, Calif.). Other suitable vectors will be readily apparent to the skilled artisan.

Nucleic acids of interest may be cloned into a suitable vector by route methods. Suitable vectors include plasmids, cosmids, recombinant viral vectors e.g. retroviral vectors, YACs, BACs and the like, phage vectors.

Introduction of the construct into the host cell can be effected by calcium phosphate transfection, DEAE-dextran mediated transfection, cationic lipid-mediated transfection, electroporation, transduction, infection, or other methods. Such methods are described in many standard laboratory manuals, such as Davis et al., Basic Methods In Molecular Biology (1986). It is specifically contemplated that the polypeptides of the present invention may in fact be expressed by a host cell lacking a recombinant vector.

A polypeptide of this invention can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification.

Polypeptides of the present invention can also be recovered from: products purified from natural sources, including bodily fluids, tissues and cells, whether directly isolated or cultured; products of chemical synthetic procedures; and products produced by recombinant techniques from a prokaryotic or eukaryotic host, including, for example, bacterial, yeast higher plant, insect, and mammalian cells. Depending upon the host employed in a recombinant production procedure, the polypeptides of the present invention may be glycosylated or may be non-glycosylated. In addition, polypeptides of the invention may also include an initial modified methionine residue, in some cases as a result of host mediated processes. Thus, it is well known in the art that the N-terminal methionine encoded by the translation initiation codon generally is removed with high efficiency from any protein after translation in all eukaryotic cells. While the N-terminal methionine on most proteins also is efficiently removed in most prokaryotes, for some proteins, this prokaryotic removal process is inefficient, depending on the nature of the amino acid to which the N-terminal methionine is covalently linked.

Suitable methods and compositions for polypeptide expression may be found in PCT publications WO/00-55173, WO/01-07611 and WO/02-16429, and suitable methods and compositions for production of modified polypeptides may be found in PCT publications WO/00-55173, WO/01-07611 and WO/02-16429.

Antibodies and Other Polypeptide or Polynucleotide Binding Molecules

The present invention further provides antibodies, which may be isolated antibodies, that are specific for a polypeptide encoded by a polynucleotide described herein and/or a polypeptide of a gene that corresponds to a polynucleotide described herein. Antibodies can be provided in a composition comprising the antibody and a buffer and/or a pharmaceutically acceptable excipient. Antibodies specific for a polypeptide associated with cancer are useful in a variety of diagnostic and therapeutic methods, as discussed in detail herein.

Gene products, including polypeptides, mRNA (particularly mRNAs having distinct secondary and/or tertiary structures), cDNA, or complete gene, can be prepared and used for raising antibodies for experimental, diagnostic, and therapeutic purposes. Antibodies may be used to identify a gene corresponding to a polynucleotide. The polynucleotide or related cDNA is expressed as described above, and antibodies are prepared. These antibodies are specific to an epitope on the polypeptide encoded by the polynucleotide, and can precipitate or bind to the corresponding native protein in a cell or tissue preparation or in a cell-free extract of an in vitro expression system.

Antibodies

Further polypeptides of the invention relate to antibodies and T-cell antigen receptors (TCR) which immunospecifically bind a subject polypeptide, subject polypeptide fragment, or variant thereof, and/or an epitope thereof (as determined by immunoassays well known in the art for assaying specific antibody-antigen binding). Antibodies of the invention include, but are not limited to, polyclonal, monoclonal, multispecific, human, humanized or chimeric antibodies, single chain antibodies, Fab fragments, F(ab') fragments, fragments produced by a Fab expression library, anti-idiotypic (anti-Id) antibodies (including, e.g., anti-Id antibodies to antibodies of the invention), and epitope-binding fragments of any of the above. The term "antibody," as used herein, refers to immunoglobulin molecules and immunologically active portions of immunoglobulin molecules, i.e., molecules that contain an antigen binding site that immunospecifically binds an antigen. The immunoglobulin molecules of the invention can be of any type (e.g., IgG, IgE, IgM, IgD, IgA and IgY), class (e.g., IgG1, IgG2, IgG3, IgG4, IgA1 and IgA2) or subclass of immunoglobulin molecule.

Most preferably the antibodies are human antigen-binding antibody fragments of the present invention and include, but are not limited to, Fab. Fab' and F(ab')$_2$, Fd, single-chain Fvs (scFv), single-chain antibodies, disulfide-linked Fvs (sdFv) and fragments comprising either a $V_L$ or $V_H$ domain. Antigen-binding antibody fragments, including single-chain antibodies, may comprise the variable region(s) alone or in combination with the entirety or a portion of the following: hinge region, $C_H1$, $C_H2$, and $C_H3$ domains. Also included in the invention are antigen-binding fragments also comprising any combination of variable region(s) with a hinge region, $C_H1$, $C_H2$, and $C_H3$ domains. The antibodies of the invention may be from any animal origin including birds and mammals. Preferably, the antibodies are human, murine (e.g., mouse and rat), donkey, ship rabbit, goat, guinea pig, camel, horse, or chicken. As used herein, "human" antibodies include antibodies having the amino acid sequence of a human immunoglobulin and include antibodies isolated from, human immunoglobulin libraries or from animals transgenic for one or more human immunoglobulin and that do not express endogenous immunoglobulins, as described infra and, for example in, U.S. Pat. No. 5,939,598 by Kucherlapati et al.

The antibodies of the present invention may be monospecific, bispecific, trispecific or of greater multispecificity. Multispecific antibodies may be specific for different epitopes of a polypeptide of the present invention or may be specific for both a polypeptide of the present invention as well as for a heterologous epitope, such as a heterologous polypeptide or solid support material. See, e.g., PCT publications WO 93/17715; WO 92/08802; WO 91/00360; WO 92/05793; Tutt, et al., J. Immunol. 147:60-69 (1991); U.S. Pat. Nos. 4,474,893; 4,714,681; 4,925,648; 5,573,920; 5,601,819; Kostelny et al., J. Immunol. 148:1547-1553 (1992).

Antibodies of the present invention may be described or specified in terms of the epitope(s) or portion(s) of a polypeptide of the present invention which they recognize or specifically bind. The epitope(s) or polypeptide portion(s) may be specified as described herein, e.g., by N-terminal and C-terminal positions, or by size in contiguous amino acid residues. Antibodies which specifically bind any epitope or polypeptide of the present invention may also be excluded. Therefore, the present invention includes antibodies that specifically bind polypeptides of the present invention, and allows for the exclusion of the same.

Antibodies of the present invention may also be described or specified in terms of their cross-reactivity. Antibodies that do not bind any other analog, ortholog, or homolog of a polypeptide of the present invention are included. Antibodies that bind polypeptides with at least 95%, at least 90%, at least 85%, at least 80%, at least 75%, at least 70%, at least 65%, at least 60%, at least 55%, and at least 50% identity (as calculated using methods known in the art and described herein) to a polypeptide of the present invention are also included in the present invention. In specific embodiments, antibodies of the present invention cross-react with murine, rat and/or rabbit homologs of human proteins and the corresponding epitopes thereof. Antibodies that do not bind polypeptides with less than 95%, less than 90%, less than 85%, less than 80%, less than 75%, less than 70%, less than 65%, less than 60%, less than 55%, and less than 50% identity (as calculated using methods known in the art and described herein) to a polypeptide of the present invention are also included in the present invention. In a specific embodiment, the above-described cross-reactivity is with respect to any single specific antigenic or immunogenic polypeptide, or combination(s) of 2, 3, 4, 5, or more of the specific antigenic and/or immunogenic polypeptides disclosed herein. Further included in the present invention are antibodies which bind polypeptides encoded by polynucleotides which hybridize to a polynucleotide of the present invention under stringent hybridization conditions (as described herein). Antibodies of the present invention may also be described or specified in terms of their binding affinity to a polypeptide of the invention. Preferred binding affinities include those with a dissociation constant or Kd less $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, 10–10 M, etc.

The invention also provides antibodies that competitively inhibit binding of an antibody to an epitope of the invention as determined by any method known in the art for determining competitive binding, for example, the immunoassays described herein. In preferred embodiments, the antibody competitively inhibits binding to the epitope by at least 95%, at least 90%, at least 85%, at least 80%, at least 75%, at least 70%, at least 60%, or at least 50%.

Methods for making screening, assaying, humanizing, and modifying different types of antibody are well known in the art and may be found in PCT publications WO/00-55173, WO/01-07611 and WO/02-16429.

In addition, the invention further provides polynucleotides comprising a nucleotide sequence encoding an antibody of the invention and fragments thereof. The invention also encompasses polynucleotides that hybridize under stringent or alternatively, under lower stringency hybridization conditions, e.g., as defined supra, to polynucleotides that encode an antibody, preferably, that specifically binds to a polypeptide of the invention, preferably, an antibody that binds to a subject polypeptide.

The antibodies of the invention can be produced by any method known in the art for the synthesis of antibodies, in particular, by chemical synthesis or preferably, by recombinant expression techniques. Recombinant expression of an antibody of the invention, or fragment, derivative or analog thereof, (e.g., a heavy or light chain of an antibody of the invention or a single chain antibody of the invention), requires construction of an expression vector containing a polynucleotide that encodes the antibody. Once a polynucleotide encoding an antibody molecule or a heavy or light chain of an antibody, or portion thereof (preferably containing the heavy or light chain variable domain), of the invention has been obtained, the vector for the production of the antibody molecule may be produced by recombinant DNA technology using techniques well known in the art. Thus, methods for preparing a protein by expressing a polynucleotide containing an antibody encoding nucleotide sequence are described herein. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The invention, thus, provides replicable vectors comprising a nucleotide sequence encoding an antibody molecule of the invention, or a heavy or light chain thereof, or a heavy or light chain variable domain, operably linked to a promoter. Such vectors may include the nucleotide sequence encoding the constant region of the antibody molecule (see, e.g., PCT Publication WO 86/05807; PCT Publication WO 89/01036; and U.S. Pat. No. 5,122,464) and the variable domain of the antibody may be cloned into such a vector for expression of the entire heavy or light chain.

The expression vector is transferred to a host cell by conventional techniques and the transfected cells are then cultured by conventional techniques to produce an antibody of the invention. Thus, the invention includes host cells containing a polynucleotide encoding an antibody of the invention, or a heavy or light chain thereof, or a single chain antibody of the invention, operably linked to a heterologous promoter. In preferred embodiments for the expression of double-chained antibodies, vectors encoding both the heavy and light chains may be co-expressed in the host cell for expression of the entire immunoglobulin molecule, as detailed below.

A variety of host-expression vector systems may be utilized to express the antibody molecules of the invention. Such host-expression systems represent vehicles by which the coding sequences of interest may be produced and subsequently purified, but also represent cells which may, when transformed or transfected with the appropriate nucleotide coding sequences, express an antibody molecule of the invention in situ. These include but are not limited to microorganisms such as bacteria (e.g., *E. coli, B. subtilis*) transformed with recombinant bacteriophage DNA, plasmid DNA or cosmid DNA expression vectors containing antibody coding sequences; yeast (e.g., *Saccharomyces, Pichia*) transformed with recombinant yeast expression vectors containing antibody coding sequences; insect cell systems infected with recombinant virus expression vectors (e.g., baculovirus) containing antibody coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS, CHO, BHK, 293, 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). Preferably, bacterial cells such as *Escherichia coli*, and more preferably, eukaryotic cells, especially for the expression of whole recombinant antibody molecule, are used for the expression of a recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., Gene 45:101 (1986); Cockett et al., Bio/Technology 8:2 (1990)).

Antibodies production is well known in the art. Exemplary methods and compositions for making antibodies may be found in PCT publications WO/00-55173, WO/01-07611 and WO/02-16429.

Immunophenotyping

The antibodies of the invention may be utilized for immunophenotyping of cell lines and biological samples. The translation product of the gene of the present invention may be useful as a cell specific marker, or more specifically as a cellular marker that is differentially expressed at various stages of differentiation and/or maturation of particular cell types. Monoclonal antibodies directed against a specific epitope, or combination of epitopes, will allow for the screening of cellular populations expressing the marker. Various techniques can be utilized using monoclonal antibodies to screen for cellular populations expressing the marker(s), and include magnetic separation using antibody-coated magnetic beads, "panning" with antibody attached to a solid matrix (i.e., plate), and flow cytometry (See, e.g., U.S. Pat. No. 5,985,660; and Morrison et al. Cell, 96:737-49 (1999)).

These techniques allow for the screening of particular populations of cells, such as might be found with hematological malignancies (i.e. minimal residual disease (MRD) in acute leukemic patients) and "non-self cells in transplantations to prevent Graft-versus-Host Disease (GVHD). Alternatively, these techniques allow for the screening of hematopoietic stem and progenitor cells capable of undergoing proliferation and/or differentiation, as might be found in human umbilical cord blood.

Kits

Also provided by the subject invention are kits for practicing the subject methods, as described above. The subject kits include at least one or more of: a subject nucleic acid, isolated polypeptide or an antibody thereto. Other optional components of the kit include: restriction enzymes, control primers and plasmids; buffers, cells, carriers adjuvents etc. The nucleic acids of the kit may also have restrictions sites, multiple cloning sites, primer sites, etc to facilitate their ligation other plasmids. The various components of the kit may be present in separate containers or certain compatible components may be precombined into a single container, as desired. In many embodiments, kits with unit doses of the active agent, e.g. in oral or injectable doses, are provided. In certain embodiments, controls, such as samples from a cancerous or non-cancerous cell are provided by the invention. Further embodiments of the kit include an antibody for a subject polypeptide and a chemotherapeutic agent to be used in combination with the polypeptide as a treatment.

In addition to above-mentioned components, the subject kits typically further include instructions for using the components of the kit to practice the subject methods. The instructions for practicing the subject methods are generally recorded on a suitable recording medium. For example, the instructions may be printed on a substrate, such as paper or plastic, etc. As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

Computer-Related Embodiments

In general, a library of polynucleotides is a collection of sequence information, which information is provided in either biochemical form (e.g., as a collection of polynucleotide molecules), or in electronic form (e.g., as a collection of polynucleotide sequences stored in a computer-readable form, as in a computer system and/or as part of a computer program). The sequence information of the polynucleotides can be used in a variety of ways, e.g., as a resource for gene discovery, as a representation of sequences expressed in a selected cell type (e.g., cell type markers), and/or as markers of a given disease or disease state. For example, in the instant case, the sequences of polynucleotides and polypeptides corresponding to genes differentially expressed in cancer, as well as the nucleic acid and amino acid sequences of the genes themselves, can be provided in electronic form in a computer database.

In general, a disease marker is a representation of a gene product that is present in all cells affected by disease either at an increased or decreased level relative to a normal cell (e.g., a cell of the same or similar type that is not substantially affected by disease). For example, a polynucleotide sequence in a library can be a polynucleotide that represents an mRNA, polypeptide, or other gene product encoded by the polynucleotide, that is either overexpressed or underexpressed in a cancerous cell affected by cancer relative to a normal (i.e., substantially disease-free) cell.

The nucleotide sequence information of the library can be embodied in any suitable form, e.g., electronic or biochemical forms. For example, a library of sequence information embodied in electronic form comprises an accessible computer data file (or, in biochemical form, a collection of nucleic acid molecules) that contains the representative nucleotide sequences of genes that are differentially expressed (e.g., overexpressed or underexpressed) as between, for example, i) a cancerous cell and a normal cell; ii) a cancerous cell and a dysplastic cell; iii) a cancerous cell and a cell affected by a disease or condition other than cancer; iv) a metastatic cancerous cell and a normal cell and/or non-metastatic cancerous cell; v) a malignant cancerous cell and a non-malignant cancerous cell (or a normal cell) and/or vi) a dysplastic cell relative to a normal cell. Other combinations and comparisons of cells affected by various diseases or stages of disease will be readily apparent to the ordinarily skilled artisan. Biochemical embodiments of the library include a collection of nucleic acids that have the sequences of the genes in the library, where the nucleic acids can correspond to the entire gene in the library or to a fragment thereof, as described in greater detail below.

The polynucleotide libraries of the subject invention generally comprise sequence information of a plurality of polynucleotide sequences, where at least one of the polynucleotides has a sequence of any of sequence described herein. By plurality is meant at least 2, usually at least 3 and can include up to all of the sequences described herein. The length and number of polynucleotides in the library will vary with the nature of the library, e.g., if the library is an oligonucleotide array, a cDNA array, a computer database of the sequence information, etc.

Where the library is an electronic library, the nucleic acid sequence information can be present in a variety of media. "Media" refers to a manufacture, other than an isolated nucleic acid molecule, that contains the sequence information of the present invention. Such a manufacture provides the genome sequence or a subset thereof in a form that can be examined by means not directly applicable to the sequence as it exists in a nucleic acid. For example, the nucleotide sequence of the present invention, e.g. the nucleic acid sequences of any of the polynucleotides of the sequences described herein, can be recorded on computer readable media, e.g. any medium that can be read and accessed directly by a computer. Such media include, but are not limited to: magnetic storage media, such as a floppy disc, a hard disc storage medium, and a magnetic tape; optical storage media such as CD-ROM; electrical storage media such as RAM and ROM; and hybrids of these categories such as magnetic/optical storage media.

One of skill in the art can readily appreciate how any of the presently known computer readable mediums can be used to create a manufacture comprising a recording of the present sequence information. "Recorded" refers to a process for storing information on computer readable medium, using any such methods as known in the art. Any convenient data storage structure can be chosen, based on the means used to access the stored information. A variety of data processor programs and formats can be used for storage, e.g. word processing text file, database format, etc. In addition to the sequence information, electronic versions of libraries comprising one or more sequence described herein can be provided in conjunction or connection with other computer-readable information and/or other types of computer-readable files (e.g., searchable files, executable files, etc, including, but not limited to, for example, search program software, etc.).

By providing the nucleotide sequence in computer readable form, the information can be accessed for a variety of purposes. Computer software to access sequence information (e.g. the NCBI sequence database) is publicly available. For example, the gapped BLAST (Altschul et al., *Nucleic Acids Res.* (1997) 25:3389-3402) and BLAZE (Brutlag et al., *Comp. Chem.* (1993) 17:203) search algorithms on a Sybase system, or the TeraBLAST (TimeLogic, Crystal Bay, Nev.) program optionally running on a specialized computer platform available from TimeLogic, can be used to identify open reading frames (ORFs) within the genome that contain homology to ORFs from other organisms.

As used herein, "a computer-based system" refers to the hardware means, software means, and data storage means used to analyze the nucleotide sequence information of the present invention. The minimum hardware of the computer-based systems of the present invention comprises a central processing unit (CPU), input means, output means, and data storage means. A skilled artisan can readily appreciate that any one of the currently available computer-based system are suitable for use in the present invention. The data storage means can comprise any manufacture comprising a recording of the present sequence information as described above, or a memory access means that can access such a manufacture.

"Search means" refers to one or more programs implemented on the computer-based system, to compare a target sequence or target structural motif, or expression levels of a polynucleotide in a sample, with the stored sequence information. Search means can be used to identify fragments or regions of the genome that match a particular target sequence or target motif. A variety of known algorithms are publicly known and commercially available, e.g. MacPattern (EMBL), TeraBLAST (TimeLogic), BLASTN and BLASTX (NCBI). A "target sequence" can be any polynucleotide or amino acid sequence of six or more contiguous nucleotides or two or more amino acids, preferably from about 10 to 100 amino acids or from about 30 to 300 nt. A variety of means for comparing nucleic acids or polypeptides may be used to compare accomplish a sequence comparison (e.g., to analyze target sequences, target motifs, or relative expression levels) with the data storage means. A skilled artisan can readily recognize that any one of the publicly available homology search programs can be used to search the computer based systems of the present invention to compare of target sequences and motifs. Computer programs to analyze expression levels in a sample and in controls are also known in the art.

A "target structural motif," or "target motif," refers to any rationally selected sequence or combination of sequences in which the sequence(s) are chosen based on a three-dimensional configuration that is formed upon the folding of the target motif, or on consensus sequences of regulatory or active sites. There are a variety of target motifs known in the art. Protein target motifs include, but are not limited to, enzyme active sites and signal sequences, kinase domains, receptor binding domains, SH2 domains, SH3 domains, phosphorylation sites, protein interaction domains, transmembrane domains, etc. Nucleic acid target motifs include, but are not limited to, hairpin structures, promoter sequences and other expression elements such as binding sites for transcription factors.

A variety of structural formats for the input and output means can be used to input and output the information in the computer-based systems of the present invention. One format for an output means ranks the relative expression levels of different polynucleotides. Such presentation provides a skilled artisan with a ranking of relative expression levels to determine a gene expression profile. A gene expression profile can be generated from, for example, a cDNA library prepared from mRNA isolated from a test cell suspected of being cancerous or pre-cancerous, comparing the sequences or partial sequences of the clones against the sequences in an electronic database, where the sequences of the electronic database represent genes differentially expressed in a cancerous cell, e.g., a cancerous breast cell. The number of clones having a sequence that has substantial similarity to a sequence that represents a gene differentially expressed in a cancerous cell is then determined, and the number of clones corresponding to each of such genes is determined. An increased number of clones that correspond to differentially expressed gene is present in the cDNA library of the test cell (relative to, for example, the number of clones expected in a cDNA of a normal cell) indicates that the test cell is cancerous.

As discussed above, the "library" as used herein also encompasses biochemical libraries of the polynucleotides of the sequences described herein, e.g., collections of nucleic acids representing the provided polynucleotides. The biochemical libraries can take a variety of forms, e.g., a solution of cDNAs, a pattern of probe nucleic acids stably associated with a surface of a solid support (i.e., an array) and the like. Of particular interest are nucleic acid arrays in which one or more of the genes described herein is represented by a sequence on the array. By array is meant an article of manufacture that has at least a substrate with at least two distinct nucleic acid targets on one of its surfaces, where the number of distinct nucleic acids can be considerably higher, typically being at least 10 nt, usually at least 20 nt and often at least 25 nt. A variety of different array formats have been developed and are known to those of skill in the art. The arrays of the subject invention find use in a variety of applications, including gene expression analysis, drug screening, mutation analysis and the like, as disclosed in the above-listed exemplary patent documents.

In addition to the above nucleic acid libraries, analogous libraries of polypeptides are also provided, where the polypeptides of the library will represent at least a portion of the polypeptides encoded by a gene corresponding to a sequence described herein.

Diagnostic and Other Methods Involving Detection of Differentially Expressed Genes The present invention provides methods of using the polynucleotides described herein in, for example, diagnosis of cancer and classification of cancer cells according to expression profiles. In specific non-limiting embodiments, the methods are useful for detecting cancer cells, facilitating diagnosis of cancer and the severity of a cancer (e.g., tumor grade, tumor burden, and the like) in a subject, facilitating a determination of the prognosis of a subject, and assessing the responsiveness of the subject to therapy (e.g., by providing a measure of therapeutic effect through, for example, assessing tumor burden during or following a chemotherapeutic regimen). Detection can be based on detection of a polynucleotide that is differentially expressed in a cancer cell, and/or detection of a polypeptide encoded by a polynucleotide that is differentially expressed in a cancer cell ("a polypeptide associated with cancer"). The detection methods of the invention can be conducted in vitro or in vivo, on isolated cells, or in whole tissues or a bodily fluid, e.g., blood, plasma, serum, urine, and the like).

In general, methods of the invention involving detection of a gene product (e.g., mRNA, cDNA generated from such mRNA, and polypeptides) involve contacting a sample with a probe specific for the gene product of interest. "Probe" as used herein in such methods is meant to refer to a molecule that specifically binds a gene product of interest (e.g., the probe binds to the target gene product with a specificity sufficient to distinguish binding to target over non-specific binding to non-target (background) molecules). "Probes" include, but are not necessarily limited to, nucleic acid probes (e.g., DNA, RNA, modified nucleic acid, and the like), antibodies (e.g., antibodies, antibody fragments that retain binding to a target epitope, single chain antibodies, and the like), or other polypeptide, peptide, or molecule (e.g., receptor ligand) that specifically binds a target gene product of interest.

The probe and sample suspected of having the gene product of interest are contacted under conditions suitable for binding of the probe to the gene product. For example, contacting is generally for a time sufficient to allow binding of the probe to the gene product (e.g. from several minutes to a few hours), and at a temperature and conditions of osmolarity and the like that provide for binding of the probe to the gene product at a level that is sufficiently distinguishable from background binding of the probe (e.g., under conditions that minimize non-specific binding). Suitable conditions for probe-target gene product binding can be readily determined using controls and other techniques available and known to one of ordinary skill in the art.

In this embodiment, the probe can be an antibody or other polypeptide, peptide, or molecule (e.g., receptor ligand) that specifically binds a target polypeptide of interest.

The detection methods can be provided as part of a kit. Thus, the invention further provides kits for detecting the presence and/or a level of a polynucleotide that is differentially expressed in a cancer cell (e.g., by detection of an mRNA encoded by the differentially expressed gene of interest), and/or a polypeptide encoded thereby, in a biological sample. Procedures using these kits can be performed by clinical laboratories, experimental laboratories, medical practitioners, or private individuals. The kits of the invention for detecting a polypeptide encoded by a polynucleotide that is differentially expressed in a cancer cell comprise a moiety that specifically binds the polypeptide, which may be a specific antibody. The kits of the invention for detecting a polynucleotide that is differentially expressed in a cancer cell comprise a moiety that specifically hybridizes to such a polynucleotide. The kit may optionally provide additional components that are useful in the procedure, including, but not limited to, buffers, developing reagents, labels, reacting surfaces, means for detection, control samples, standards, instructions, and interpretive information.

Detecting a Polypeptide Encoded by a Polynucleotide that is Differentially Expressed in a Cancer Cell In some embodiments, methods are provided for a detecting cancer cell by detecting in a cell, a polypeptide encoded by a gene differentially expressed in a cancer cell. Any of a variety of known methods can be used for detection, including, but not limited to, immunoassay, using an antibody specific for the encoded polypeptide, e.g., by enzyme-linked immunosorbent assay (ELISA), radioimmunoassay (RIA), and the like; and functional assays for the encoded polypeptide, e.g., binding activity or enzymatic activity.

For example, an immunofluorescence assay can be easily performed on cells without first isolating the encoded polypeptide. The cells are first fixed onto a solid support, such as a microscope slide or microtiter well. This fixing step can permeabilize the cell membrane. The permeablization of the cell membrane permits the polypeptide-specific probe (e.g, antibody) to bind. Alternatively, where the polypeptide is secreted or membrane-bound, or is otherwise accessible at the cell-surface (e.g., receptors, and other molecule stably-associated with the outer cell membrane or otherwise stably associated with the cell membrane, such permeabilization may not be necessary.

Next, the fixed cells are exposed to an antibody specific for the encoded polypeptide. To increase the sensitivity of the assay, the fixed cells may be further exposed to a second antibody, which is labeled and binds to the first antibody, which is specific for the encoded polypeptide. Typically, the secondary antibody is detectably labeled, e.g., with a fluorescent marker. The cells which express the encoded polypeptide will be fluorescently labeled and easily visualized under the microscope. See, for example, Hashido et al. (1992) *Biochem. Biophys. Res. Comm.* 187:1241-1248.

As will be readily apparent to the ordinarily skilled artisan upon reading the present specification, the detection methods and other methods described herein can be varied. Such variations are within the intended scope of the invention. For example, in the above detection scheme, the probe for use in detection can be immobilized on a solid support, and the test sample contacted with the immobilized probe. Binding of the test sample to the probe can then be detected in a variety of ways, e.g., by detecting a detectable label bound to the test sample.

The present invention further provides methods for detecting the presence of and/or measuring a level of a polypeptide in a biological sample, which polypeptide is encoded by a polynucleotide that represents a gene differentially expressed in cancer, particularly in a polynucleotide that represents a gene differentially cancer cell, using a probe specific for the encoded polypeptide. In this embodiment, the probe can be a an antibody or other polypeptide, peptide, or molecule (e.g., receptor ligand) that specifically binds a target polypeptide of interest.

The methods generally comprise: a) contacting the sample with an antibody specific for a differentially expressed polypeptide in a test cell; and b) detecting binding between the antibody and molecules of the sample. The level of antibody binding (either qualitative or quantitative) indicates the cancerous state of the cell. For example, where the differentially expressed gene is increased in cancerous cells, detection of an increased level of antibody binding to the test sample relative to antibody binding level associated with a normal cell indicates that the test cell is cancerous.

Suitable controls include a sample known not to contain the encoded polypeptide; and a sample contacted with an antibody not specific for the encoded polypeptide, e.g., an anti-idiotype antibody. A variety of methods to detect specific antibody-antigen interactions are known in the art and can be used in the method, including, but not limited to, standard immunohistological methods, immunoprecipitation, an enzyme immunoassay, and a radioimmunoassay.

In general, the specific antibody will be detectably labeled, either directly or indirectly. Direct labels include radioisotopes; enzymes whose products are detectable (e.g., luciferase, β-galactosidase, and the like); fluorescent labels (e.g., fluorescein isothiocyanate, rhodamine, phycoerythrin, and the like); fluorescence emitting metals, e.g., $^{152}$Eu, or others of the lanthanide series, attached to the antibody through metal chelating groups such as EDTA; chemiluminescent compounds, e.g., luminol, isoluminol, acridinium salts, and the like; bioluminescent compounds, e.g., luciferin, aequorin (green fluorescent protein), and the like.

The antibody may be attached (coupled) to an insoluble support, such as a polystyrene plate or a bead. Indirect labels include second antibodies specific for antibodies specific for the encoded polypeptide ("first specific antibody"), wherein the second antibody is labeled as described above; and members of specific binding pairs, e.g., biotin-avidin, and the like. The biological sample may be brought into contact with and immobilized on a solid support or carrier, such as nitrocellulose, that is capable of immobilizing cells, cell particles, or soluble proteins. The support may then be washed with suitable buffers, followed by contacting with a detectably-labeled first specific antibody. Detection methods are known in the art and will be chosen as appropriate to the signal emitted by the detectable label. Detection is generally accomplished in comparison to suitable controls, and to appropriate standards.

In some embodiments, the methods are adapted for use in vivo, e.g., to locate or identify sites where cancer cells are present. In these embodiments, a detectably-labeled moiety, e.g., an antibody, which is specific for a cancer-associated polypeptide is administered to an individual (e.g., by injection), and labeled cells are located using standard imaging techniques, including, but not limited to, magnetic resonance imaging, computed tomography scanning, and the like. In this manner, cancer cells are differentially labeled.

Detecting a Polynucleotide that Represents a Gene Differentially Expressed in a Cancer Cell In some embodiments, methods are provided for detecting a cancer cell by detecting expression in the cell of a transcript or that is differentially expressed in a cancer cell. Any of a variety of known methods can be used for detection, including, but not limited to, detection of a transcript by hybridization with a polynucleotide that hybridizes to a polynucleotide that is differentially expressed in a cancer cell; detection of a transcript by a polymerase chain reaction using specific oligonucleotide primers; in situ hybridization of a cell using as a probe a polynucleotide that hybridizes to a gene that is differentially expressed in a cancer cell and the like.

In many embodiments, the levels of a subject gene product are measured. By measured is meant qualitatively or quantitatively estimating the level of the gene product in a first biological sample either directly (e.g. by determining or estimating absolute levels of gene product) or relatively by comparing the levels to a second control biological sample. In many embodiments the second control biological sample is obtained from an individual not having not having cancer. As will be appreciated in the art, once a standard control level of gene expression is known, it can be used repeatedly as a standard for comparison. Other control samples include samples of cancerous tissue.

The methods can be used to detect and/or measure mRNA levels of a gene that is differentially expressed in a cancer cell. In some embodiments, the methods comprise: a) contacting a sample with a polynucleotide that corresponds to a differentially expressed gene described herein under conditions that allow hybridization; and b) detecting hybridization, if any. Detection of differential hybridization, when compared to a suitable control, is an indication of the presence in the sample of a polynucleotide that is differentially expressed in a cancer cell. Appropriate controls include, for example, a sample that is known not to contain a polynucleotide that is differentially expressed in a cancer cell. Conditions that allow hybridization are known in the art, and have been described in more detail above.

Detection can also be accomplished by any known method, including, but not limited to, in situ hybridization, PCR (polymerase chain reaction), RT-PCR (reverse transcription-PCR), and "Northern" or RNA blotting, arrays, microarrays, etc, or combinations of such techniques, using a suitably labeled polynucleotide. A variety of labels and labeling methods for polynucleotides are known in the art and can be used in the assay methods of the invention. Specific hybridization can be determined by comparison to appropriate controls.

Polynucleotides described herein are used for a variety of purposes, such as probes for detection of and/or measurement of, transcription levels of a polynucleotide that is differentially expressed in a cancer cell. Additional disclosure about preferred regions of the disclosed polynucleotide sequences is found in the Examples. A probe that hybridizes specifically to a polynucleotide disclosed herein should provide a detection signal at least 2-, 5-, 10-, or 20-fold higher than the background hybridization provided with other unrelated sequences. It should be noted that "probe" as used in this context of detection of nucleic acid is meant to refer to a polynucleotide sequence used to detect a differentially expressed gene product in a test sample. As will be readily appreciated by the ordinarily skilled artisan, the probe can be detectably labeled and contacted with, for example, an array comprising immobilized polynucleotides obtained from a test sample (e.g., mRNA). Alternatively, the probe can be immobilized on an array and the test sample detectably labeled. These and other variations of the methods of the invention are well within the skill in the art and are within the scope of the invention.

Labeled nucleic acid probes may be used to detect expression of a gene corresponding to the provided polynucleotide. In Northern blots, mRNA is separated electrophoretically and contacted with a probe. A probe is detected as hybridizing to an mRNA species of a particular size. The amount of hybridization can be quantitated to determine relative amounts of expression, for example under a particular condition. Probes are used for in situ hybridization to cells to detect expression. Probes can also be used in vivo for diagnostic detection of hybridizing sequences. Probes are typically labeled with a radioactive isotope. Other types of detectable labels can be used such as chromophores, fluorophores, and enzymes. Other examples of nucleotide hybridization assays are described in WO92/02526 and U.S. Pat. No. 5,124,246.

PCR is another means for detecting small amounts of target nucleic acids, methods for which may be found in Sambrook, et al. *Molecular Cloning: A Laboratory Manual*, CSH Press 1989, pp. 14.2-14.33.

A detectable label may be included in the amplification reaction. Suitable detectable labels include fluorochromes, (e.g. fluorescein isothiocyanate (FITC), rhodamine, Texas Red, phycoerythrin, allophycocyanin, 6-carboxyfluorescein (6-FAM), 2',7'-dimethoxy-4',5'-dichloro-6-carboxyfluorescein, 6-carboxy-X-rhodamine (ROX), 6-carboxy-2',4',7',4,7-hexachlorofluorescein (HEX), 5-carboxyfluorescein (5-FAM) or N,N,N',N'-tetramethyl-6-carboxyrhodamine (TAMRA)), radioactive labels, (e.g. $^{32}$P, $^{35}$S, $^{3}$H, etc.), and the like. The label may be a two stage system, where the polynucleotides is conjugated to biotin, haptens, etc. having a high affinity binding partner, e.g. avidin, specific antibodies, etc., where the binding partner is conjugated to a detectable label. The label may be conjugated to one or both of the primers.

Alternatively, the pool of nucleotides used in the amplification is labeled, so as to incorporate the label into the amplification product.

Arrays

Polynucleotide arrays provide a high throughput technique that can assay a large number of polynucleotides or polypeptides in a sample. This technology can be used as a tool to test for differential expression.

A variety of methods of producing arrays, as well as variations of these methods, are known in the art and contemplated for use in the invention. For example, arrays can be created by spotting polynucleotide probes onto a substrate (e.g., glass, nitrocellulose, etc.) in a two-dimensional matrix or array having bound probes. The probes can be bound to the substrate by either covalent bonds or by non-specific interactions, such as hydrophobic interactions.

Samples of polynucleotides can be detectably labeled (e.g., using radioactive or fluorescent labels) and then hybridized to the probes. Double stranded polynucleotides, comprising the labeled sample polynucleotides bound to probe polynucleotides, can be detected once the unbound portion of the sample is washed away. Alternatively, the polynucleotides of the test sample can be immobilized on the array, and the probes detectably labeled. Techniques for constructing arrays and methods of using these arrays are described in, for example, Schena et al. (1996) *Proc Natl Acad Sci* USA. 93(20):10614-9; Schena et al. (1995) *Science* 270(5235):467-70; Shalon et al. (1996) *Genome Res.* 6(7): 639-45, U.S. Pat. No. 5,807,522, EP 799 897; WO 97/29212; WO 97/27317; EP 785 280; WO 97/02357; U.S. Pat. No. 5,593,839; U.S. Pat. No. 5,578,832; EP 728 520; U.S. Pat. No. 5,599,695; EP 721 016; U.S. Pat. No. 5,556,752; WO 95/22058; and U.S. Pat. No. 5,631,734. In most embodiments, the "probe" is detectably labeled. In other embodiments, the probe is immobilized on the array and not detectably labeled.

Arrays can be used, for example, to examine differential expression of genes and can be used to determine gene function. For example, arrays can be used to detect differential expression of a gene corresponding to a polynucleotide described herein, where expression is compared between a test cell and control cell (e.g., cancer cells and normal cells). For example, high expression of a particular message in a cancer cell, which is not observed in a corresponding normal cell, can indicate a cancer specific gene product. Exemplary uses of arrays are further described in, for example, Pappalarado et al., *Sem. Radiation Oncol.* (1998) 8:217; and Ramsay, *Nature Biotechnol.* (1998) 16:40. Furthermore, many variations on methods of detection using arrays are well within the skill in the art and within the scope of the present invention. For example, rather than immobilizing the probe to a solid support, the test sample can be immobilized on a solid support which is then contacted with the probe.

Diagnosis, Prognosis, Assessment of Therapy (Therametrics), and Management of Cancer The polynucleotides described herein, as well as their gene products and corresponding genes and gene products, are of particular interest as genetic or biochemical markers (e.g., in blood or tissues) that will detect the earliest changes along the carcinogenesis pathway and/or to monitor the efficacy of various therapies and preventive interventions.

For example, the level of expression of certain polynucleotides can be indicative of a poorer prognosis, and therefore warrant more aggressive chemo- or radio-therapy for a patient or vice versa. The correlation of novel surrogate tumor specific features with response to treatment and outcome in patients can define prognostic indicators that allow the design of tailored therapy based on the molecular profile of the tumor. These therapies include antibody targeting, antagonists (e.g., small molecules), and gene therapy.

Determining expression of certain polynucleotides and comparison of a patient's profile with known expression in normal tissue and variants of the disease allows a determination of the best possible treatment for a patient, both in terms of specificity of treatment and in terms of comfort level of the patient. Surrogate tumor markers, such as polynucleotide expression, can also be used to better classify, and thus diagnose and treat, different forms and disease states of cancer. Two classifications widely used in oncology that can benefit from identification of the expression levels of the genes corresponding to the polynucleotides described herein are staging of the cancerous disorder, and grading the nature of the cancerous tissue.

The polynucleotides that correspond to differentially expressed genes, as well as their encoded-gene products, can be useful to monitor patients having or susceptible to cancer to detect potentially malignant events at a molecular level before they are detectable at a gross morphological level. In addition, the polynucleotides described herein, as well as the genes corresponding to such polynucleotides, can be useful as therametrics, e.g., to assess the effectiveness of therapy by using the polynucleotides or their encoded gene products, to assess, for example, tumor burden in the patient before, during, and after therapy.

Furthermore, a polynucleotide identified as corresponding to a gene that is differentially expressed in, and thus is important for, one type of cancer can also have implications for development or risk of development of other types of cancer, e.g., where a polynucleotide represents a gene differentially expressed across various cancer types. Thus, for example, expression of a polynucleotide corresponding to a gene that has clinical implications for cancer can also have clinical implications for metastatic breast cancer, colon cancer, or ovarian cancer, etc.

Staging. Staging is a process used by physicians to describe how advanced the cancerous state is in a patient. Staging assists the physician in determining a prognosis, planning treatment and evaluating the results of such treatment. Staging systems vary with the types of cancer, but generally involve the following "TNM" system: the type of tumor, indicated by T; whether the cancer has metastasized to nearby lymph nodes, indicated by N; and whether the cancer has metastasized to more distant parts of the body, indicated by M. Generally, if a cancer is only detectable in the area of the primary lesion without having spread to any lymph nodes it is called Stage I. If it has spread only to the closest lymph nodes, it is called Stage II. In Stage III, the cancer has generally spread to the lymph nodes in near proximity to the site of the primary lesion. Cancers that have spread to a distant part of the body, such as the liver, bone, brain or other site, are Stage IV, the most advanced stage.

The polynucleotides and corresponding genes and gene products described herein can facilitate fine-tuning of the staging process by identifying markers for the aggressiveness of a cancer, e.g. the metastatic potential, as well as the presence in different areas of the body. Thus, a Stage II cancer with a polynucleotide signifying a high metastatic potential cancer can be used to change a borderline Stage II tumor to a Stage III tumor, justifying more aggressive therapy. Conversely, the presence of a polynucleotide signifying a lower metastatic potential allows more conservative staging of a tumor.

One type of breast cancer is ductal carcinoma in situ (DCIS): DCIS is when the breast cancer cells are completely contained within the breast ducts (the channels in the breast that carry milk to the nipple), and have not spread into the surrounding breast tissue. This may also be referred to as non-invasive or intraductal cancer, as the cancer cells have not yet spread into the surrounding breast tissue and so usually have not spread into any other part of the body.

Lobular carcinoma in situ breast cancer (LCIS) means that cell changes are found in the lining of the lobules of the breast. It can be present in both breasts. It is also referred to as non-invasive cancer as it has not spread into the surrounding breast tissue.

Invasive breast cancer can be staged as follows: Stage 1 tumours: these measure less than two centimeters. The lymph glands in the armpit are not affected and there are no signs that the cancer has spread elsewhere in the body; Stage 2 tumours: these measure between two and five centimeters, or the lymph glands in the armpit are affected, or both. However, there are no signs that the cancer has spread further; Stage 3 tumours: these are larger than five centimeters and may be attached to surrounding structures such as the muscle or skin. The lymph glands are usually affected, but there are no signs that the cancer has spread beyond the breast or the lymph glands in the armpit; Stage 4 tumours: these are of any size, but the lymph glands are usually affected and the cancer has spread to other parts of the body. This is secondary breast cancer.

Grading of cancers. Grade is a term used to describe how closely a tumor resembles normal tissue of its same type. The microscopic appearance of a tumor is used to identify tumor grade based on parameters such as cell morphology, cellular organization, and other markers of differentiation. As a general rule, the grade of a tumor corresponds to its rate of growth or aggressiveness, with undifferentiated or high-grade tumors generally being more aggressive than well-differentiated or low-grade tumors.

The polynucleotides of the Sequence Listing, and their corresponding genes and gene products, can be especially valuable in determining the grade of the tumor, as they not only can aid in determining the differentiation status of the cells of a tumor, they can also identify factors other than differentiation that are valuable in determining the aggressiveness of a tumor, such as metastatic potential.

Low grade means that the cancer cells look very like the normal cells. They are usually slowly growing and are less likely to spread. In high grade tumors the cells look very abnormal. They are likely to grow more quickly and are more likely to spread.

Assessment of proliferation of cells in tumor. The differential expression level of the polynucleotides described herein can facilitate assessment of the rate of proliferation of tumor cells, and thus provide an indicator of the aggressiveness of the rate of tumor growth. For example, assessment of the relative expression levels of genes involved in cell cycle can provide an indication of cellular proliferation, and thus serve as a marker of proliferation.

Detection of Cancer.

The polynucleotides corresponding to genes that exhibit the appropriate expression pattern can be used to detect cancer in a subject. The expression of appropriate polynucleotides can be used in the diagnosis, prognosis and management of cancer. Detection of cancer can be determined using expression levels of any of these sequences alone or in combination with the levels of expression of other known cancer genes. Determination of the aggressive nature and/or the metastatic potential of a cancer can be determined by comparing levels of one or more gene products of the genes corresponding to the polynucleotides described herein, and comparing total levels of another sequence known to vary in cancerous tissue, e.g., expression of p53, DCC, ras, FAP (see, e.g., Fearon E R, et al., *Cell* (1990) 61(5):759; Hamilton S R et al., *Cancer* (1993) 72:957; Bodmer W, et al., *Nat Genet.* (1994) 4(3):217; Fearon E R, *Ann NY Acad. Sci.* (1995) 768: 101). For example, development of cancer can be detected by examining the level of expression of a gene corresponding to a polynucleotides described herein to the levels of oncogenes (e.g. ras) or tumor suppressor genes (e.g. FAP or p53). Thus expression of specific marker polynucleotides can be used to discriminate between normal and cancerous tissue, to discriminate between cancers with different cells of origin, to discriminate between cancers with different potential metastatic rates, etc. For a review of other markers of cancer, see, e.g., Hanahan et al. (2000) Cell 100:57-70.

Treatment of Cancer

The invention further provides methods for reducing growth of cancer cells. The methods provide for decreasing the expression of a gene that is differentially expressed in a cancer cell or decreasing the level of and/or decreasing an activity of a cancer-associated polypeptide. In general, the methods comprise contacting a cancer cell with a substance that modulates (1) expression of a gene that is differentially expressed in cancer; or (2) a level of and/or an activity of a cancer-associated polypeptide.

"Reducing growth of cancer cells" includes, but is not limited to, reducing proliferation of cancer cells, and reducing the incidence of a non-cancerous cell becoming a cancerous cell. Whether a reduction in cancer cell growth has been achieved can be readily determined using any known assay, including, but not limited to, [$^3$H]-thymidine incorporation; counting cell number over a period of time; detecting and/or measuring a marker associated with breast cancer (e.g., PSA).

The present invention provides methods for treating cancer, generally comprising administering to an individual in need thereof a substance that reduces cancer cell growth, in an amount sufficient to reduce cancer cell growth and treat the cancer. Whether a substance, or a specific amount of the substance, is effective in treating cancer can be assessed using any of a variety of known diagnostic assays for cancer, including, but not limited to, proctoscopy, rectal examination, biopsy, contrast radiographic studies, CAT scan, and detection of a tumor marker associated with cancer in the blood of the individual (e.g., PSA (breast-specific antigen)). The substance can be administered systemically or locally. Thus, in some embodiments, the substance is administered locally, and cancer growth is decreased at the site of administration. Local administration may be useful in treating, e.g., a solid tumor.

A substance that reduces cancer cell growth can be targeted to a cancer cell. Thus, in some embodiments, the invention provides a method of delivering a drug to a cancer cell, comprising administering a drug-antibody complex to a subject, wherein the antibody is specific for a cancer-associated polypeptide, and the drug is one that reduces cancer cell growth, a variety of which are known in the art. Targeting can be accomplished by coupling (e.g., linking, directly or via a linker molecule, either covalently or non-covalently, so as to form a drug-antibody complex) a drug to an antibody specific for a cancer-associated polypeptide. Methods of coupling a drug to an antibody are well known in the art and need not be elaborated upon herein.

Tumor Classification and Patient Stratification

The invention further provides for methods of classifying tumors, and thus grouping or "stratifying" patients, according to the expression profile of selected differentially expressed genes in a tumor. Differentially expressed genes can be analyzed for correlation with other differentially expressed genes in a single tumor type or across tumor types. Genes that demonstrate consistent correlation in expression profile in a given cancer cell type (e.g., in a cancer cell or type of cancer) can be grouped together, e.g., when one gene is overexpressed in a tumor, a second gene is also usually overexpressed. Tumors can then be classified according to the expression profile of one or more genes selected from one or more groups.

The tumor of each patient in a pool of potential patients can be classified as described above. Patients having similarly classified tumors can then be selected for participation in an investigative or clinical trial of a cancer therapeutic where a homogeneous population is desired. The tumor classification of a patient can also be used in assessing the efficacy of a cancer therapeutic in a heterogeneous patient population. In addition, therapy for a patient having a tumor of a given expression profile can then be selected accordingly.

In another embodiment, differentially expressed gene products (e.g., polypeptides or polynucleotides encoding such polypeptides) may be effectively used in treatment through vaccination. The growth of cancer cells is naturally limited in part due to immune surveillance. Stimulation of the immune system using a particular tumor-specific antigen enhances the effect towards the tumor expressing the antigen. An active vaccine comprising a polypeptide encoded by the cDNA of this invention would be appropriately administered to subjects having an alteration, e.g., overabundance, of the corresponding RNA, or those predisposed for developing cancer cells with an alteration of the same RNA. Polypeptide antigens are typically combined with an adjuvant as part of a vaccine composition. The vaccine is preferably administered first as a priming dose, and then again as a boosting dose, usually at least four weeks later. Further boosting doses may be given to enhance the effect. The dose and its timing are usually determined by the person responsible for the treatment.

The invention also encompasses the selection of a therapeutic regimen based upon the expression profile of differentially expressed genes in the patient's tumor. For example, a tumor can be analyzed for its expression profile of the genes corresponding to SEQ ID NOS:1-23767 as described herein, e.g., the tumor is analyzed to determine which genes are expressed at elevated levels or at decreased levels relative to normal cells of the same tissue type. The expression patterns of the tumor are then compared to the expression patterns of tumors that respond to a selected therapy. Where the expression profiles of the test tumor cell and the expression profile of a tumor cell of known drug responsivity at least substantially match (e.g., selected sets of genes at elevated levels in the tumor of known drug responsivity and are also at elevated levels in the test tumor cell), then the therapeutic agent selected for therapy is the drug to which tumors with that expression pattern respond.

Pattern Matching in Diagnosis Using Arrays

In another embodiment, the diagnostic and/or prognostic methods of the invention involve detection of expression of a selected set of genes in a test sample to produce a test expression pattern (TEP). The TEP is compared to a reference expression pattern (REP), which is generated by detection of expression of the selected set of genes in a reference sample (e.g., a positive or negative control sample). The selected set of genes includes at least one of the genes of the invention, which genes correspond to the polynucleotide sequences described herein. Of particular interest is a selected set of genes that includes gene differentially expressed in the disease for which the test sample is to be screened.

Identification of Therapeutic Targets and Anti-Cancer Therapeutic Agents

The present invention also encompasses methods for identification of agents having the ability to modulate activity of a differentially expressed gene product, as well as methods for identifying a differentially expressed gene product as a therapeutic target for treatment of cancer.

Identification of compounds that modulate activity of a differentially expressed gene product can be accomplished using any of a variety of drug screening techniques. Such agents are candidates for development of cancer therapies. Of particular interest are screening assays for agents that have tolerable toxicity for normal, non-cancerous human cells. The screening assays of the invention are generally based upon the ability of the agent to modulate an activity of a differentially expressed gene product and/or to inhibit or suppress phenomenon associated with cancer (e.g., cell proliferation, colony formation, cell cycle arrest, metastasis, and the like).

Screening of Candidate Agents

Screening assays can be based upon any of a variety of techniques readily available and known to one of ordinary skill in the art. In general, the screening assays involve contacting a cancerous cell with a candidate agent, and assessing the effect upon biological activity of a differentially expressed gene product. The effect upon a biological activity can be detected by, for example, detection of expression of a gene product of a differentially expressed gene (e.g., a decrease in mRNA or polypeptide levels, would in turn cause a decrease in biological activity of the gene product). Alternatively or in addition, the effect of the candidate agent can be assessed by examining the effect of the candidate agent in a functional assay. For example, where the differentially expressed gene product is an enzyme, then the effect upon biological activity can be assessed by detecting a level of enzymatic activity associated with the differentially expressed gene product. The functional assay will be selected according to the differentially expressed gene product. In general, where the differentially expressed gene is increased in expression in a cancerous cell, agents of interest are those that decrease activity of the differentially expressed gene product.

Assays described infra can be readily adapted in the screening assay embodiments of the invention. Exemplary assays useful in screening candidate agents include, but are not limited to, hybridization-based assays (e.g., use of nucleic acid probes or primers to assess expression levels), antibody-based assays (e.g., to assess levels of polypeptide gene products), binding assays, (e.g., to detect interaction of a candidate agent with a differentially expressed polypeptide, which assays may be competitive assays where a natural or synthetic ligand for the polypeptide is available), and the like; Additional exemplary assays include, but are not necessarily limited to, cell proliferation assays, antisense knockout assays, assays to detect inhibition of cell cycle, assays of induction of cell death/apoptosis, and the like. Generally such assays are conducted in vitro, but many assays can be adapted for in vivo analyses, e.g., in an animal model of the cancer.

Identification of Therapeutic Targets

In another embodiment, the invention contemplates identification of differentially expressed genes and gene products as therapeutic targets. In some respects, this is the converse of the assays described above for identification of agents having activity in modulating (e.g., decreasing or increasing) activity of a differentially expressed gene product.

In this embodiment, therapeutic targets are identified by examining the effect(s) of an agent that can be demonstrated or has been-demonstrated to modulate a cancerous phenotype (e.g., inhibit or suppress or prevent development of a cancerous phenotype). Such agents are generally referred to herein as an "anti-cancer agent", which agents encompass chemotherapeutic agents. For example, the agent can be an antisense oligonucleotide that is specific for a selected gene transcript. For example, the antisense oligonucleotide may have a sequence corresponding to a sequence of a differentially expressed gene described herein, e.g., a sequence of one of SEQ ID NOS:1-23767.

Assays for identification of therapeutic targets can be conducted in a variety of ways using methods that are well known to one of ordinary skill in the art. For example, a test cancerous cell that expresses or overexpresses a differentially expressed gene is contacted with an anti-cancer agent, the effect upon a cancerous phenotype and a biological activity of the candidate gene product assessed. The biological activity of the candidate gene product can be assayed be examining, for example, modulation of expression of a gene encoding the candidate gene product (e.g., as detected by, for example, an increase or decrease in transcript levels or polypeptide levels), or modulation of an enzymatic or other activity of the gene product. The cancerous phenotype can be, for example, cellular proliferation, loss of contact inhibition of growth (e.g., colony formation), tumor growth (in vitro or in vivo), and the like. Alternatively or in addition, the effect of modulation of a biological activity of the candidate target gene upon cell death/apoptosis or cell cycle regulation can be assessed.

Inhibition or suppression of a cancerous phenotype, or an increase in cell death or apoptosis as a result of modulation of biological activity of a candidate gene product indicates that the candidate gene product is a suitable target for cancer therapy. Assays described infra can be readily adapted for assays for identification of therapeutic targets. Generally such assays are conducted in vitro, but many assays can be adapted for in vivo analyses, e.g., in an appropriate, art-accepted animal model of the cancer.

Candidate Agents

The term "agent" as used herein describes any molecule, e.g. protein or pharmaceutical, with the capability of modulating a biological activity of a gene product of a differentially expressed gene. Generally a plurality of assay mixtures are run in parallel with different agent concentrations to obtain a differential response to the various concentrations. Typically, one of these concentrations serves as a negative control, i.e. at zero concentration or below the level of detection.

Candidate agents encompass numerous chemical classes, though typically they are organic molecules, preferably small organic compounds having a molecular weight of more than 50 and less than about 2,500 daltons. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Candidate agents are also found among biomolecules including, but not limited to: peptides, saccharides, fatty acids, steroids, purines, pyrimidines, derivatives, structural analogs or combinations thereof.

Candidate agents are obtained from a wide variety of sources including libraries of synthetic or natural compounds. For example, numerous means are available for random and directed synthesis of a wide variety of organic compounds and biomolecules, including expression of randomized oligonucleotides and oligopeptides. Alternatively, libraries of natural compounds in the form of bacterial, fungal, plant and animal extracts (including extracts from human tissue to identify endogenous factors affecting differentially expressed gene products) are available or readily produced. Additionally, natural or synthetically produced libraries and compounds are readily modified through conventional chemical, physical and biochemical means, and may be used to produce combinatorial libraries. Known pharmacological agents may be subjected to directed or random chemical modifications, such as acylation, alkylation, esterification, amidification, etc. to produce structural analogs.

Exemplary candidate agents of particular interest include, but are not limited to, antisense and RNAi polynucleotides, and antibodies, soluble receptors, and the like. Antibodies and soluble receptors are of particular interest as candidate agents where the target differentially expressed gene product is secreted or accessible at the cell-surface (e.g., receptors and other molecule stably-associated with the outer cell membrane).

For method that involve RNAi (RNA interference), a double stranded RNA (dsRNA) molecule is usually used. The dsRNA is prepared to be substantially identical to at least a segment of a subject polynucleotide (e.g. a cDNA or gene). In general, the dsRNA is selected to have at least 70%, 75%, 80%, 85% or 90% sequence identity with the subject polynucleotide over at least a segment of the candidate gene. In other instances, the sequence identity is even higher, such as 95%, 97% or 99%, and in still other instances, there is 100% sequence identity with the subject polynucleotide over at least a segment of the subject polynucleotide. The size of the segment over which there is sequence identity can vary depending upon the size of the subject polynucleotide. In general, however, there is substantial sequence identity over at least 15, 20, 25, 30, 35, 40 or 50 nucleotides. In other instances, there is substantial sequence identity over at least 100, 200, 300, 400, 500 or 1000 nucleotides; in still other instances, there is substantial sequence identity over the entire length of the subject polynucleotide, i.e., the coding and non-coding region of the candidate gene.

Because only substantial sequence similarity between the subject polynucleotide and the dsRNA is necessary, sequence variations between these two species arising from genetic mutations, evolutionary divergence and polymorphisms can be tolerated. Moreover, as described further infra, the dsRNA can include various modified or nucleotide analogs.

Usually the dsRNA consists of two separate complementary RNA strands. However, in some instances, the dsRNA may be formed by a single strand of RNA that is self-complementary, such that the strand loops back upon itself to form a hairpin loop. Regardless of form, RNA duplex formation can occur inside or outside of a cell.

The size of the dsRNA that is utilized varies according to the size of the subject polynucleotide whose expression is to be suppressed and is sufficiently long to be effective in reducing expression of the subject polynucleotide in a cell. Generally, the dsRNA is at least 10-15 nucleotides long. In certain applications, the dsRNA is less than 20, 21, 22, 23, 24 or 25 nucleotides in length. In other instances, the dsRNA is at least 50, 100, 150 or 200 nucleotides in length. The dsRNA can be longer still in certain other applications, such as at least 300, 400, 500 or 600 nucleotides. Typically, the dsRNA is not longer than 3000 nucleotides. The optimal size for any particular subject polynucleotide can be determined by one of ordinary skill in the art without undue experimentation by varying the size of the dsRNA in a systematic fashion and determining whether the size selected is effective in interfering with expression of the subject polynucleotide.

dsRNA can be prepared according to any of a number of methods that are known in the art, including in vitro and in vivo methods, as well as by synthetic chemistry approaches.

In vitro methods. Certain methods generally involve inserting the segment corresponding to the candidate gene that is to be transcribed between a promoter or pair of promoters that are oriented to drive transcription of the inserted segment and then utilizing an appropriate RNA polymerase to carry out transcription. One such arrangement involves positioning a DNA fragment corresponding to the candidate gene or segment thereof into a vector such that it is flanked by two opposable polymerase-specific promoters that can be same or different. Transcription from such promoters produces two complementary RNA strands that can subsequently anneal to form the desired dsRNA. Exemplary plasmids for use in such systems include the plasmid (PCR 4.0 TOPO) (available from Invitrogen). Another example is the vector pGEM-T (Promega, Madison, Wis.) in which the oppositely oriented promoters are T7 and SP6; the T3 promoter can also be utilized.

In a second arrangement, DNA fragments corresponding to the segment of the subject polynucleotide that is to be transcribed is inserted both in the sense and antisense orientation downstream of a single promoter. In this system, the sense and antisense fragments are cotranscribed to generate a single RNA strand that is self-complementary and thus can form dsRNA.

Various other in vitro methods have been described. Examples of such methods include, but are not limited to, the methods described by Sadher et al. (Biochem. Int. 1-4:1015, 1987); by Bhattacharyya (Nature 343:484, 1990); and by Livache, et al. (U.S. Pat. No. 5,795,715), each of which is incorporated herein by reference in its entirety.

Single-stranded RNA can also be produced using a combination of enzymatic and organic synthesis or by total organic synthesis. The use of synthetic chemical methods enable one to introduce desired modified nucleotides or nucleotide analogs into the dsRNA.

In vivo methods. dsRNA can also be prepared in vivo according to a number of established methods (see, e.g., Sambrook, et al. (1989) Molecular Cloning: A Laboratory Manual, $2^{nd}$ ed.; Transcription and Translation (B. D. Hames, and S. J. Higgins, Eds., 1984); DNA Cloning, volumes I and II (D. N. Glover, Ed., 1985); and Oligonucleotide Synthesis (M. J. Gait, Ed., 1984, each of which is incorporated herein by reference in its entirety).

Once the single-stranded RNA has been formed, the complementary strands are allowed to anneal to form duplex RNA. Transcripts are typically treated with DNAase and further purified according to established protocols to remove proteins. Usually such purification methods are not conducted with phenol:chloroform. The resulting purified transcripts are subsequently dissolved in RNAase free water or a buffer of suitable composition.

dsRNA is generated by annealing the sense and anti-sense RNA in vitro. Generally, the strands are initially denatured to keep the strands separate and to avoid self-annealing. During the annealing process, typically certain ratios of the sense and antisense strands are combined to facilitate the annealing process. In some instances, a molar ratio of sense to antisense strands of 3:7 is used; in other instances, a ratio of 4:6 is utilized; and in still other instances, the ratio is 1:1.

The buffer composition utilized during the annealing process can in some instances affect the efficacy of the annealing process and subsequent transfection procedure. While some have indicated that the buffered solution used to carry out the annealing process should include a potassium salt such as potassium chloride (e.g. at a concentration of about 80 mM). In some embodiments, the buffer is substantially potassium free. Once single-stranded RNA has annealed to form duplex RNA, typically any single-strand overhangs are removed using an enzyme that specifically cleaves such overhangs (e.g., RNAase A or RNAase T).

Once the dsRNA has been formed, it is introduced into a reference cell, which can include an individual cell or a population of cells (e.g., a tissue, an embryo and an entire organism). The cell can be from essentially any source, including animal, plant, viral, bacterial, fungal and other sources. If a tissue, the tissue can include dividing or nondividing and differentiated or undifferentiated cells. Further, the tissue can include germ line cells and somatic cells. Examples of differentiated cells that can be utilized include, but are not limited to, neurons, glial cells, blood cells, megakaryocytes, lymphocytes, macrophages, neutrophils, eosinophils, basophils, mast cells, leukocytes, granulocytes, keratinocytes, adipocytes, osteoblasts, osteoclasts, hepatocytes, cells of the endocrine or exocrine glands, fibroblasts, myocytes, cardiomyocytes, and endothelial cells. The cell can be an individual cell of an embryo, and can be a blastocyte or an oocyte.

Certain methods are conducted using model systems for particular cellular states (e.g., a disease). For instance, certain methods provided herein are conducted with a cancer cell lines that serves as a model system for investigating genes that are correlated with various cancers.

A number of options can be utilized to deliver the dsRNA into a cell or population of cells such as in a cell culture, tissue or embryo. For instance, RNA can be directly introduced intracellularly. Various physical methods are generally utilized in such instances, such as administration by microinjection (see, e.g., Zernicka-Goetz, et al. (1997) Development 124:1133-1137; and Wianny, et al. (1998) Chromosoma 107: 430-439).

Other options for cellular delivery include permeabilizing the cell membrane and electroporation in the presence of the dsRNA, liposome-mediated transfection, or transfection using chemicals such as calcium phosphate. A number of established gene therapy techniques can also be utilized to introduce the dsRNA into a cell. By introducing a viral construct within a viral particle, for instance, one can achieve efficient introduction of an expression construct into the cell and transcription of the RNA encoded by the construct.

If the dsRNA is to be introduced into an organism or tissue, gene gun technology is an option that can be employed. This generally involves immobilizing the dsRNA on a gold particle which is subsequently fired into the desired tissue. Research has also shown that mammalian cells have transport mechanisms for taking in dsRNA (see, e.g., Asher, et al. (1969) Nature 223:715-717). Consequently, another delivery option is to administer the dsRNA extracellularly into a body cavity, interstitial space or into the blood system of the mammal for subsequent uptake by such transport processes. The blood and lymph systems and the cerebrospinal fluid are potential sites for injecting dsRNA. Oral, topical, parenteral, rectal and intraperitoneal administration are also possible modes of administration.

The composition introduced can also include various other agents in addition to the dsRNA. Examples of such agents include, but are not limited to, those that stabilize the dsRNA, enhance cellular uptake and/or increase the extent of interference. Typically, the dsRNA is introduced in a buffer that is compatible with the composition of the cell into which the RNA is introduced to prevent the cell from being shocked.

The minimum size of the dsRNA that effectively achieves gene silencing can also influence the choice of delivery system and solution composition.

Sufficient dsRNA is introduced into the tissue to cause a detectable change in expression of a taget gene (assuming the candidate gene is in fact being expressed in the cell into which the dsRNA is introduced) using available detection methodologies. Thus, in some instances, sufficient dsRNA is introduced to achieve at least a 5-10% reduction in candidate gene expression as compared to a cell in which the dsRNA is not introduced. In other instances, inhibition is at least 20, 30, 40, or 50%. In still other instances, the inhibition is at least 60, 70, 80, 90 or 95%. Expression in some instances is essentially completely inhibited to undetectable levels.

The amount of dsRNA introduced depends upon various factors such as the mode of administration utilized, the size of the dsRNA, the number of cells into which dsRNA is administered, and the age and size of an animal if dsRNA is introduced into an animal. An appropriate amount can be determined by those of ordinary skill in the art by initially administering dsRNA at several different concentrations for example, for example. In certain instances when dsRNA is introduced into a cell culture, the amount of dsRNA introduced into the cells varies from about 0.5 to 3 µg per $10^6$ cells.

A number of options are available to detect interference of candidate gene expression (i.e., to detect candidate gene silencing). In general, inhibition in expression is detected by detecting a decrease in the level of the protein encoded by the candidate gene, determining the level of mRNA transcribed from the gene and/or detecting a change in phenotype associated with candidate gene expression.

Use of Polypeptides to Screen for Peptide Analogs and Antagonists

Polypeptides encoded by differentially expressed genes identified herein can be used to screen peptide libraries to identify binding partners, such as receptors, from among the encoded polypeptides. Peptide libraries can be synthesized according to methods known in the art (see, e.g., U.S. Pat. No. 5,010,175 and WO 91/17823).

Agonists or antagonists of the polypeptides of the invention can be screened using any available method known in the art, such as signal transduction, antibody binding, receptor binding, mitogenic assays, chemotaxis assays, etc. The assay conditions ideally should resemble the conditions under which the native activity is exhibited in vivo, that is, under physiologic pH, temperature, and ionic strength. Suitable agonists or antagonists will exhibit strong inhibition or enhancement of the native activity at concentrations that do not cause toxic side effects in the subject. Agonists or antagonists that compete for binding to the native polypeptide can require concentrations equal to or greater than the native concentration, while inhibitors capable of binding irreversibly to the polypeptide can be added in concentrations on the order of the native concentration.

Such screening and experimentation can lead to identification of a polypeptide binding partner, such as a receptor, encoded by a gene or a cDNA corresponding to a polynucleotide described herein, and at least one peptide agonist or antagonist of the binding partner. Such agonists and antagonists can be used to modulate, enhance, or inhibit receptor function in cells to which the receptor is native, or in cells that possess the receptor as a result of genetic engineering. Further, if the receptor shares biologically important characteristics with a known receptor, information about agonist/antagonist binding can facilitate development of improved agonists/antagonists of the known receptor.

Vaccines and Uses

The differentially expressed nucleic acids and polypeptides produced by the nucleic acids of the invention can also be used to modulate primary immune response to prevent or treat cancer. Every immune response is a complex and intricately regulated sequence of events involving several cell types. It is triggered when an antigen enters the body and encounters a specialized class of cells called antigen-presenting cells (APCs). These APCs capture a minute amount of the antigen and display it in a form that can be recognized by antigen-specific helper T lymphocytes. The helper (Th) cells become activated and, in turn, promote the activation of other classes of lymphocytes, such as B cells or cytotoxic T cells. The activated lymphocytes then proliferate and carry out their specific effector functions, which in many cases successfully activate or eliminate the antigen. Thus, activating the immune response to a particular antigen associated with a cancer cell can protect the patient from developing cancer or result in lymphocytes eliminating cancer cells expressing the antigen.

Gene products, including polypeptides, mRNA (particularly mRNAs having distinct secondary and/or tertiary structures), cDNA, or complete gene, can be prepared and used in vaccines for the treatment or prevention of hyperproliferative disorders and cancers. The nucleic acids and polypeptides can be utilized to enhance the immune response, prevent tumor progression, prevent hyperproliferative cell growth, and the like. Methods for selecting nucleic acids and polypeptides that are capable of enhancing the immune response are known in the art. Preferably, the gene products for use in a vaccine are gene products which are present on the surface of a cell and are recognizable by lymphocytes and antibodies.

The gene products may be formulated with pharmaceutically acceptable carriers into pharmaceutical compositions by methods known in the art. The composition is useful as a vaccine to prevent or treat cancer. The composition may further comprise at least one co-immunostimulatory molecule, including but not limited to one or more major histocompatibility complex (MHC) molecules, such as a class I or class II molecule, preferably a class I molecule. The composition may further comprise other stimulator molecules including B7.1, B7.2, ICAM-1, ICAM-2, LFA-1, LFA-3, CD72 and the like, immunostimulatory polynucleotides (which comprise an 5'-CG-3' wherein the cytosine is unmethylated), and cytokines which include but are not limited to IL-1 through IL-15, TNF-α, IFN-γ, RANTES, G-CSF, M-CSF, IFN-α, CTAP III, ENA-78, GRO, I-309, PF-4, IP-10, LD-78, MGSA, MIP-1α, MIP-1β, or combination thereof, and the like for immunopotentiation. In one embodiment, the immunopotentiators of particular interest are those that facilitate a Th1 immune response.

The gene products may also be prepared with a carrier that will protect the gene products against rapid elimination from the body, such as a controlled release formulation, including implants and microencapsulated delivery systems. Biodegradable polymers can be used, such as ethylene vinyl acetate, polyanhydrides, polyglycolic acid, collagen, polyorthoesters, polylactic acid, and the like. Methods for preparation of such formulations are known in the art.

In the methods of preventing or treating cancer, the gene products may be administered via one of several routes including but not limited to transdermal, transmucosal, intravenous, intramuscular, subcutaneous, intradermal, intraperitoneal, intrathecal, intrapleural, intrauterine, rectal, vaginal, topical, intratumor, and the like. For transmucosal or transdermal administration, penetrants appropriate to the barrier to be permeated are used in the formulation. Such penetrants are generally known in the art, and include, for example, administration bile salts and fusidic acid derivatives. In addition, detergents may be used to facilitate permeation. Transmucosal administration may be by nasal sprays or suppositories. For oral administration, the gene products are formulated into conventional oral administration form such as capsules, tablets, elixirs and the like.

The gene product is administered to a patient in an amount effective to prevent or treat cancer. In general, it is desirable to provide the patient with a dosage of gene product of at least about 1 pg per Kg body weight, preferably at least about 1 ng per Kg body weight, more preferably at least about 1 µg or greater per Kg body weight of the recipient. A range of from about 1 ng per Kg body weight to about 100 mg per Kg body weight is preferred although a lower or higher dose may be administered. The dose is effective to prime, stimulate and/or cause the clonal expansion of antigen-specific T lymphocytes, preferably cytotoxic T lymphocytes, which in turn are capable of preventing or treating cancer in the recipient. The dose is administered at least once and may be provided as a bolus or a continuous administration. Multiple administrations of the dose over a period of several weeks to months may be preferable. Subsequent doses may be administered as indicated.

In another method of treatment, autologous cytotoxic lymphocytes or tumor infiltrating lymphocytes may be obtained from a patient with cancer. The lymphocytes are grown in culture, and antigen-specific lymphocytes are expanded by culturing in the presence of the specific gene products alone or in combination with at least one co-immunostimulatory molecule with cytokines. The antigen-specific lymphocytes are then infused back into the patient in an amount effective to reduce or eliminate the tumors in the patient. Cancer vaccines and their uses are further described in U.S. Pat. No. 5,961,978; U.S. Pat. No. 5,993,829; U.S. Pat. No. 6,132,980; and WO 00/38706.

Pharmaceutical Compositions and Uses

Pharmaceutical compositions can comprise polypeptides, receptors that specifically bind a polypeptide produced by a differentially expressed gene (e.g., antibodies, or polynucleotides (including antisense nucleotides and ribozymes) of the claimed invention in a therapeutically effective amount. The compositions can be used to treat primary tumors as well as metastases of primary tumors. In addition, the pharmaceutical compositions can be used in conjunction with conventional methods of cancer treatment, e.g., to sensitize tumors to radiation or conventional chemotherapy.

Where the pharmaceutical composition comprises a receptor (such as an antibody) that specifically binds to a gene product encoded by a differentially expressed gene, the receptor can be coupled to a drug for delivery to a treatment site or coupled to a detectable label to facilitate imaging of a site comprising cancer cells. Methods for coupling antibodies to drugs and detectable labels are well known in the art, as are methods for imaging using detectable labels.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature.

The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation is determined by routine experimentation and is within the judgment of the clinician. For purposes of the present invention, an effective dose will generally be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which can be administered without undue toxicity. Suitable carriers can be large, slowly metabolized macromolecules such as proteins, polysaccharides, polylactic acids, polyglycolic acids, polymeric amino acids, amino acid copolymers, lipid aggregates and inactive virus particles. Such carriers are well known to those of ordinary skill in the art. Pharmaceutically acceptable carriers in therapeutic compositions can include liquids such as water, saline, glycerol and ethanol. Auxiliary substances, such as wetting or emulsifying agents, pH buffering substances, and the like, can also be present in such vehicles.

Typically, the therapeutic compositions are prepared as injectables, either as liquid solutions or suspensions; solid forms suitable for solution in, or suspension in, liquid vehicles prior to injection can also be prepared. Liposomes are included within the definition of a pharmaceutically acceptable carrier. Pharmaceutically acceptable salts can also be present in the pharmaceutical composition, e.g., mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in *Remington: The Science and Practice of Pharmacy* (1995) Alfonso Gennaro, Lippincott, Williams, & Wilkins.

Delivery Methods

Once formulated, the compositions contemplated by the invention can be (1) administered directly to the subject (e.g., as polynucleotide, polypeptides, small molecule agonists or antagonists, and the like); or (2) delivered ex vivo, to cells derived from the subject (e.g., as in ex vivo gene therapy). Direct delivery of the compositions will generally be accomplished by parenteral injection, e.g., subcutaneously, intraperitoneally, intravenously or intramuscularly, intratumoral or to the interstitial space of a tissue. Other modes of administration include oral and pulmonary administration, suppositories, and transdermal applications, needles, and gene guns or hyposprays. Dosage treatment can be a single dose schedule or a multiple dose schedule.

Methods for the ex vivo delivery and reimplantation of transformed cells into a subject are known in the art and described in e.g., International Publication No. WO 93/14778. Examples of cells useful in ex vivo applications include, for example, stem cells, particularly hematopoetic, lymph cells, macrophages, dendritic cells, or tumor cells. Generally, delivery of nucleic acids for both ex vivo and in vitro applications can be accomplished by, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Once differential expression of a gene corresponding to a polynucleotide described herein has been found to correlate with a proliferative disorder, such as neoplasia, dysplasia, and hyperplasia, the disorder can be amenable to treatment by administration of a therapeutic agent based on the provided polynucleotide, corresponding polypeptide or other corresponding molecule (e.g., antisense, ribozyme, etc.). In other embodiments, the disorder can be amenable to treatment by administration of a small molecule drug that, for example, serves as an inhibitor (antagonist) of the function of the encoded gene product of a gene having increased expression in cancerous cells relative to normal cells or as an agonist for gene products that are decreased in expression in cancerous cells (e.g., to promote the activity of gene products that act as tumor suppressors).

The dose and the means of administration of the inventive pharmaceutical compositions are determined based on the specific qualities of the therapeutic composition, the condition, age, and weight of the patient, the progression of the disease, and other relevant factors. For example, administration of polynucleotide therapeutic composition agents includes local or systemic administration, including injection, oral administration, particle gun or catheterized administration, and topical administration. In general, the therapeutic polynucleotide composition contains an expression construct comprising a promoter operably linked to a polynucleotide of at least 12, 22, 25, 30, or 35 contiguous nt of the polynucleotide disclosed herein. Various methods can be used to administer the therapeutic composition directly to a specific site in the body. For example, a small metastatic lesion is located and the therapeutic composition injected several times in several different locations within the body of the tumor. Alternatively, arteries which serve a tumor are identified, and the therapeutic composition injected into such an artery, in order to deliver the composition directly into the tumor. A tumor that has a necrotic center is aspirated and the composition injected directly into the now empty center of the tumor. The antisense composition is directly administered to the surface of the tumor, for example, by topical application of the composition. X-ray imaging is used to assist in certain of the above delivery methods.

Targeted delivery of therapeutic compositions containing an antisense polynucleotide, subgenomic polynucleotides, or antibodies to specific tissues can also be used. Receptor-mediated DNA delivery techniques are described in, for example, Findeis et al., Trends Biotechnol. (1993) 11:202; Chiou et al., Gene Therapeutics: Methods And Applications Of Direct Gene Transfer (J. A. Wolff, ed.) (1994); Wu et al., J. Biol. Chem. (1988) 263:621; Wu et al., J. Biol. Chem. (1994) 269:542; Zenke et al., Proc. Natl. Acad. Sci. (USA) (1990) 87:3655; Wu et al., J. Biol. Chem. (1991) 266:338. Therapeutic compositions containing a polynucleotide are administered in a range of about 100 ng to about 200 mg of DNA for local administration in a gene therapy protocol. Concentration ranges of about 500 ng to about 50 mg, about 1 µg to about 2 mg, about 5 µg to about 500 µg, and about 20 µg to about 100: g of DNA can also be used during a gene therapy protocol. Factors such as method of action (e.g., for enhancing or inhibiting levels of the encoded gene product) and efficacy of transformation and expression are considerations that will affect the dosage required for ultimate efficacy of the antisense subgenomic polynucleotides.

The therapeutic polynucleotides and polypeptides of the present invention can be delivered using gene delivery vehicles. The gene delivery vehicle can be of viral or non-viral origin (see generally, Jolly, Cancer Gene Therapy (1994) 1:51; Kimura, Human Gene Therapy (1994) 5:845; Connelly, Human Gene Therapy (1995) 1:185; and Kaplitt, Nature Genetics (1994) 6:148). Expression of such coding sequences can be induced using endogenous mammalian or heterologous promoters. Expression of the coding sequence can be either constitutive or regulated.

Viral-based vectors for delivery of a desired polynucleotide and expression in a desired cell are well known in the art. Exemplary viral-based vehicles include, but are not limited to, recombinant retroviruses (see, e.g., WO 90/07936; WO 94/03622; WO 93/25698; WO 93/25234; U.S. Pat. No. 5,219, 740; WO 93/11230; WO 93/10218; U.S. Pat. No. 4,777,127; GB Patent No. 2,200,651; EP 0 345 242; and WO 91/02805), alphavirus-based vectors (e.g., Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532), and adeno-associated virus (AAV) vectors (see, e.g., WO 94/12649, WO 93/03769; WO 93/19191; WO 94/28938; WO 95/11984 and WO 95/00655). Administration of DNA linked to killed adenovirus as described in Curiel, Hum. Gene Ther. (1992) 3:147 can also be employed.

Non-viral delivery vehicles and methods can also be employed, including, but not limited to, polycationic condensed DNA linked or unlinked to killed adenovirus alone (see, e.g., Curiel, Hum. Gene Ther. (1992) 3:147); ligand-linked DNA (see, e.g., Wu, J. Biol. Chem. (1989) 264:16985); eukaryotic cell delivery vehicles cells (see, e.g., U.S. Pat. No. 5,814,482; WO 95/07994; WO 96/17072; WO 95/30763; and WO 97/42338) and nucleic charge neutralization or fusion with cell membranes. Naked DNA can also be employed. Exemplary naked DNA introduction methods are described in WO 90/11092 and U.S. Pat. No. 5,580,859. Liposomes that can act as gene delivery vehicles are described in U.S. Pat. No. 5,422,120; WO 95/13796; WO 94/23697; WO 91/14445; and EP 0524968. Additional approaches are described in Philip, Mol. Cell Biol. (1994) 14:2411, and in Woffendin, Proc. Natl. Acad. Sci. (1994) 91:1581.

The sequences disclosed in this patent application were disclosed in several earlier patent applications. The relationship between the SEQ ID NOS in those earlier application and the SEQ ID NOS disclosed herein is shown in Tables 161 and 162.

TABLE 161 relationship between SEQ ID NOs. this patent application and SEQ ID NOs of parent patent applications

| parent case | parent application no. | filing date | SEQ IDs in parent case | corresponding SEQ IDs in this patent application |
|---|---|---|---|---|
| 1480 | 10/076,555 | Feb. 15, 2002 | 1-844 | 1-844 |
| 1481 | 09/297,648 | Mar. 10, 2000 | 1-5252 | 845-6096 |
| 1487 | 09/313,292 | May 13, 1999 | 1-2707 | 6097-8803 |
| 1490 | 09/854,124 | May 10, 2001 | 1-37 | 8804-8840 |
| 1492 | 09/404,706 | Sep. 23, 1999 | 1-1079 | 8841-9919 |
| 1598 | 10/629,771 | Jul. 28, 2003 | 1-3351 | 9920-13270 |
| 1624 | 09/803,719 | Mar. 9, 2001 | 1-2396 | 13271-15666 |
| 1625 | 10/609,021 | Jun. 26, 2003 | 1-324 | 15667-15990 |
| 15990 | 10/615,618 | Jul. 7, 2003 | 1-6010 | 15991-22000 |
| 16252 | 10/012,697 | Dec. 7, 2001 | 1-1568 | 22001-23568 |
| 18790 | 60/532,830 | Dec. 23, 2003 | 1-199 | 23569-23767 |

The disclosures of all prior U.S. applications to which the present application claims priority, which includes those U.S. applications referenced in the table above as well as their respective priority applications, are each incorporated herein by referenced in their entireties for all purposes, including the disclosures found in the Sequence Listings, tables, figures and Examples.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Centigrade, and pressure is at or near atmospheric.

Example 1

Source of Biological Materials and Overview of Novel Polynucleotides Expressed by the Biological Materials Human colon cancer cell line Km12L4-A (Morika, W. A. K. et al., *Cancer Research* (1988) 48:6863) was used to construct a cDNA library from mRNA isolated from the cells. As described in the above overview, a total of 4,693 sequences expressed by the Km12L4-A cell line were isolated and analyzed; most sequences were about 275-300 nucleotides in length. The KM12L4-A cell line is derived from the KM12C cell line. The KM12C cell line, which is poorly metastatic (low metastatic) was established in culture from a Dukes' stage $B_2$ surgical specimen (Morikawa et al. *Cancer Res*. (1988) 48:6863). The KML4-A is a highly metastatic subline derived from KM12C (Yeatman et al. *Nucl. Acids. Res*. (1995) 23:4007; Bao-Ling et al. *Proc. Annu. Meet. Am. Assoc. Cancer. Res*. (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res*. (1995) 1:19; Yeatman et al., (1995) supra; Yeatman et al. *Clin. Exp. Metastasis* (1996) 14:246).

The sequences were first masked to eliminate low complexity sequences using the XBLAST masking program (Claverie "Effective Large-Scale Sequence Similarity Searches," In: *Computer Methods for Macromolecular Sequence Analysis*, Doolittle, ed., *Meth. Enzymol*. 266:212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem*. (1993) 17:191). Generally, masking does not influence the final search results, except to eliminate of relative little interest due to their lox complexity, and to eliminate multiple "hits" based on similarity to repetitive regions common to multiple sequences, e.g., Alu repeats. Masking resulted in the elimination of 43 sequences. The remaining sequences were then used in a BLASTN vs. Genbank search with search parameters of greater than 70% overlap, 99% identity, and a p value of less than $1 \times 10^{-40}$, which search resulted in the discarding of 1,432 sequences. Sequences from this search also were discarded if the inclusive parameters were met, but the sequence was ribosomal or vector-derived.

The resulting sequences from the previous search were classified into three groups (1, 2 and 3 below) and searched in a BLASTX vs. NRP (non-redundant proteins) database search: (1) unknown (no hits in the Genbank search), (2) weak similarity (greater than 45% identity and p value of less than $1 \times 10^{-5}$), and (3) high similarity (greater than 60% overlap, greater than 80% identity, and p value less than $1 \times 10^{-5}$). This search resulted in discard of 98 sequences as having greater than 70% overlap, greater than 99% identity, and p value of less than $1 \times 10^{-40}$.

The remaining sequences were classified as unknown (no hits), weak similarity, and high similarity (parameters as above). Two searches were performed on these sequences. First, a BLAST vs. EST database search resulted in discard of 1771 sequences (sequences with greater than 99% overlap, greater than 99% similarity and a p value of less than $1 \times 10^{-40}$; sequences with a p value of less than $1 \times 10^{-65}$ when compared to a database sequence of human origin were also excluded). Second, a BLASTN vs. Patent GeneSeq database resulted in discard of 15 sequences (greater than 99% identity; p value less than $1 \times 10^{-40}$; greater than 99% overlap).

The remaining sequences were subjected to screening using other rules and redundancies in the dataset. Sequences with a p value of less than $1 \times 10^{-111}$ in relation to a database sequence of human origin were specifically excluded. The final result provided the 404 sequences listed in the accompanying Sequence Listing. The Sequence Listing is arranged beginning with sequences with no similarity to any sequence in a database searched, and ending with sequences with the greatest similarity. Each identified polynucleotide represents sequence from at least a partial mRNA transcript. Polynucleotides that were determined to be novel were assigned a sequence identification number.

The novel polynucleotides and were assigned sequence identification numbers SEQ ID NOS: 1-404. The DNA sequences corresponding to the novel polynucleotides are provided in the Sequence Listing. The majority of the sequences are presented in the Sequence Listing in the 5' to 3' direction. A small number, 25, are listed in the Sequence Listing in the 5' to 3' direction but the sequence as written is actually 3' to 5'. These sequences are readily identified with the designation "AR" in the Sequence Name in Table 1 (inserted before the claims). The sequences correctly listed in the 5' to 3' direction in the Sequence Listing are designated "AF." The Sequence Listing filed herewith therefore contains 25 sequences listed in the reverse order, namely SEQ ID NOS:47, 97, 137, 171, 173, 179, 182, 194, 200, 202, 213, 227, 258, 264, 275, 302, 313, 324, 329, 330, 331, 338, 358, 379, and 404.

Because the provided polynucleotides represent partial mRNA transcripts, two or more polynucleotides of the invention may represent different regions of the same mRNA transcript and the same gene. Thus, if two or more SEQ ID NOS: are identified as belonging to the same clone, then either sequence can be used to obtain the full-length mRNA or gene.

In order to confirm the sequences of SEQ ID NOS:1-404, inserts of the clones corresponding to these polynucleotides were re-sequenced. These "validation" sequences are provided in SEQ ID NOS:405-800. These validation sequences were often longer than the original polynucleotide sequences. They validate, and thus often provide additional sequence information. Validation sequences can be correlated with the original sequences they validate by identifying those sequences of SEQ ID NOS:1-404 and the validation sequences of SEQ ID NOS:405-800 that share the same clone name in Table 1.

TABLE 1

Sequence identification numbers, cluster ID, sequence name, and clone name

| SEQ ID NO: | Cluster ID | Sequence Name | Clone Name |
|---|---|---|---|
| 1 | 4635 | RTA00000180AF.i.20.1 | M00001429B:A11 |
| 2 | | RTA00000185AF.n.12.1 | M00001608D:A11 |
| 3 | 4622 | RTA00000187AF.m.15.2 | M00001686A:E06 |
| 4 | 3706 | RTA00000191AF.i.17.2 | M00004068B:A01 |
| 5 | 36535 | RTA00000181AF.f.5.1 | M00001449A:G10 |
| 6 | 3990 | RTA00000183AF.j.11.1 | M00001532B:A06 |
| 7 | 5319 | RTA00000192AF.i.12.1 | M00004169C:C12 |
| 8 | 36393 | RTA00000180AF.c.2.1 | M00001417A:E02 |
| 9 | 2623 | RTA00000183AF.a.6.1 | M00001497A:G02 |
| 10 | 7587 | RTA00000178AF.n.24.1 | M00001387B:G03 |
| 11 | 7065 | RTA00000137A.g.6.1 | M00001557A:D02 |
| 12 | 10539 | RTA00000187AF.l.7.1 | M00001680D:F08 |
| 13 | 27250 | RTA00000181AF.g.10.1 | M00001450A:D08 |
| 14 | 5556 | RTA00000179AF.n.10.1 | M00001407B:D11 |
| 15 | | RTA00000192AF.m.12.1 | M00004191D:B11 |
| 16 | 8761 | RTA00000184AF.k.12.1 | M00001557D:D09 |
| 17 | 4622 | RTA00000189AF.g.1.1 | M00003856B:C02 |
| 18 | 11460 | RTA00000187AF.g.12.1 | M00001676B:F05 |
| 19 | 16283 | RTA00000120A.o.20.1 | M00001467A:D08 |
| 20 | 3430 | RTA00000191AF.a.9.1 | M00003981A:E10 |
| 21 | 7065 | RTA00000184AF.j.21.1 | M00001557A:D02 |
| 22 | | RTA00000182AF.l.20.1 | M00001488B:F12 |
| 23 | | RTA00000123A.g.19.1 | M00001531A:H11 |
| 24 | 16918 | RTA00000193AF.a.16.1 | M00004223A:G10 |
| 25 | 16914 | RTA00000193AF.f.5.1 | M00004275C:C11 |
| 26 | 40108 | RTA00000187AF.o.24.1 | M00003741D:C09 |
| 27 | 14286 | RTA00000193AF.f.22.1 | M00004283B:A04 |
| 28 | 17004 | RTA00000186AF.b.21.1 | M00001617C:E02 |
| 29 | | RTA00000180AF.g.22.1 | M00001426B:D12 |
| 30 | 13272 | RTA00000192AF.e.3.1 | M00004138B:H02 |
| 31 | | RTA00000194AF.f.4.1 | M00005180C:G03 |
| 32 | 32663 | RTA00000118A.l.8.1 | M00001450A:A11 |
| 33 | | RTA00000180AF.a.9.1 | M00001414A:B01 |
| 34 | 5832 | RTA00000178AF.o.23.1 | M00001388D:G05 |
| 35 | 7801 | RTA00000181AF.c.21.1 | M00001446A:F05 |
| 36 | 76760 | RTA00000187AF.a.15.1 | M00001657D:F08 |
| 37 | 40132 | RTA00000178AF.c.7.1 | M00001365C:C10 |
| 38 | | RTA00000183AF.e.1.1 | M00001505C:C05 |
| 39 | 4016 | RTA00000118A.c.4.1 | M00001395A:C03 |
| 40 | 5382 | RTA00000187AF.m.23.2 | M00001688C:F09 |
| 41 | 5693 | RTA00000190AF.p.17.2 | M00003978B:G05 |
| 42 | 307 | RTA00000136A.o.4.2 | M00001552A:B12 |
| 43 | 39833 | RTA00000178AF.i.23.1 | M00001378B:B02 |
| 44 | | RTA00000193AF.m.5.1 | M00004359B:G02 |
| 45 | 5325 | RTA00000191AF.o.6.1 | M00004093D:B12 |
| 46 | 5325 | RTA00000191AF.o.6.2 | M00004093D:B12 |
| 47 | 18957 | RTA00000190AR.m.9.1 | M00003958A:H02 |
| 48 | 39508 | RTA00000120A.o.2.1 | M00001467A:D04 |
| 49 | 22390 | RTA00000136A.j.13.1 | M00001551A:G06 |
| 50 | 12170 | RTA00000125A.h.18.4 | M00001544A:E03 |
| 51 | 4393 | RTA00000187AF.n.17.1 | M00001693C:G01 |
| 52 | 19 | RTA00000182AF.b.7.1 | M00001463C:B11 |
| 53 | | RTA00000193AF.c.21.1 | M00004249D:F10 |
| 54 | 7899 | RTA00000189AF.c.10.1 | M00003837D:A01 |
| 55 | 40073 | RTA00000191AF.e.3.1 | M00004028D:C05 |
| 56 | 7005 | RTA00000179AF.o.22.1 | M00001410A:D07 |
| 57 | | RTA00000187AF.h.22.1 | M00001679A:F06 |
| 58 | 18957 | RTA00000190AF.m.9.2 | M00003958A:H02 |
| 59 | 18957 | RTA00000183AF.h.23.1 | M00001528A:F09 |
| 60 | 16283 | RTA00000182AF.c.22.1 | M00001467A:D08 |
| 61 | 6974 | RTA00000183AF.d.9.1 | M00001504C:H06 |
| 62 | 2623 | RTA00000183AF.b.14.1 | M00001500A:E11 |
| 63 | 9105 | RTA00000191AF.a.21.2 | M00003983A:A05 |
| 64 | 13238 | RTA00000181AF.m.4.1 | M00001455A:E09 |
| 65 | 5749 | RTA00000185AF.a.19.1 | M00001571C:H06 |
| 66 | 6455 | RTA00000193AF.b.9.1 | M00004229B:F08 |
| 67 | 23001 | RTA00000185AF.c.24.1 | M00001578B:E04 |
| 68 | 6455 | RTA00000192AF.g.23.1 | M00004157C:A09 |
| 69 | 13595 | RTA00000189AF.f.8.1 | M00003851B:D10 |
| 70 | 39442 | RTA00000120A.o.21.1 | M00001467A:E10 |
| 71 | 17036 | RTA00000191AF.f.13.1 | M00004035D:B06 |
| 72 | | RTA00000183AF.g.9.1 | M00001513B:G03 |
| 73 | 7005 | RTA00000181AF.k.24.1 | M00001454B:C12 |
| 74 | 6268 | RTA00000126A.o.23.1 | M00001551A:B10 |
| 75 | 16130 | RTA00000119A.c.13.1 | M00001453A:E11 |
| 76 | 23201 | RTA00000187AF.a.14.1 | M00001657D:C03 |

TABLE 1-continued

Sequence identification numbers, cluster ID, sequence name, and clone name

| SEQ ID NO: | Cluster ID | Sequence Name | Clone Name |
|---|---|---|---|
| 77 | 5321 | RTA00000183AF.k.8.1 | M00001534A:F09 |
| 78 | 13157 | RTA00000186AF.a.6.1 | M00001614C:F10 |
| 79 | 2102 | RTA00000193AF.n.7.1 | M00004377C:F05 |
| 80 | 1058 | RTA00000126A.e.20.3 | M00001548A:H09 |
| 81 | 40392 | RTA00000180AF.j.8.1 | M00001429D:D07 |
| 82 |  | RTA00000183AF.e.23.1 | M00001506D:A09 |
| 83 | 11476 | RTA00000187AF.p.19.1 | M00003747D:C05 |
| 84 | 3584 | RTA00000177AF.h.20.1 | M00001349B:B08 |
| 85 | 10470 | RTA00000180AF.f.18.1 | M00001424B:G09 |
| 86 | 39425 | RTA00000133A.f.1.1 | M00001470A:C04 |
| 87 | 5175 | RTA00000184AF.f.3.1 | M00001550A:G01 |
| 88 | 13576 | RTA00000189AF.o.13.1 | M00003885C:A02 |
| 89 | 7665 | RTA00000134A.l.19.1 | M00001535A:B01 |
| 90 | 16927 | RTA00000177AF.h.9.3 | M00001348B:B04 |
| 91 | 6660 | RTA00000187AF.h.15.1 | M00001679A:A06 |
| 92 | 2433 | RTA00000191AF.a.15.2 | M00003982C:C02 |
| 93 | 5097 | RTA00000134A.k.1.1 | M00001534A:D09 |
| 94 | 21847 | RTA00000193AF.j.9.1 | M00004318C:D10 |
| 95 | 3277 | RTA00000138A.l.5.1 | M00001624A:B06 |
| 96 | 5708 | RTA00000184AF.g.12.1 | M00001552B:D04 |
| 97 | 945 | RTA00000178AR.a.20.1 | M00001362C:H11 |
| 98 | 16269 | RTA00000178AF.p.1.1 | M00001389A:C08 |
| 99 |  | RTA00000183AF.c.24.1 | M00001504A:E01 |
| 100 | 16731 | RTA00000181AF.a.20.1 | M00001442C:D07 |
| 101 | 12439 | RTA00000190AF.o.24.1 | M00003975A:G11 |
| 102 | 3162 | RTA00000177AF.j.12.3 | M00001351B:A08 |
| 103 |  | RTA00000194AF.b.19.1 | M00004505D:F08 |
| 104 |  | RTA00000193AF.n.15.1 | M00004384C:D02 |
| 105 |  | RTA00000186AF.n.7.1 | M00001651A:H01 |
| 106 | 10717 | RTA00000181AF.d.10.1 | M00001447A:G03 |
| 107 | 4573 | RTA00000189AF.j.12.1 | M00003871C:E02 |
| 108 |  | RTA00000186AF.h.14.1 | M00001632D:H07 |
| 109 | 11443 | RTA00000192AF.l.13.2 | M00004185C:C03 |
| 110 | 5892 | RTA00000184AF.d.11.1 | M00001548A:E10 |
| 111 | 3162 | RTA00000177AF.j.12.1 | M00001351B:A08 |
| 112 | 10470 | RTA00000185AF.k.6.1 | M00001597D:C05 |
| 113 | 17055 | RTA00000187AF.m.3.1 | M00001682C:B12 |
| 114 | 2030 | RTA00000193AF.m.20.1 | M00004372A:A03 |
| 115 | 6558 | RTA00000184AF.m.21.1 | M00001560D:F10 |
| 116 | 23255 | RTA00000190AF.j.4.1 | M00003922A:E06 |
| 117 | 9577 | RTA00000179AF.o.17.1 | M00001409C:D12 |
| 118 |  | RTA00000180AF.a.11.1 | M00001414C:A07 |
| 119 | 8 | RTA00000181AF.e.17.1 | M00001448D:C09 |
| 120 | 67907 | RTA00000188AF.g.11.1 | M00003774C:A03 |
| 121 | 12081 | RTA00000133A.d.14.2 | M00001469A:C10 |
| 122 | 2448 | RTA00000119A.j.21.1 | M00001460A:F06 |
| 123 | 3389 | RTA00000189AF.g.3.1 | M00003857A:G10 |
| 124 | 39174 | RTA00000124A.n.13.1 | M00001541A:H03 |
| 125 | 24488 | RTA00000190AF.n.16.1 | M00003968B:F06 |
| 126 | 8210 | RTA00000192AF.n.13.1 | M00004197D:H01 |
| 127 |  | RTA00000135A.l.2.2 | M00001545A:B02 |
| 128 | 40455 | RTA00000190AF.m.10.2 | M00003958C:G10 |
| 129 | 9577 | RTA00000180AF.d.23.1 | M00001421C:F01 |
| 130 | 13183 | RTA00000192AF.a.24.1 | M00004114C:F11 |
| 131 | 5214 | RTA00000186AF.g.11.1 | M00001630B:H09 |
| 132 | 67252 | RTA00000187AF.o.6.1 | M00001716D:H05 |
| 133 | 3108 | RTA00000188AF.d.24.1 | M00003763A:F06 |
| 134 | 2464 | RTA00000178AF.n.18.1 | M00001387A:C05 |
| 135 | 36313 | RTA00000181AF.e.23.1 | M00001448D:H01 |
| 136 | 23255 | RTA00000177AF.e.14.3 | M00001343D:H07 |
| 137 | 7985 | RTA00000182AR.j.2.1 | M00001481D:A05 |
| 138 | 8286 | RTA00000183AF.o.1.1 | M00001540A:D06 |
| 139 | 22195 | RTA00000180AF.g.7.1 | M00001425B:H08 |
| 140 | 4573 | RTA00000184AF.h.9.1 | M00001553B:F12 |
| 141 | 26875 | RTA00000187AF.i.1.1 | M00001679A:F10 |
| 142 | 7187 | RTA00000177AF.i.8.2 | M00001350A:H01 |
| 143 | 86859 | RTA00000118A.p.8.1 | M00001452A:B12 |
| 144 | 4623 | RTA00000185AF.f.4.1 | M00001586C:C05 |
| 145 |  | RTA00000121A.c.10.1 | M00001469A:A01 |
| 146 | 10185 | RTA00000183AF.d.5.1 | M00001504C:A07 |
| 147 |  | RTA00000183AF.p.4.1 | M00001542B:B01 |
| 148 | 15069 | RTA00000191AF.l.6.1 | M00004081C:D10 |
| 149 | 39304 | RTA00000118A.j.21.1 | M00001450A:A02 |
| 150 | 8672 | RTA00000190AF.f.11.1 | M00003909D:C03 |
| 151 | 13576 | RTA00000177AF.g.16.1 | M00001347A:B10 |
| 152 | 6293 | RTA00000185AF.e.11.1 | M00001583D:A10 |

TABLE 1-continued

Sequence identification numbers, cluster ID, sequence name, and clone name

| SEQ ID NO: | Cluster ID | Sequence Name | Clone Name |
|---|---|---|---|
| 153 | 16977 | RTA00000192AF.g.3.1 | M00004151D:B08 |
| 154 | 5345 | RTA00000189AF.l.19.1 | M00003879B:C11 |
| 155 | 4905 | RTA00000193AF.e.14.1 | M00004269D:D06 |
| 156 | 17036 | RTA00000191AF.j.10.1 | M00004072B:B05 |
| 157 | 5417 | RTA00000191AF.h.19.1 | M00004059A:D06 |
| 158 | 7172 | RTA00000178AF.f.9.1 | M00001371C:E09 |
| 159 | 40044 | RTA00000186AF.d.1.1 | M00001621C:C08 |
| 160 | 4386 | RTA00000184AF.j.4.1 | M00001556B:C08 |
| 161 | 40044 | RTA00000183AF.g.22.1 | M00001514C:D11 |
| 162 | 9685 | RTA00000183AF.c.11.1 | M00001501D:C02 |
| 163 | 22155 | RTA00000185AF.n.9.1 | M00001608B:E03 |
| 164 | 10515 | RTA00000189AF.f.18.1 | M00003853A:F12 |
| 165 | 6539 | RTA00000185AF.d.11.1 | M00001579D:C03 |
| 166 | 15066 | RTA00000180AF.e.24.1 | M00001423B:E07 |
| 167 | 4261 | RTA00000180AF.h.5.1 | M00001426D:C08 |
| 168 | 13864 | RTA00000125A.m.9.1 | M00001545A:D08 |
| 169 | 6539 | RTA00000189AF.d.22.1 | M00003844C:B11 |
| 170 | 11465 | RTA00000185AF.m.19.1 | M00001607A:E11 |
| 171 | 3266 | RTA00000184AR.g.1.1 | M00001551C:G09 |
| 172 | 102 | RTA00000184AF.o.5.1 | M00001563B:F06 |
| 173 | 16970 | RTA00000181AR.i.18.2 | M00001452C:B06 |
| 174 | 12971 | RTA00000193AF.a.20.1 | M00004223D:E04 |
| 175 | 5007 | RTA00000177AF.g.2.1 | M00001346A:F09 |
| 176 | 3765 | RTA00000135A.d.1.1 | M00001541A:D02 |
| 177 | 11294 | RTA00000184AF.j.6.1 | M00001556B:G02 |
| 178 | 3681 | RTA00000131A.g.15.2 | M00001449A:D12 |
| 179 | 9283 | RTA00000181AR.m.21.2 | M00001455D:F09 |
| 180 | 18699 | RTA00000182AF.m.16.1 | M00001490B:C04 |
| 181 | 86110 | RTA00000181AF.f.12.1 | M00001449C:D06 |
| 182 | 39648 | RTA00000178AR.l.8.2 | M00001383A:C03 |
| 183 | 7337 | RTA00000123A.b.17.1 | M00001528A:C04 |
| 184 | 1334 | RTA00000178AF.j.7.1 | M00001379A:A05 |
| 185 | 17076 | RTA00000188AF.d.21.1 | M00003762C:B08 |
| 186 | 22794 | RTA00000138A.b.5.1 | M00001601A:D08 |
| 187 | 39171 | RTA00000186AF.l.7.1 | M00001644C:B07 |
| 188 | 8551 | RTA00000179AF.p.21.1 | M00001412B:B10 |
| 189 | 5857 | RTA00000118A.g.14.1 | M00001449A:A12 |
| 190 | 9443 | RTA00000183AF.c.1.1 | M00001500C:E04 |
| 191 | 9457 | RTA00000193AF.i.14.2 | M00004307C:A06 |
| 192 | 7206 | RTA00000182AF.o.15.1 | M00001494D:F06 |
| 193 | 22979 | RTA00000178AF.k.22.1 | M00001382C:A02 |
| 194 | 40455 | RTA00000190AR.m.10.1 | M00003958C:G10 |
| 195 | 7221 | RTA00000191AF.p.9.1 | M00004105C:A04 |
| 196 |  | RTA00000191AF.j.9.1 | M00004072A:C03 |
| 197 | 7239 | RTA00000126A.m.4.2 | M00001550A:A03 |
| 198 | 31587 | RTA00000189AF.l.20.1 | M00003879B:D10 |
| 199 | 16317 | RTA00000190AF.e.6.1 | M00003907D:H04 |
| 200 | 13576 | RTA00000189AR.o.13.1 | M00003885C:A02 |
| 201 | 5779 | RTA00000177AF.g.14.3 | M00001346D:G06 |
| 202 | 6124 | RTA00000191AR.e.2.3 | M00004028D:A06 |
| 203 | 9952 | RTA00000180AF.c.20.1 | M00001418B:F03 |
| 204 |  | RTA00000188AF.i.8.1 | M00003784D:D12 |
| 205 | 5779 | RTA00000177AF.g.14.1 | M00001346D:G06 |
| 206 | 39490 | RTA00000128A.b.4.1 | M00001557A:F03 |
| 207 | 4416 | RTA00000187AF.h.13.1 | M00001678D:F12 |
| 208 | 4009 | RTA00000179AF.e.20.1 | M00001396A:C03 |
| 209 | 5336 | RTA00000183AF.b.13.1 | M00001500A:C05 |
| 210 | 39186 | RTA00000121A.p.15.1 | M00001512A:A09 |
| 211 | 40122 | RTA00000190AF.n.23.1 | M00003970C:B09 |
| 212 | 12532 | RTA00000190AF.g.2.1 | M00003912B:D01 |
| 213 | 8078 | RTA00000177AR.l.13.1 | M00001353A:G12 |
| 214 | 3900 | RTA00000190AF.g.13.1 | M00003914C:F05 |
| 215 | 7589 | RTA00000120A.p.23.1 | M00001468A:F05 |
| 216 | 8298 | RTA00000127A.d.19.1 | M00001553A:H06 |
| 217 | 4443 | RTA00000177AF.b.20.4 | M00001341A:E12 |
| 218 | 26295 | RTA00000193AF.i.24.2 | M00004312A:G03 |
| 219 | 3389 | RTA00000183AF.m.19.1 | M00001537B:G07 |
| 220 | 7015 | RTA00000187AF.f.18.1 | M00001673C:H02 |
| 221 | 8526 | RTA00000180AF.d.1.1 | M00001418D:B06 |
| 222 | 4665 | RTA00000186AF.m.3.1 | M00001648C:A01 |
| 223 | 1399 | RTA00000129A.o.10.1 | M00001604A:B10 |
| 224 | 9244 | RTA00000127A.l.3.1 | M00001556A:C09 |
| 225 |  | RTA00000179AF.j.13.1 | M00001400B:H06 |
| 226 | 82498 | RTA00000118A.m.10.1 | M00001450A:B12 |
| 227 | 35702 | RTA00000187AR.c.15.2 | M00001663A:E04 |
| 228 | 38759 | RTA00000120A.m.12.3 | M00001467A:B07 |

TABLE 1-continued

Sequence identification numbers, cluster ID, sequence name, and clone name

| SEQ ID NO: | Cluster ID | Sequence Name | Clone Name |
|---|---|---|---|
| 229 | 39648 | RTA00000178AF.l.8.1 | M00001383A:C03 |
| 230 | 19105 | RTA00000133A.e.15.1 | M00001469A:H12 |
| 231 | 85064 | RTA00000131A.m.23.1 | M00001452A:F05 |
| 232 | 9285 | RTA00000191AF.m.18.1 | M00004086D:G06 |
| 233 | 9285 | RTA00000190AF.d.7.1 | M00003906C:E10 |
| 234 | 39391 | RTA00000138A.c.3.1 | M00001604A:F05 |
| 235 |  | RTA00000178AF.d.20.1 | M00001368D:E03 |
| 236 | 39498 | RTA00000119A.j.20.1 | M00001460A:F12 |
| 237 | 7798 | RTA00000189AF.k.12.1 | M00003876D:E12 |
| 238 | 7798 | RTA00000189AF.c.18.1 | M00003839A:D08 |
| 239 | 19829 | RTA00000125A.h.24.4 | M00001544A:G02 |
| 240 |  | RTA00000188AF.d.11.1 | M00003761D:A09 |
| 241 | 4275 | RTA00000120A.j.14.1 | M00001466A:E07 |
| 242 | 22113 | RTA00000125A.c.7.1 | M00001542A:A09 |
| 243 | 40314 | RTA00000186AF.c.15.1 | M00001619C:F12 |
| 244 | 10944 | RTA00000126A.h.17.2 | M00001549A:D08 |
| 245 | 39809 | RTA00000190AF.e.3.1 | M00003907D:A09 |
| 246 | 22085 | RTA00000135A.e.5.2 | M00001541A:F07 |
| 247 | 19255 | RTA00000135A.m.18.1 | M00001545A:C03 |
| 248 | 14311 | RTA00000192AF.o.2.1 | M00004203B:C12 |
| 249 | 8479 | RTA00000189AF.j.22.1 | M00003875C:G07 |
| 250 |  | RTA00000189AF.j.23.1 | M00003875D:D11 |
| 251 | 4193 | RTA00000184AF.e.13.1 | M00001549B:F06 |
| 252 | 22814 | RTA00000184AF.h.14.1 | M00001553D:D10 |
| 253 | 39563 | RTA00000179AF.k.20.1 | M00001402A:E08 |
| 254 | 39420 | RTA00000134A.o.23.1 | M00001537A:F12 |
| 255 | 11589 | RTA00000177AF.b.17.4 | M00001340D:F10 |
| 256 | 4937 | RTA00000191AF.p.21.1 | M00004108A:E06 |
| 257 | 39412 | RTA00000133A.k.17.1 | M00001511A:H06 |
| 258 | 4837 | RTA00000185AR.k.3.2 | M00001597C:H02 |
| 259 | 13046 | RTA00000193AF.h.19.1 | M00004296C:H07 |
| 260 | 4141 | RTA00000177AF.p.20.3 | M00001361A:A05 |
| 261 | 38085 | RTA00000123A.e.15.1 | M00001531A:D01 |
| 262 |  | RTA00000189AF.p.8.1 | M00003891C:H09 |
| 263 | 11451 | RTA00000192AF.p.17.1 | M00004214C:H05 |
| 264 | 14507 | RTA00000189AR.l.23.2 | M00003879D:A02 |
| 265 | 40054 | RTA00000180AF.p.10.1 | M00001439C:F08 |
| 266 | 39423 | RTA00000134A.k.22.1 | M00001535A:F10 |
| 267 | 39453 | RTA00000135A.g.11.1 | M00001542A:E06 |
| 268 | 10751 | RTA00000187AF.k.7.1 | M00001679D:D03 |
| 269 | 10751 | RTA00000187AF.k.6.1 | M00001679D:D03 |
| 270 | 78091 | RTA00000187AF.j.6.1 | M00001679C:F01 |
| 271 | 39539 | RTA00000127A.i.21.1 | M00001555A:B02 |
| 272 |  | RTA00000182AF.l.15.1 | M00001487B:H06 |
| 273 |  | RTA00000194AF.d.13.1 | M00004896A:C07 |
| 274 |  | RTA00000128A.c.20.1 | M00001558A:H05 |
| 275 | 9283 | RTA00000181AR.m.22.2 | M00001455D:F09 |
| 276 | 39168 | RTA00000121A.l.10.1 | M00001507A:H05 |
| 277 | 39458 | RTA00000126A.p.15.2 | M00001552A:D11 |
| 278 | 14391 | RTA00000177AF.m.17.3 | M00001355B:G10 |
| 279 | 39195 | RTA00000137A.c.16.1 | M00001555A:C01 |
| 280 | 7212 | RTA00000193AF.b.14.1 | M00004230B:C07 |
| 281 | 4015 | RTA00000136A.e.12.1 | M00001549A:B02 |
| 282 | 12977 | RTA00000189AF.j.19.1 | M00003875B:F04 |
| 283 |  | RTA00000178AF.m.13.1 | M00001384B:A11 |
| 284 | 14391 | RTA00000191AF.l.7.1 | M00004081C:D12 |
| 285 |  | RTA00000194AF.c.23.1 | M00004691D:A05 |
| 286 |  | RTA00000181AF.b.7.1 | M00001443B:F01 |
| 287 | 8358 | RTA00000183AF.i.5.1 | M00001528B:H04 |
| 288 | 1267 | RTA00000125A.o.5.1 | M00001546A:G11 |
| 289 |  | RTA00000189AF.f.7.1 | M00003851B:D08 |
| 290 | 16347 | RTA00000184AF.e.15.1 | M00001549C:E06 |
| 291 | 7899 | RTA00000193AF.a.17.1 | M00004223B:D09 |
| 292 | 2379 | RTA00000178AF.a.6.1 | M00001361D:F08 |
| 293 | 39478 | RTA00000133A.i.5.1 | M00001471A:B01 |
| 294 | 39392 | RTA00000134A.m.16.1 | M00001536A:C08 |
| 295 | 5053 | RTA00000184AF.o.12.1 | M00001564A:B12 |
| 296 | 16999 | RTA00000185AF.k.9.1 | M00001598A:G03 |
| 297 | 39180 | RTA00000126A.n.8.2 | M00001551A:F05 |
| 298 | 1037 | RTA00000121A.f.8.1 | M00001470A:B10 |
| 299 | 6867 | RTA00000178AF.e.12.1 | M00001370A:C09 |
| 300 | 10539 | RTA00000183AF.a.24.1 | M00001499B:A11 |
| 301 | 41633 | RTA00000118A.g.16.1. | M00001449A:B12 |
| 302 | 23218 | RTA00000187AR.c.5.2 | M00001662C:A09 |
| 303 | 39380 | RTA00000129A.e.24.1 | M00001587A:B11 |
| 304 |  | RTA00000185AF.d.24.1 | M00001582D:F05 |

TABLE 1-continued

Sequence identification numbers, cluster ID, sequence name, and clone name

| SEQ ID NO: | Cluster ID | Sequence Name | Clone Name |
|---|---|---|---|
| 305 | | RTA00000177AF.o.4.3 | M00001358C:C06 |
| 306 | 6974 | RTA00000184AF.a.15.1 | M00001544B:B07 |
| 307 | | RTA00000185AF.g.11.1 | M00001590B:F03 |
| 308 | 15855 | RTA00000184AF.j.1.1 | M00001556A:H01 |
| 309 | 84328 | RTA00000118A.p.10.1 | M00001452A:B04 |
| 310 | 10145 | RTA00000120A.g.12.1 | M00001465A:B11 |
| 311 | 39805 | RTA00000177AF.c.21.3 | M00001342B:E06 |
| 312 | | RTA00000187AF.h.23.1 | M00001679A:F06 |
| 313 | 6298 | RTA00000187AR.i.10.2 | M00001679B:F01 |
| 314 | 14367 | RTA00000187AF.e.8.1 | M00001670C:H02 |
| 315 | | RTA00000193AF.c.22.1 | M00004249D:G12 |
| 316 | 16921 | RTA00000183AF.k.6.1 | M00001534A:C04 |
| 317 | 1577 | RTA00000184AF.i.23.1 | M00001556A:F11 |
| 318 | 8773 | RTA00000187AF.f.24.1 | M00001675A:C09 |
| 319 | | RTA00000194AF.a.11.1 | M00004461A:B09 |
| 320 | 39886 | RTA00000178AF.j.24.1 | M00001380D:B09 |
| 321 | 13532 | RTA00000181AF.c.4.1 | M00001445A:F05 |
| 322 | | RTA00000193AF.d.2.1 | M00004251C:G07 |
| 323 | 5257 | RTA00000192AF.f.3.1 | M00004146C:C11 |
| 324 | 9061 | RTA00000191AR.e.11.2 | M00004031A:A12 |
| 325 | 19267 | RTA00000186AF.l.12.1 | M00001645A:C12 |
| 326 | 20212 | RTA00000134A.1.22.1 | M00001535A:C06 |
| 327 | 16653 | RTA00000181AF.k.5.3 | M00001453C:F06 |
| 328 | 16985 | RTA00000177AF.h.10.1 | M00001348B:G06 |
| 329 | 12977 | RTA00000189AR.j.19.1 | M00003875B:F04 |
| 330 | 9061 | RTA00000191AR.e.11.3 | M00004031A:A12 |
| 331 | | RTA00000194AR.a.10.2 | M00004461A:B08 |
| 332 | 6468 | RTA00000187AF.d.15.1 | M00001669B:F02 |
| 333 | 16392 | RTA00000192AF.1.1.1 | M00004183C:D07 |
| 334 | 14627 | RTA00000187AF.g.23.1 | M00001677C:E10 |
| 335 | 6583 | RTA00000179AF.d.13.1 | M00001394A:F01 |
| 336 | 6806 | RTA00000177AF.g.13.3 | M00001346D:E03 |
| 337 | 9635 | RTA00000137A.e.23.4 | M00001557A:F01 |
| 338 | 689 | RTA00000181AR.1.22.1 | M00001454D:G03 |
| 339 | 4119 | RTA00000183AF.k.16.1 | M00001534C:A01 |
| 340 | 8952 | RTA00000183AF.h.15.1 | M00001518C:B11 |
| 341 | 2379 | RTA00000192AF.p.8.1 | M00004212B:C07 |
| 342 | 39486 | RTA00000128A.m.22.2 | M00001561A:C05 |
| 343 | 21877 | RTA00000189AF.b.21.1 | M00003833A:E05 |
| 344 | 6874 | RTA00000192AF.a.14.1 | M00004111D:A08 |
| 345 | 6874 | RTA00000189AF.e.9.1 | M00003846B:D06 |
| 346 | 37285 | RTA00000191AF.f.11.1 | M00004035C:A07 |
| 347 | | RTA00000193AF.j.20.1 | M00004327B:H04 |
| 348 | 7674 | RTA00000118A.g.9.1 | M00001416A:H01 |
| 349 | 2797 | RTA00000180AF.i.19.1 | M00001429A:H04 |
| 350 | | RTA00000184AF.g.22.1 | M00001552D:A01 |
| 351 | 7802 | RTA00000185AF.n.5.1 | M00001608A:B03 |
| 352 | 16921 | RTA00000193AF.h.15.1 | M00004295D:F12 |
| 353 | 11494 | RTA00000192AF.j.6.1 | M00004172C:D08 |
| 354 | 17062 | RTA00000177AF.b.8.4 | M00001340B:A06 |
| 355 | 16245 | RTA00000177AF.k.9.3 | M00001352A:E02 |
| 356 | 83103 | RTA00000119A.e.24.2 | M00001454A:A09 |
| 357 | 4309 | RTA00000186AF.e.22.1 | M00001624C:F01 |
| 358 | 13072 | RTA00000181AR.m.5.2 | M00001455B:E12 |
| 359 | 4059 | RTA00000177AF.n.18.3 | M00001357D:D11 |
| 360 | 5178 | RTA00000178AF.n.10.1 | M00001386C:B12 |
| 361 | 1120 | RTA00000118A.p.15.3 | M00001452A:D08 |
| 362 | 6420 | RTA00000183AF.d.11.1 | M00001504D:G06 |
| 363 | 13913 | RTA00000186AF.e.6.1 | M00001623D:F10 |
| 364 | | RTA00000192AF.c.2.1 | M00004121B:G01 |
| 365 | 3956 | RTA00000183AF.g.3.1 | M00001512D:G09 |
| 366 | 14364 | RTA00000183AF.g.12.1 | M00001513C:E08 |
| 367 | 6880 | RTA00000191AF.m.20.1 | M00004087D:A01 |
| 368 | 84182 | RTA00000180AF.h.19.1 | M00001428A:H10 |
| 369 | 2790 | RTA00000177AF.e.2.1 | M00001343C:F10 |
| 370 | 4561 | RTA00000184AF.i.21.1 | M00001555D:G10 |
| 371 | 8847 | RTA00000180AF.b.16.1 | M00001416B:H11 |
| 372 | 56020 | RTA00000193AF.g.2.1 | M00004285B:E08 |
| 373 | 1531 | RTA00000119A.o.3.1 | M00001461A:D06 |
| 374 | 6420 | RTA00000177AF.f.10.3 | M00001345A:E01 |
| 375 | | RTA00000188AF.b.12.1 | M00003754C:E09 |
| 376 | | RTA00000180AF.k.24.1 | M00001432C:F06 |
| 377 | | RTA00000184AF.a.8.1 | M00001544A:E06 |
| 378 | 2696 | RTA00000134A.m.13.1 | M00001536A:B07 |
| 379 | 260 | RTA00000185AR.i.12.2 | M00001594B:H04 |
| 380 | 11350 | RTA00000189AF.a.24.2 | M00003826B:A06 |

TABLE 1-continued

Sequence identification numbers, cluster ID, sequence name, and clone name

| SEQ ID NO: | Cluster ID | Sequence Name | Clone Name |
|---|---|---|---|
| 381 | 2428 | RTA00000123A.l.21.1 | M00001533A:C11 |
| 382 | 4313 | RTA00000122A.n.3.1 | M00001517A:B07 |
| 383 | | RTA00000184AF.p.3.1 | M00001566B:D11 |
| 384 | 697 | RTA00000188AF.d.6.1 | M00003759B:B09 |
| 385 | 5619 | RTA00000188AF.l.9.1 | M00003796C:D05 |
| 386 | 4568 | RTA00000122A.d.15.3 | M00001513A:B06 |
| 387 | | RTA00000177AF.i.6.2 | M00001350A:B08 |
| 388 | 5622 | RTA00000178AF.a.11.1 | M00001362B:D10 |
| 389 | 7514 | RTA00000184AF.k.21.1 | M00001558B:H11 |
| 390 | 5619 | RTA00000189AF.f.17.1 | M00003853A:D04 |
| 391 | 7570 | RTA00000187AF.g.24.1 | M00001677D:A07 |
| 392 | 23358 | RTA00000190AF.o.21.1 | M00003974D:H02 |
| 393 | 23210 | RTA00000190AF.o.20.1 | M00003974D:E07 |
| 394 | 5192 | RTA00000184AF.k.2.1 | M00001557B:H10 |
| 395 | 13538 | RTA00000180AF.a.24.1 | M00001415A:H06 |
| 396 | | RTA00000189AF.h.17.1 | M00003867A:D10 |
| 397 | | RTA00000192AF.o.11.1 | M00004205D:F06 |
| 398 | | RTA00000184AF.l.11.1 | M00001559B:F01 |
| 399 | 4718 | RTA00000189AF.g.5.1 | M00003857A:H03 |
| 400 | 14929 | RTA00000177AF.m.1.2 | M00001353D:D10 |
| 401 | 4908 | RTA00000192AF.j.2.1 | M00004171B:B03 |
| 402 | | RTA00000178AF.k.16.1 | M00001381D:E06 |
| 403 | | RTA00000194AF.c.24.1 | M00004692B:H08 |
| 404 | 17732 | RTA00000178AR.i.2.2 | M00001376B:G06 |
| 405 | 17062 | 80.A1.sp6:130208.Seq | M00001340B:A06 |
| 406 | 11589 | 80.B1.sp6:130220.Seq | M00001340D:F10 |
| 407 | 4443 | 80.C1.sp6:130232.Seq | M00001341A:E12 |
| 408 | 39805 | 80.D1.sp6:130244.Seq | M00001342B:E06 |
| 409 | 2790 | 80.E1.sp6:130256.Seq | M00001343C:F10 |
| 410 | 23255 | 80.F1.sp6:130268.Seq | M00001343D:H07 |
| 411 | 6420 | 80.G1.sp6:130280.Seq | M00001345A:E01 |
| 412 | 5007 | 80.H1.sp6:130292.Seq | M00001346A:F09 |
| 413 | 13576 | 80.D2.sp6:130245.Seq | M00001347A:B10 |
| 414 | 16927 | 80.E2.sp6:130257.Seq | M00001348B:B04 |
| 415 | 16985 | 80.F2.sp6:130269.Seq | M00001348B:G06 |
| 416 | 3584 | 80.G2.sp6:130281.Seq | M00001349B:B08 |
| 417 | | 80.H2.sp6:130293.Seq | M00001350A:B08 |
| 418 | 7187 | 80.A3.sp6:130210.Seq | M00001350A:H01 |
| 419 | 16245 | 80.D3.sp6:130246.Seq | M00001352A:E02 |
| 420 | 8078 | 80.E3.sp6:130258.Seq | M00001353A:G12 |
| 421 | 14929 | 80.F3.sp6:130270.Seq | M00001353D:D10 |
| 422 | 14391 | 80.G3.sp6:130282.Seq | M00001355B:G10 |
| 423 | 4141 | 80.B4.sp6:130223.Seq | M00001361A:A05 |
| 424 | 2379 | 80.C4.sp6:130235.Seq | M00001361D:F08 |
| 425 | 5622 | 80.D4.sp6:130247.Seq | M00001362B:D10 |
| 426 | 945 | 80.E4.sp6:130259.Seq | M00001362C:H11 |
| 427 | 40132 | 80.F4.sp6:130271.Seq | M00001365C:C10 |
| 428 | | 80.G4.sp6:130283.Seq | M00001368D:E03 |
| 429 | 6867 | 80.H4.sp6:130295.Seq | M00001370A:C09 |
| 430 | 7172 | 80.A5.sp6:130212.Seq | M00001371C:E09 |
| 431 | 17732 | 80.B5.sp6:130224.Seq | M00001376B:G06 |
| 432 | 39833 | 80.C5.sp6:130236.Seq | M00001378B:B02 |
| 433 | 1334 | 80.D5.sp6:130248.Seq | M00001379A:A05 |
| 434 | 39886 | 80.E5.sp6:130260.Seq | M00001380D:B09 |
| 435 | | 80.F5.sp6:130272.Seq | M00001381D:E06 |
| 436 | 22979 | 80.G5.sp6:130284.Seq | M00001382C:A02 |
| 437 | 39648 | 80.H5.sp6:130296.Seq | M00001383A:C03 |
| 438 | | 80.B6.sp6:130225.Seq | M00001384B:A11 |
| 439 | 5178 | 80.C6.sp6:130237.Seq | M00001386C:B12 |
| 440 | 2464 | 80.D6.sp6:130249.Seq | M00001387A:C05 |
| 441 | 7587 | 80.E6.sp6:130261.Seq | M00001387B:G03 |
| 442 | 5832 | 80.F6.sp6:130273.Seq | M00001388D:G05 |
| 443 | 16269 | 80.G6.sp6:130285.Seq | M00001389A:C08 |
| 444 | 6583 | 80.H6.sp6:130297.Seq | M00001394A:F01 |
| 445 | 4009 | 80.A7.sp6:130214.Seq | M00001396A:C03 |
| 446 | | 80.B7.sp6:130226.Seq | M00001400B:H06 |
| 447 | 39563 | 80.C7.sp6:130238.Seq | M00001402A:E08 |
| 448 | 5556 | 80.D7.sp6:130250.Seq | M00001407B:D11 |
| 449 | 9577 | 80.E7.sp6:130262.Seq | M00001409C:D12 |
| 450 | 7005 | 80.F7.sp6:130274.Seq | M00001410A:D07 |
| 451 | 8551 | 80.G7.sp6:130286.Seq | M00001412B:B10 |
| 452 | | 80.H7.sp6:130298.Seq | M00001414A:B01 |
| 453 | | 80.A8.sp6:130215.Seq | M00001414C:A07 |
| 454 | 13538 | 80.B8.sp6:130227.Seq | M00001415A:H06 |
| 455 | 8847 | 80.C8.sp6:130239.Seq | M00001416B:H11 |
| 456 | 36393 | 80.D8.sp6:130251.Seq | M00001417A:E02 |

TABLE 1-continued

Sequence identification numbers, cluster ID, sequence name, and clone name

| SEQ ID NO: | Cluster ID | Sequence Name | Clone Name |
|---|---|---|---|
| 457 | 9952 | 80.E8.sp6:130263.Seq | M00001418B:F03 |
| 458 | 9577 | 80.G8.sp6:130287.Seq | M00001421C:F01 |
| 459 | 15066 | 80.H8.sp6:130299.Seq | M00001423B:E07 |
| 460 | 10470 | 80.A9.sp6:130216.Seq | M00001424B:G09 |
| 461 | 22195 | 80.B9.sp6:130228.Seq | M00001425B:H08 |
| 462 | | 80.C9.sp6:130240.Seq | M00001426B:D12 |
| 463 | 4261 | 80.D9.sp6:130252.Seq | M00001426D:C08 |
| 464 | 84182 | 80.E9.sp6:130264.Seq | M00001428A:H10 |
| 465 | 40392 | 80.H9.sp6:130300.Seq | M00001429D:D07 |
| 466 | 16731 | 80.C10.sp6:130241.Seq | M00001442C:D07 |
| 467 | | 80.D10.sp6:130253.Seq | M00001443B:F01 |
| 468 | 13532 | 80.E10.sp6:130265.Seq | M00001445A:F05 |
| 469 | 8 | 80.H10.sp6:130301.Seq | M00001448D:C09 |
| 470 | 36313 | 80.A11.sp6:130218.Seq | M00001448D:H01 |
| 471 | 5857 | 80.B11.sp6:130230.Seq | M00001449A:A12 |
| 472 | 41633 | 80.C11.sp6:130242.Seq | M00001449A:B12 |
| 473 | 36535 | 80.D11.sp6:130254.Seq | M00001449A:G10 |
| 474 | 86110 | 80.E11.sp6:130266.Seq | M00001449C:D06 |
| 475 | 32663 | 80.F11.sp6:130278.Seq | M00001450A:A11 |
| 476 | 27250 | 80.G11.sp6:130290.Seq | M00001450A:D08 |
| 477 | 16970 | 80.H11.sp6:130302.Seq | M00001452C:B06 |
| 478 | 16130 | 80.A12.sp6:130219.Seq | M00001453A:E11 |
| 479 | 16653 | 80.B12.sp6:130231.Seq | M00001453C:F06 |
| 480 | 7005 | 80.C12.sp6:130243.Seq | M00001454B:C12 |
| 481 | 13072 | 80.F12.sp6:130279.Seq | M00001455B:E12 |
| 482 | 9283 | 80.G12.sp6:130291.Seq | M00001455D:F09 |
| 483 | 23255 | 100.C1.sp6:131446.Seq | M00001343D:H07 |
| 484 | 13576 | 100.E1.sp6:131470.Seq | M00001347A:B10 |
| 485 | 7187 | 100.C2.sp6:131447.Seq | M00001350A:H01 |
| 486 | 14391 | 100.E3.sp6:131472.Seq | M00001355B:G10 |
| 487 | 945 | 100.E4.sp6:131473.Seq | M00001362G:H11 |
| 488 | 7172 | 100.A5.sp6:131426.Seq | M00001371C:E09 |
| 489 | 39648 | 100.A6.sp6:131427.Seq | M00001383A:C03 |
| 490 | 84182 | 100.G9.sp6:131502.Seq | M00001428A:H10 |
| 491 | 8 | 100.B11.sp6:131444.Seq | M00001448D:C09 |
| 492 | 36535 | 100.D11.sp6:131468.Seq | M00001449A:G10 |
| 493 | 82498 | 100.F11.sp6:131492.Seq | M00001450A:B12 |
| 494 | 16970 | 100.C12.sp6:131457.Seq | M00001452C:B06 |
| 495 | 16130 | 100.D12.sp6:131469.Seq | M00001453A:E11 |
| 496 | 7005 | 121.D1.sp6:131917.Seq | M00001454B:C12 |
| 497 | | 121.G6.sp6:131958.Seq | M00001506D:A09 |
| 498 | 18957 | 121.F7.sp6:131947.Seq | M00001528A:F09 |
| 499 | 40044 | 122.E1.sp6:132121.Seq | M00001621C:C08 |
| 500 | 5214 | 122.C2.sp6:132098.Seq | M00001630B:H09 |
| 501 | 6660 | 122.B5.sp6:132089.Seq | M00001679A:A06 |
| 502 | 13183 | 123.D5.sp6:132305.Seq | M00004114C:F11 |
| 503 | 6455 | 123.E7.sp6:132319.Seq | M00004157C:A09 |
| 504 | 5319 | 123.F7.sp6:132331.Seq | M00004169C:C12 |
| 505 | 11443 | 123.A8.sp6:132272.Seq | M00004185C:C03 |
| 506 | | 123.C8.sp6:132296.Seq | M00004191D:B11 |
| 507 | 8210 | 123.E8.sp6:132320.Seq | M00004197D:H01 |
| 508 | 9457 | 123.D11.sp6:132311.Seq | M00004307C:A06 |
| 509 | 6420 | 172.E1.sp6:133925.Seq | M00001345A:E01 |
| 510 | 16245 | 172.D2.sp6:133914.Seq | M00001352A:E02 |
| 511 | 8078 | 172.C3.sp6:133903.Seq | M00001353A:G12 |
| 512 | 14929 | 172.D3.sp6:133915.Seq | M00001353D:D10 |
| 513 | 14391 | 172.H3.sp6:133963.Seq | M00001355B:G10 |
| 514 | 6583 | 172.B8.sp6:133896.Seq | M00001394A:F01 |
| 515 | 4009 | 172.D8.sp6:133920.Seq | M00001396A:C03 |
| 516 | | 172.B9.sp6:133897.Seq | M00001400B:H06 |
| 517 | | 176.A3.sp6:134514.Seq | M00001632B:H07 |
| 518 | 19267 | 176.G3.sp6:134586.Seq | M00001645A:C12 |
| 519 | 78091 | 176.G5.sp6:134588.Seq | M00001679C:F01 |
| 520 | 17055 | 176.D6.sp6:134553.Seq | M00001682C:B12 |
| 521 | 6539 | 176.D9.sp6:134556.Seq | M00003844C:B11 |
| 522 | | 177.H4.sp6:134791.Seq | M00004121B:G01 |
| 523 | 5257 | 177.F5.sp6:134768.Seq | M00004146C:C11 |
| 524 | 11494 | 177.E6.sp6:134757.Seq | M00004172C:D08 |
| 525 | | 177.G7.sp6:134782.Seq | M00004205D:F06 |
| 526 | 11451 | 177.D8.sp6:134747.Seq | M00004214C:H05 |
| 527 | 9283 | 173.D2.SP6:134106.Seq | M00001455D:F09 |
| 528 | 16283 | 173.F3.SP6:134131.Seq | M00001467A:D08 |
| 529 | 10539 | 173.B5.SP6:134085.Seq | M00001499B:A11 |
| 530 | 6420 | 173.F5.SP6:134133.Seq | M00001504D:G06 |
| 531 | 3956 | 173.H5.SP6:134157.Seq | M00001512D:G09 |
| 532 | | 173.G7.SP6:134147.Seq | M00001544A:E06 |

TABLE 1-continued

Sequence identification numbers, cluster ID, sequence name, and clone name

| SEQ ID NO: | Cluster ID | Sequence Name | Clone Name |
|---|---|---|---|
| 533 | 1577 | 173.C9.SP6:134101.Seq | M00001556A:F11 |
| 534 | 9635 | 173.D9.SP6:134113.Seq | M00001557A:F01 |
| 535 | 5192 | 173.E9.SP6:134125.Seq | M00001557B:H10 |
| 536 | 6539 | 173.A12.SP6:134080.Seq | M00001579D:C03 |
| 537 | 945 | 180.C2.sp6:135940.Seq | M00001362C:H11 |
| 538 | 7005 | 180.H5.sp6:136003.Seq | M00001410A:D07 |
| 539 | 39304 | 180.G9.sp6:135995.Seq | M00001450A:A02 |
| 540 | 27250 | 180.B10.sp6:135936.Seq | M00001450A:D08 |
| 541 | 35555 | 184.A5.sp6:135530.Seq | M00001528A:C04 |
| 542 | 19255 | 184.B10.sp6:135547.Seq | M00001545A:C03 |
| 543 | 6268 | 184.C12.sp6:135561.Seq | M00001551A:B10 |
| 544 | 3277 | 217.E1.sp6:139406.Seq | M00001624A:B06 |
| 545 | 39171 | 217.A12.sp6:139369.Seq | M00001644C:B07 |
| 546 | 11460 | 219.F2.sp6:139035.Seq | M00001676B:F05 |
| 547 | 10539 | 219.F6.sp6:139039.Seq | M00001680D:F08 |
| 548 | 11476 | 219.H8.sp6:139065.Seq | M00003747D:C05 |
| 549 | 4016 | 79.A1.sp6:130016.Seq | M00001395A:C03 |
| 550 | 7674 | 79.C1.sp6:130040.Seq | M00001416A:H01 |
| 551 | 3681 | 79.E1.sp6:130064.Seq | M00001449A:D12 |
| 552 | 39304 | 79.F1.sp6:130076.Seq | M00001450A:A02 |
| 553 | 82498 | 79.G1.sp6:130088.Seq | M00001450A:B12 |
| 554 | 84328 | 79.A2.sp6:130017.Seq | M00001452A:B04 |
| 555 | 86859 | 79.B2.sp6:130029.Seq | M00001452A:B12 |
| 556 | 1120 | 79.C2.sp6:130041.Seq | M00001452A:D08 |
| 557 | 85064 | 79.D2.sp6:130053.Seq | M00001452A:F05 |
| 558 | 83103 | 79.G2.sp6:130089.Seq | M00001454A:A09 |
| 559 | 10145 | 79.F3.sp6:130078.Seq | M00001465A:B11 |
| 560 | 16283 | 79.H3.sp6:130102.Seq | M00001467A:D08 |
| 561 | 4568 | 79.D4.sp6:130055.Seq | M00001513A:B06 |
| 562 | 4313 | 79.F4.sp6:130079.Seq | M00001517A:B07 |
| 563 | 2428 | 79.A5.sp6:130020.Seq | M00001533A:C11 |
| 564 | 39423 | 79.C5.sp6:130044.Seq | M00001535A:F10 |
| 565 | 39174 | 79.E5.sp6:130068.Seq | M00001541A:H03 |
| 566 | 22113 | 79.F5.sp6:130080.Seq | M00001542A:A09 |
| 567 | 19829 | 79.H5.sp6:130104.Seq | M00001544A:G02 |
| 568 | 13864 | 79.B6.sp6:130033.Seq | M00001545A:D08 |
| 569 | 1058 | 79.F6.sp6:130081.Seq | M00001548A:H09 |
| 570 | 4015 | 79.G6.sp6:130093.Seq | M00001549A:B02 |
| 571 | 39180 | 79.A7.sp6:130022.Seq | M00001551A:F05 |
| 572 | 307 | 79.C7.sp6:130046.Seq | M00001552A:B12 |
| 573 | 39458 | 79.D7.sp6:130058.Seq | M00001552A:D11 |
| 574 | 39490 | 79.G7.sp6:130094.Seq | M00001557A:F03 |
| 575 | 39486 | 79.B8.sp6:130035.Seq | M00001561A:C05 |
| 576 | 39380 | 79.E8.sp6:130071.Seq | M00001587A:B11 |
| 577 | 1399 | 79.G8.sp6:130095.Seq | M00001604A:B10 |
| 578 | 39391 | 79.A9.sp6:130024.Seq | M00001604A:F05 |
| 579 | 6268 | 79.G9.sp6:130096.Seq | M00001551A:B10 |
| 580 |  | 377.F4.sp6:141957.Seq | M00004692A:H08 |
| 581 | 2448 | 89.A1.sp6:130667.Seq | M00001460A:F06 |
| 582 | 1531 | 89.C1.sp6:130691.Seq | M00001461A:D06 |
| 583 | 19 | 89.D1.sp6:130703.Seq | M00001463C:B11 |
| 584 | 38759 | 89.F1.sp6:130727.Seq | M00001467A:B07 |
| 585 | 39508 | 89.G1.sp6:130739.Seq | M00001467A:D04 |
| 586 | 16283 | 89.H1.sp6:130751.Seq | M00001467A:D08 |
| 587 | 39442 | 89.A2.sp6:130668.Seq | M00001467A:E10 |
| 588 | 7589 | 89.B2.sp6:130680.Seq | M00001468A:F05 |
| 589 |  | 89.C2.sp6:130692.Seq | M00001469A:A01 |
| 590 | 12081 | 89.D2.sp6:130704.Seq | M00001469A:C10 |
| 591 | 19105 | 89.E2.sp6:130716.Seq | M00001469A:H12 |
| 592 | 1037 | 89.F2.sp6:130728.Seq | M00001470A:B10 |
| 593 | 39425 | 89.G2.sp6:130740.Seq | M00001470A:C04 |
| 594 | 39478 | 89.H2.sp6:130752.Seq | M00001471A:B01 |
| 595 |  | 89.B3.sp6:130681.Seq | M00001487B:H06 |
| 596 |  | 89.C3.sp6:130693.Seq | M00001488B:F12 |
| 597 | 18699 | 89.D3.sp6:130705.Seq | M00001490B:C04 |
| 598 | 7206 | 89.E3.sp6:130717.Seq | M00001494D:F06 |
| 599 | 2623 | 89.F3.sp6:130729.Seq | M00001497A:G02 |
| 600 | 10539 | 89.G3.sp6:130741.Seq | M00001499B:A11 |
| 601 | 5336 | 89.H3.sp6:130753.Seq | M00001500A:C05 |
| 602 | 2623 | 89.A4.sp6:130670.Seq | M00001500A:E11 |
| 603 | 9443 | 89.B4.sp6:130682.Seq | M00001500C:E04 |
| 604 | 9685 | 89.C4.sp6:130694.Seq | M00001501D:C02 |
| 605 |  | 89.D4.sp6:130706.Seq | M00001504A:E01 |
| 606 | 10185 | 89.E4.sp6:130718.Seq | M00001504C:A07 |
| 607 | 6974 | 89.F4.sp6:130730.Seq | M00001504C:H06 |
| 608 | 6420 | 89.G4.sp6:130742.Seq | M00001504D:G06 |

TABLE 1-continued

Sequence identification numbers, cluster ID, sequence name, and clone name

| SEQ ID NO: | Cluster ID | Sequence Name | Clone Name |
|---|---|---|---|
| 609 | | 89.H4.sp6:130754.Seq | M00001505C:C05 |
| 610 | | 89.A5.sp6:130671.Seq | M00001506D:A09 |
| 611 | 39168 | 89.B5.sp6:130683.Seq | M00001507A:H05 |
| 612 | 39412 | 89.C5.sp6:130695.Seq | M00001511A:H06 |
| 613 | 39186 | 89.D5.sp6:130707.Seq | M00001512A:A09 |
| 614 | 3956 | 89.E5.sp6:130719.Seq | M00001512D:G09 |
| 615 | | 89.F5.sp6:130731.Seq | M00001513B:G03 |
| 616 | 14364 | 89.G5.sp6:130743.Seq | M00001513C:E08 |
| 617 | 40044 | 89.H5.sp6:130755.Seq | M00001514C:D11 |
| 618 | 8952 | 89.A6.sp6:130672.Seq | M00001518C:B11 |
| 619 | 35555 | 89.B6.sp6:130684.Seq | M00001528A:C04 |
| 620 | 18957 | 89.C6.sp6:130696.Seq | M00001528A:F09 |
| 621 | 8358 | 89.D6.sp6:130708.Seq | M00001528B:H04 |
| 622 | 38085 | 89.E6.sp6:130720.Seq | M00001531A:D01 |
| 623 | | 89.F6.sp6:130732.Seq | M00001531A:H11 |
| 624 | 3990 | 89.G6.sp6:130744.Seq | M00001532B:A06 |
| 625 | 16921 | 89.H6.sp6:130756.Seq | M00001534A:C04 |
| 626 | 5321 | 89.B7.sp6:130685.Seq | M00001534A:F09 |
| 627 | 4119 | 89.C7.sp6:130697.Seq | M00001534C:A01 |
| 628 | 20212 | 89.E7.sp6:130721.Seq | M00001535A:C06 |
| 629 | 2696 | 89.F7.sp6:130733.Seq | M00001536A:B07 |
| 630 | 39392 | 89.G7.sp6:130745.Seq | M00001536A:C08 |
| 631 | 39420 | 89.H7.sp6:130757.Seq | M00001537A:F12 |
| 632 | 3389 | 89.A8.sp6:130674.Seq | M00001537B:G07 |
| 633 | 8286 | 89.B8.sp6:130686.Seq | M00001540A:D06 |
| 634 | 3765 | 89.C8.sp6:130698.Seq | M00001541A:D02 |
| 635 | 39453 | 89.E8.sp6:130722.Seq | M00001542A:E06 |
| 636 | | 89.F8.sp6:130734.Seq | M00001542B:B01 |
| 637 | | 89.H8.sp6:130758.Seq | M00001544A:E06 |
| 638 | 6974 | 89.A9.sp6:130675.Seq | M00001544B:B07 |
| 639 | | 89.B9.sp6:130687.Seq | M00001545A:B02 |
| 640 | 19255 | 89.C9.sp6:130699.Seq | M00001545A:C03 |
| 641 | 1267 | 89.D9.sp6:130711.Seq | M00001546A:G11 |
| 642 | 5892 | 89.E9.sp6:130723.Seq | M00001548A:E10 |
| 643 | 4193 | 89.G9.sp6:130747.Seq | M00001549B:F06 |
| 644 | 16347 | 89.H9.sp6:130759.Seq | M00001549C:E06 |
| 645 | 7239 | 89.A10.sp6:130676.Seq | M00001550A:A03 |
| 646 | 5175 | 89.B10.sp6:130688.Seq | M00001550A:G01 |
| 647 | 22390 | 89.C10.sp6:130700.Seq | M00001551A:G06 |
| 648 | 3266 | 89.D10.sp6:130712.Seq | M00001551C:G09 |
| 649 | 5708 | 89.E10.sp6:130724.Seq | M00001552B:D04 |
| 650 | | 89.F10.sp6:130736.Seq | M00001552D:A01 |
| 651 | 8298 | 89.G10.sp6:130748.Seq | M00001553A:H06 |
| 652 | 4573 | 89.H10.sp6:130760.Seq | M00001553B:F12 |
| 653 | 22814 | 89.A11.sp6:130677.Seq | M00001553D:D10 |
| 654 | 39539 | 89.B11.sp6:130689.Seq | M00001555A:B02 |
| 655 | 39195 | 89.C11.sp6:130701.Seq | M00001555A:C01 |
| 656 | 4561 | 89.D11.sp6:130713.Seq | M00001555D:G10 |
| 657 | 9244 | 89.E11.sp6:130725.Seq | M00001556A:C09 |
| 658 | 1577 | 89.F11.sp6:130737.Seq | M00001556A:F11 |
| 659 | 4386 | 89.H11.sp6:130761.Seq | M00001556B:C08 |
| 660 | 11294 | 89.A12.sp6:130678.Seq | M00001556B:G02 |
| 661 | 5192 | 89.D12.sp6:130714.Seq | M00001557B:H10 |
| 662 | 8761 | 89.E12.sp6:130726.Seq | M00001557D:D09 |
| 663 | | 89.F12.sp6:130738.Seq | M00001558A:H05 |
| 664 | 7514 | 89.G12.sp6:130750.Seq | M00001558B:H11 |
| 665 | | 89.H12.sp6:130762.Seq | M00001559B:F01 |
| 666 | 6558 | 90.A1.sp6:130859.Seq | M00001560D:F10 |
| 667 | 102 | 90.B1.sp6:130871.Seq | M00001563B:F06 |
| 668 | | 90.D1.sp6:130895.Seq | M00001566B:D11 |
| 669 | 5749 | 90.E1.sp6:130907.Seq | M00001571C:H06 |
| 670 | 6539 | 90.G1.sp6:130931.Seq | M00001579D:C03 |
| 671 | 6293 | 90.A2.sp6:130860.Seq | M00001583D:A10 |
| 672 | | 90.C2.sp6:130884.Seq | M00001590B:F03 |
| 673 | 260 | 90.D2.sp6:130896.Seq | M00001594B:H04 |
| 674 | 4837 | 90.E2.sp6:130908.Seq | M00001597C:H02 |
| 675 | 10470 | 90.F2.sp6:130920.Seq | M00001597D:C05 |
| 676 | 16999 | 90.G2.sp6:130932.Seq | M00001598A:G03 |
| 677 | 22794 | 90.H2.sp6:130944.Seq | M00001601A:D08 |
| 678 | 11465 | 90.A3.sp6:130861.Seq | M00001607A:E11 |
| 679 | 7802 | 90.B3.sp6:130873.Seq | M00001608A:B03 |
| 680 | 22155 | 90.C3.sp6:130885.Seq | M00001608B:E03 |
| 681 | | 90.D3.sp6:130897.Seq | M00001608D:A11 |
| 682 | 13157 | 90.E3.sp6:130909.Seq | M00001614C:F10 |
| 683 | 17004 | 90.F3.sp6:130921.Seq | M00001617C:E02 |
| 684 | 40314 | 90.G3.sp6:130933.Seq | M00001619C:F12 |

TABLE 1-continued

Sequence identification numbers, cluster ID, sequence name, and clone name

| SEQ ID NO: | Cluster ID | Sequence Name | Clone Name |
|---|---|---|---|
| 685 | 40044 | 90.H3.sp6:130945.Seq | M00001621C:C08 |
| 686 | 13913 | 90.A4.sp6:130862.Seq | M00001623D:F10 |
| 687 | 3277 | 90.B4.sp6:130874.Seq | M00001624A:B06 |
| 688 | 4309 | 90.C4.sp6:130886.Seq | M00001624C:F01 |
| 689 | 5214 | 90.D4.sp6:130898.Seq | M00001630B:H09 |
| 690 |  | 90.E4.sp6:130910.Seq | M00001632D:H07 |
| 691 | 39171 | 90.F4.sp6:130922.Seq | M00001644C:B07 |
| 692 | 19267 | 90.G4.sp6:130934.Seq | M00001645A:C12 |
| 693 | 4665 | 90.H4.sp6:130946.Seq | M00001648C:A01 |
| 694 |  | 90.A5.sp6:130863.Seq | M00001651A:H01 |
| 695 | 23201 | 90.B5.sp6:130875.Seq | M00001657D:C03 |
| 696 | 76760 | 90.C5.sp6:130887.Seq | M00001657D:F08 |
| 697 | 23218 | 90.D5.sp6:130899.Seq | M00001662C:A09 |
| 698 | 35702 | 90.E5.sp6:130911.Seq | M00001663A:E04 |
| 699 | 6468 | 90.F5.sp6:130923.Seq | M00001669B:F02 |
| 700 | 14367 | 90.G5.sp6:130935.Seq | M00001670C:H02 |
| 701 | 7015 | 90.H5.sp6:130947.Seq | M00001673C:H02 |
| 702 | 8773 | 90.A6.sp6:130864.Seq | M00001675A:C09 |
| 703 | 11460 | 90.B6.sp6:130876.Seq | M00001676B:F05 |
| 704 | 7570 | 90.D6.sp6:130900.Seq | M00001677D:A07 |
| 705 | 4416 | 90.E6.sp6:130912.Seq | M00001678D:F12 |
| 706 | 6660 | 90.F6.sp6:130924.Seq | M00001679A:A06 |
| 707 |  | 90.H6.sp6:130948.Seq | M00001679A:F06 |
| 708 | 26875 | 90.A7.sp6:130865.Seq | M00001679A:F10 |
| 709 | 6298 | 90.B7.sp6:130877.Seq | M00001679B:F01 |
| 710 | 78091 | 90.C7.sp6:130889.Seq | M00001679C:F01 |
| 711 | 10751 | 90.D7.sp6:130901.Seq | M00001679D:D03 |
| 712 | 10539 | 90.F7.sp6:130925.Seq | M00001680D:F08 |
| 713 | 17055 | 90.G7.sp6:130937.Seq | M00001682C:B12 |
| 714 | 5382 | 90.A8.sp6:130866.Seq | M00001688C:F09 |
| 715 | 4393 | 90.B8.sp6:130878.Seq | M00001693C:G01 |
| 716 | 67252 | 90.C8.sp6:130890.Seq | M00001716D:H05 |
| 717 | 40108 | 90.D8.sp6:130902.Seq | M00003741D:C09 |
| 718 | 11476 | 90.E8.sp6:130914.Seq | M00003747D:C05 |
| 719 |  | 90.F8.sp6:130926.Seq | M00003754C:E09 |
| 720 | 697 | 90.G8.sp6:130938.Seq | M00003759B:B09 |
| 721 |  | 90.H8.sp6:130950.Seq | M00003761D:A09 |
| 722 | 17076 | 90.A9.sp6:130867.Seq | M00003762C:B08 |
| 723 | 3108 | 90.B9.sp6:130879.Seq | M00003763A:F06 |
| 724 | 67907 | 90.C9.sp6:130891.Seq | M00003774C:A03 |
| 725 |  | 90.D9.sp6:130903.Seq | M00003784D:D12 |
| 726 | 11350 | 90.F9.sp6:130927.Seq | M00003826B:A06 |
| 727 | 7899 | 90.H9.sp6:130951.Seq | M00003837D:A01 |
| 728 | 7798 | 90.A10.sp6:130868.Seq | M00003839A:D08 |
| 729 | 6539 | 90.B10.sp6:130880.Seq | M00003844C:B11 |
| 730 | 6874 | 90.C10.sp6:130892.Seq | M00003846B:D06 |
| 731 |  | 90.D10.sp6:130904.Seq | M00003851B:D08 |
| 732 | 13595 | 90.E10.sp6:130916.Seq | M00003851B:D10 |
| 733 | 5619 | 90.F10.sp6:130928.Seq | M00003853A:D04 |
| 734 | 10515 | 90.G10.sp6:130940.Seq | M00003853A:F12 |
| 735 | 4622 | 90.H10.sp6:130952.Seq | M00003856B:C02 |
| 736 | 3389 | 90.A11.sp6:130869.Seq | M00003857A:G10 |
| 737 | 4718 | 90.B11.sp6:130881.Seq | M00003857A:H03 |
| 738 |  | 90.C11.sp6:130893.Seq | M00003867A:D10 |
| 739 | 12977 | 90.F11.sp6:130929.Seq | M00003875B:F04 |
| 740 | 8479 | 90.G11.sp6:130941.Seq | M00003875C:G07 |
| 741 |  | 90.H11.sp6:130953.Seq | M00003875D:D11 |
| 742 | 7798 | 90.A12.sp6:130870.Seq | M00003876D:E12 |
| 743 | 5345 | 90.B12.sp6:130882.Seq | M00003879B:C11 |
| 744 | 31587 | 90.C12.sp6:130894.Seq | M00003879B:D10 |
| 745 | 14507 | 90.D12.sp6:130906.Seq | M00003879D:A02 |
| 746 | 13576 | 90.F12.sp6:130930.Seq | M00003885C:A02 |
| 747 |  | 90.G12.sp6:130942.Seq | M00003891C:H09 |
| 748 | 9285 | 90.H12.sp6:130954.Seq | M00003906C:E10 |
| 749 | 39809 | 99.A1.sp6:131230.Seq | M00003907D:A09 |
| 750 | 16317 | 99.B1.sp6:131242.Seq | M00003907D:H04 |
| 751 | 8672 | 99.C1.sp6:131254.Seq | M00003909D:C03 |
| 752 | 12532 | 99.D1.sp6:131266.Seq | M00003912B:D01 |
| 753 | 3900 | 99.E1.sp6:131278.Seq | M00003914C:F05 |
| 754 | 23255 | 99.F1.sp6:131290.Seq | M00003922A:E06 |
| 755 | 24488 | 99.C2.sp6:131255.Seq | M00003968B:F06 |
| 756 | 40122 | 99.D2.sp6:131267.Seq | M00003970C:B09 |
| 757 | 23210 | 99.E2.sp6:131279.Seq | M00003974D:E07 |
| 758 | 23358 | 99.F2.sp6:131291.Seq | M00003974D:H02 |
| 759 | 3430 | 99.A3.sp6:131232.Seq | M00003981A:E10 |
| 760 | 2433 | 99.B3.sp6:131244.Seq | M00003982C:C02 |

TABLE 1-continued

Sequence identification numbers, cluster ID, sequence name, and clone name

| SEQ ID NO: | Cluster ID | Sequence Name | Clone Name |
|---|---|---|---|
| 761 | 9105 | 99.C3.sp6:131256.Seq | M00003983A:A05 |
| 762 | 6124 | 99.D3.sp6:131268.Seq | M00004028D:A06 |
| 763 | 40073 | 99.E3.sp6:131280.Seq | M00004028D:C05 |
| 764 | 37285 | 99.H3.sp6:131316.Seq | M00004035C:A07 |
| 765 | 17036 | 99.A4.sp6:131233.Seq | M00004035D:B06 |
| 766 | 3706 | 99.C4.sp6:131257.Seq | M00004068B:A01 |
| 767 |  | 99.D4.sp6:131269.Seq | M00004072A:C03 |
| 768 | 15069 | 99.F4.sp6:131293.Seq | M00004081C:D10 |
| 769 | 9285 | 99.H4.sp6:131317.Seq | M00004086D:G06 |
| 770 | 6880 | 99.A5.sp6:131234.Seq | M00004087D:A01 |
| 771 | 5325 | 99.C5.sp6:131258.Seq | M00004093D:B12 |
| 772 | 7221 | 99.D5.sp6:131270.Seq | M00004105C:A04 |
| 773 | 4937 | 99.E5.sp6:131282.Seq | M00004108A:E06 |
| 774 | 6874 | 99.F5.sp6:131294.Seq | M00004111D:A08 |
| 775 | 13183 | 99.G5.sp6:131306.Seq | M00004114C:F11 |
| 776 |  | 99.H5.sp6:131318.Seq | M00004121B:G01 |
| 777 | 13272 | 99.A6.sp6:131235.Seq | M00004138B:H02 |
| 778 | 5257 | 99.B6.sp6:131247.Seq | M00004146C:C11 |
| 779 | 6455 | 99.D6.sp6:131271.Seq | M00004157C:A09 |
| 780 | 5319 | 99.E6.sp6:131283.Seq | M00004169C:C12 |
| 781 | 4908 | 99.F6.sp6:131295.Seq | M00004171D:B03 |
| 782 | 11494 | 99.G6.sp6:131307.Seq | M00004172C:D08 |
| 783 | 11443 | 99.A7.sp6:131236.Seq | M00004185C:C03 |
| 784 |  | 99.B7.sp6:131248.Seq | M00004191D:B11 |
| 785 | 8210 | 99.C7.sp6:131260.Seq | M00004197D:H01 |
| 786 | 14311 | 99.D7.sp6:131272.Seq | M00004203B:C12 |
| 787 |  | 99.E7.sp6:131284.Seq | M00004205D:F06 |
| 788 | 12971 | 99.B8.sp6:131249.Seq | M00004223D:E04 |
| 789 | 6455 | 99.C8.sp6:131261.Seq | M00004229B:F08 |
| 790 | 7212 | 99.D8.sp6:131273.Seq | M00004230B:C07 |
| 791 | 4905 | 99.H8.sp6:131321.Seq | M00004269D:D06 |
| 792 | 16914 | 99.A9.sp6:131238.Seq | M00004275C:C11 |
| 793 | 16921 | 99.D9.sp6:131274.Seq | M00004295D:F12 |
| 794 | 13046 | 99.E9.sp6:131286.Seq | M00004296C:H07 |
| 795 | 9457 | 99.F9.sp6:131298.Seq | M00004307C:A06 |
| 796 | 26295 | 99.G9.sp6:131310.Seq | M00004312A:G03 |
| 797 | 21847 | 99.H9.sp6:131322.Seq | M00004318C:D10 |
| 798 |  | 99.H10.sp6:131323.Seq | M00004505D:F08 |
| 799 |  | 99.B11.sp6:131252.Seq | M00004692A:H08 |
| 800 |  | 99.D11.sp6:131276.Seq | M00005180C:G03 |
| 801 | 39304 | RTA00000118A.j.21.1.Seq_THC151859 |  |
| 802 | 2428 | RTA00000123A.1.21.1.Seq_THC205063 |  |
| 803 | 1058 | RTA00000126A.e.20.3.Seq_THC217534 |  |
| 804 | 5097 | RTA00000134A.k.1.1.Seq_THC215869 |  |
| 805 | 20212 | RTA00000134A.1.22.1.Seq_THC128232 |  |
| 806 | 23255 | RTA00000177AF.e.14.3.Seq_THC228776 |  |
| 807 | 2790 | RTA00000177AF.e.2.1.Seq_THC229461 |  |
| 808 | 6420 | RTA00000177AF.f.10.3.Seq_THC226443 |  |
| 809 | 4059 | RTA00000177AF.n.18.3.Seq_THC123051 |  |
| 810 |  | RTA00000179AF.j.13.1.Seq_THC105720 |  |
| 811 | 9952 | RTA00000180AF.c.20.1.Seq_THC162284 |  |
| 812 | 13238 | RTA00000181AF.m.4.1.Seq_THC140691 |  |
| 813 | 9685 | RTA00000183AF.c.11.1.Seq_THC109544 |  |
| 814 |  | RTA00000183AF.c.24.1.Seq_THC125912 |  |
| 815 | 6420 | RTA00000183AF.d.11.1.Seq_THC226443 |  |
| 816 | 6974 | RTA00000183AF.d.9.1.Seq_THC223129 |  |
| 817 | 40044 | RTA00000183AF.g.22.1.Seq_THC232899 |  |
| 818 |  | RTA00000183AF.g.9.1.Seq_THC198280 |  |
| 819 | 5892 | RTA00000184AF.d.11.1.Seq_THC161896 |  |
| 820 | 40044 | RTA00000186AF.d.1.1.Seq_THC232899 |  |
| 821 |  | RTA00000186AF.h.14.1.Seq_THC112525 |  |
| 822 | 19267 | RTA00000186AF.1.12.1.Seq_THC178183 |  |
| 823 | 8773 | RTA00000187AF.f.24.1.Seq_THC220002 |  |
| 824 | 7570 | RTA00000187AF.g.24.1.Seq_THC168636 |  |
| 825 | 11476 | RTA00000187AF.p.19.1.Seq_THC108482 |  |
| 826 |  | RTA00000188AF.d.11.1.Seq_THC212094 |  |
| 827 | 17076 | RTA00000188AF.d.21.1.Seq_THC208760 |  |
| 828 | 697 | RTA00000188AF.d.6.1.Seq_THC178884 |  |
| 829 | 67907 | RTA00000188AF.g.11.1.Seq_THC123222 |  |
| 830 | 5619 | RTA00000188AF.1.9.1.Seq_THC167845 |  |
| 831 | 4718 | RTA00000189AF.g.5.1.Seq_THC196102 |  |
| 832 | 39809 | RTA00000190AF.e.3.1.Seq_THC150217 |  |
| 833 | 23255 | RTA00000190AF.j.4.1.Seq_THC228776 |  |
| 834 | 40122 | RTA00000190AF.n.23.1.Seq_THC109227 |  |
| 835 | 23210 | RTA00000190AF.o.20.1.Seq_THC207240 |  |
| 836 | 23358 | RTA00000190AF.o.21.1.Seq_THC207240 |  |

TABLE 1-continued

Sequence identification numbers, cluster ID, sequence name, and clone name

| SEQ ID NO: | Cluster ID | Sequence Name | Clone Name |
|---|---|---|---|
| 837 | 5693 | RTA00000190AF.p.17.2.Seq_THC173318 | |
| 838 | 2433 | RTA00000191AF.a.15.2.Seq_THC79498 | |
| 839 | 5257 | RTA00000192AF.f.3.1.Seq_THC213833 | |
| 840 | 16392 | RTA00000192AF.l.1.1.Seq_THC202071 | |
| 841 | | RTA00000193AF.c.21.1.Seq_THC222602 | |
| 842 | 26295 | RTA00000193AF.i.24.2.Seq_THC197345 | |
| 843 | | RTA00000193AF.m.5.1.Seq_THC173318 | |
| 844 | | RTA00000193AF.n.15.1.Seq_THC215687 | |

Example 2

Results of Public Database Search to Identify Function of Gene Products

SEQ ID NOS:1-404, as well as the validation sequences SEQ ID NOS:405-800, were translated in all three reading frames to determine the best alignment with the individual sequences. These amino acid sequences and nucleotide sequences are referred, generally, as query sequences, which are aligned with the individual sequences. Query and individual sequences were aligned using the BLAST programs, available over the world wide web sit of the NCBI. Again the sequences were masked to various extents to prevent searching of repetitive sequences or poly-A sequences, using the XBLAST program for masking low complexity as described above in Example 1.

Table 2 (inserted before the claims) shows the results of the alignments. Table 2 refers to each sequence by its SEQ ID NO:, the accession numbers and descriptions of nearest neighbors from the Genbank and Non-Redundant Protein searches, and the p values of the search results. Table 1 identifies each SEQ ID NO: by SEQ name, clone ID, and cluster. As discussed above, a single cluster includes polynucleotides representing the same gene or gene family, and generally represents sequences encoding the same gene product.

For each of SEQ ID NOS:1-800, the best alignment to a protein or DNA sequence is included in Table 2. The activity of the polypeptide encoded by SEQ ID NOS:1-800 is the same or similar to the nearest neighbor reported in Table 2. The accession number of the nearest neighbor is reported, providing a reference to the activities exhibited by the nearest neighbor. The search program and database used for the alignment also are indicated as well as a calculation of the p value.

Full length sequences or fragments of the polynucleotide sequences of the nearest neighbors can be used as probes and primers to identify and isolate the full length sequence of SEQ ID NOS:1-800. The nearest neighbors can indicate a tissue or cell type to be used to construct a library for the full-length sequences of SEQ ID NOS:1-800.

SEQ ID NOS:1-800 and the translations thereof may be human homologs of known genes of other species or novel allelic variants of known human genes. In such cases, these new human sequences are suitable as diagnostics or therapeutics. As diagnostics, the human sequences SEQ ID NOS:1-800 exhibit greater specificity in detecting and differentiating human cell lines and types than homologs of other species. The human polypeptides encoded by SEQ ID NOS:1-800 are likely to be less immunogenic when administered to humans than homologs from other species. Further, on administration to humans, the polypeptides encoded by SEQ ID NOS:1-800 can show greater specificity or can be better regulated by other human proteins than are homologs from other species.

Example 3

Members of Protein Families

After conducting a profile search as described in the specification above, several of the polynucleotides of the invention were found to encode polypeptides having characteristics of a polypeptide belonging to a known protein families (and thus represent new members of these protein families) and/or comprising a known functional domain (Table 3). Thus the invention encompasses fragments, fusions, and variants of such polynucleotides that retain biological activity associated with the protein family and/or functional domain identified herein.

TABLE 3

Polynucleotides encoding gene products of a protein family or having a known functional domain(s).

| SEQ ID NO: | Biological Activity (Profile hit) | Start | Stop | Dir |
|---|---|---|---|---|
| 24 | 4 transmembrane segments integral membrane proteins | 1218 | 578 | rev |
| 41 | 4 transmembrane segments integral membrane proteins | 1086 | 413 | rev |
| 101 | 4 transmembrane segments integral membrane proteins | 1206 | 544 | rev |
| 157 | 4 transmembrane segments integral membrane proteins | 721 | 33 | rev |
| 341 | 4 transmembrane segments integral membrane proteins | 1253 | 613 | rev |
| 395 | 4 transmembrane segments integral membrane proteins | 530 | 10 | for |
| 395 | 4 transmembrane segments integral membrane proteins | 696 | 17 | for |
| 395 | 4 transmembrane segments integral membrane proteins | 471 | 39 | rev |
| 24 | 7 transmembrane receptor (Secretin family) | 1301 | 491 | rev |
| 41 | 7 transmembrane receptor (Secretin family) | 1309 | 10 | rev |
| 101 | 7 transmembrane receptor (Secretin family) | 1330 | 296 | rev |
| 157 | 7 transmembrane receptor (Secretin family) | 1173 | 249 | rev |
| 291 | 7 transmembrane receptor (Secretin family) | 1400 | 269 | rev |
| 291 | 7 transmembrane receptor (Secretin family) | 712 | 130 | for |

TABLE 3-continued

Polynucleotides encoding gene products of a protein family or having a known functional domain(s).

| SEQ ID NO: | Biological Activity (Profile hit) | Start | Stop | Dir |
|---|---|---|---|---|
| 305 | 7 transmembrane receptor (Secretin family) | 926 | 4 | for |
| 305 | 7 transmembrane receptor (Secretin family) | 753 | 55 | rev |
| 315 | 7 transmembrane receptor (Secretin family) | 1058 | 270 | rev |
| 341 | 7 transmembrane receptor (Secretin family) | 1265 | 534 | rev |
| 116 | Ank repeat | 141 | 218 | for |
| 251 | Ank repeat | 290 | 207 | for |
| 251 | Ank repeat | 467 | 387 | for |
| 63 | ATPases Associated with Various Cellular Activities | 543 | 60 | for |
| 116 | ATPases Associated with Various Cellular Activities | 802 | 313 | for |
| 134 | ATPases Associated with Various Cellular Activities | 525 | 57 | rev |
| 136 | ATPases Associated with Various Cellular Activities | 712 | 163 | for |
| 151 | ATPases Associated with Various Cellular Activities | 719 | 73 | for |
| 151 | ATPases Associated with Various Cellular Activities | 386 | 13 | for |
| 384 | ATPases Associated with Various Cellular Activities | 664 | 140 | for |
| 404 | ATPases Associated with Various Cellular Activities | 704 | 52 | for |
| 374 | Basic region plus leucine zipper transcription factors | 298 | 146 | for |
| 97 | Bromodomain (conserved sequence found in human, *Drosophila* and yeast proteins.) | 230 | 63 | for |
| 136 | EF-hand | 121 | 207 | for |
| 242 | EF-hand | 238 | 155 | for |
| 379 | EF-hand | 212 | 126 | for |
| 308 | Eukaryotic aspartyl proteases | 1300 | 461 | rev |
| 213 | GATA family of transcription factors | 720 | 377 | for |
| 367 | G-protein alpha subunit | 971 | 467 | rev |
| 188 | Phorbol esters/diacylglycerol binding | 91 | 177 | for |
| 251 | Phorbol esters/diacylglycerol binding | 133 | 219 | for |
| 202 | protein kinase | 482 | 1 | rev |
| 202 | protein kinase | 970 | 1 | rev |
| 315 | protein kinase | 739 | 158 | for |
| 315 | protein kinase | 1023 | 197 | for |
| 367 | protein kinase | 1046 | 285 | rev |
| 397 | protein kinase | 511 | 6 | for |
| 256 | Protein phosphatase 2C | 13 | 90 | for |
| 256 | Protein phosphatase 2C | 163 | 86 | for |
| 382 | Protein Tyrosine Phosphatase | 261 | 2 | for |
| 306 | SH3 Domain | 141 | 296 | for |
| 386 | SH3 Domain | 359 | 209 | for |
| 169 | Trypsin | 764 | 164 | rev |
| 188 | WD domain, G-beta repeats | 480 | 382 | for |
| 188 | WD domain, G-beta repeats | 206 | 117 | for |
| 335 | WD domain, G-beta repeats | 3 | 92 | for |
| 23 | wnt family of developmental signaling proteins | 1151 | 335 | rev |
| 291 | wnt family of developmental signaling proteins | 779 | 89 | rev |
| 291 | wnt family of developmental signaling proteins | 1347 | 382 | rev |
| 324 | wnt family of developmental signaling proteins | 1180 | 499 | rev |
| 330 | wnt family of developmental signaling proteins | 1180 | 499 | rev |
| 341 | wnt family of developmental signaling proteins | 1399 | 560 | rev |
| 353 | wnt family of developmental signaling proteins | 880 | 49 | rev |
| 188 | WW/rsp5/WWP domain containing proteins | 431 | 354 | for |
| 379 | WW/rsp5/WWP domain containing proteins | 12 | 89 | for |
| 395 | WW/rsp5/WWP domain containing proteins | 153 | 76 | for |
| 395 | WW/rsp5/WWP domain containing proteins | 156 | 64 | for |
| 61 | Zinc finger, C2H2 type | 254 | 192 | for |
| 306 | Zinc finger, C2H2 type | 428 | 367 | for |
| 386 | Zinc finger, C2H2 type | 191 | 253 | for |
| 322 | Zinc finger, CCHC class | 553 | 503 | for |
| 306 | Zinc-binding metalloprotease domain | 101 | 60 | rev |
| 395 | Zinc-binding metalloprotease domain | 28 | 69 | rev |

Start and stop indicate the position within the individual sequences that align with the query sequence having the indicated SEQ ID NO. The direction (Dir) indicates the orientation of the query sequence with respect to the individual sequence, where forward (for) indicates that the alignment is in the same direction (left to right) as the sequence provided in the Sequence Listing and reverse (rev) indicates that the alignment is with a sequence complementary to the sequence provided in the Sequence Listing. Some polynucleotides exhibited multiple profile hits because, for example, the particular sequence contains overlapping profile regions, and/or the sequence contains two different functional domains. These profile hits are described in more detail below.

a) Four Transmembrane Integral Membrane Proteins. SEQ ID NOS: 24, 41, 101, 157, 341, and 395 correspond to a sequence encoding a polypeptide that is a member of the 4 transmembrane segments integral membrane protein family (transmembrane 4 family). The transmembrane 4 family of proteins includes a number of evolutionarily-related eukaryotic cell surface antigens (Levy et al., *J. Biol. Chem.*, (1991) 266:14597; Tomlinson et al., *Eur. J. Immunol.* (1993) 23:136; Barclay et al. The leucocyte antigen factbooks. (1993) Academic Press, London/San Diego). The proteins belonging to this family include: 1) Mammalian antigen CD9 (MIC3), which is involved in platelet activation and aggregation; 2)

Mammalian leukocyte antigen CD37, expressed on B lymphocytes; 3) Mammalian leukocyte antigen CD53 (OX-44), which is implicated in growth regulation in hematopoietic cells; 4) Mammalian lysosomal membrane protein CD63 (melanoma-associated antigen ME491; antigen AD1); 5) Mammalian antigen CD81 (cell surface protein TAPA-1), which is implicated in regulation of lymphoma cell growth; 6) Mammalian antigen CD82 (protein R2; antigen C33; Kangai 1 (KAI1)), which associates with CD4 or CD8 and delivers costimulatory signals for the TCR/CD3 pathway; 7) Mammalian antigen CD151 (SFA-1; platelet-endothelial tetraspan antigen 3 (PETA-3)); 8) Mammalian cell surface glycoprotein A15 (TALLA-1; MXS1); 9) Mammalian novel antigen 2 (NAG-2); 10) Human tumor-associated antigen CO-029; 11) *Schistosoma mansoni* and *japonicum* 23 Kd surface antigen (SM23/SJ23).

The members of the 4 transmembrane family share several characteristics. First, they all are apparently type III membrane proteins, which are integral membrane proteins containing an N-terminal membrane-anchoring domain which is not cleaved during biosynthesis and which functions both as a translocation signal and as a membrane anchor. The family members also contain three additional transmembrane regions, at least seven conserved cysteines residues, and are of approximately the same size (218 to 284 residues). These proteins are collectively know as the "transmembrane 4 superfamily" (TM4) because they span plasma membrane four times. A schematic diagram of the domain structure of these proteins is as follows:

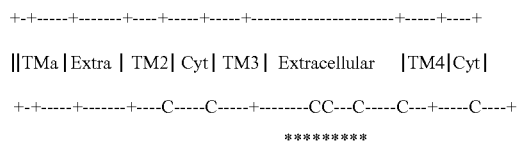

where Cyt is the cytoplasmic domain, TMa is the transmembrane anchor; TM2 to TM4 represents transmembrane regions 2 to 4, 'C' are conserved cysteines, and '*' indicates the position of the consensus pattern. The consensus pattern spans a conserved region including two cysteines located in a short cytoplasmic loop between two transmembrane domains: Consensus pattern: G-x(3)-[LIVMF]-x(2)-[GSA]-[LIVMF](2)-G-C-x-[GA]-[STA]-x(2)-[EG]-x(2)-[CWN]-[LIVM](2).

b) Seven Transmembrane Integral Membrane Proteins. SEQ ID NOS: 24, 41, 101, 157, 291, 305, 315, and 341 correspond to a sequence encoding a polypeptide that is a member of the seven transmembrane receptor family. G-protein coupled receptors (Strosberg, *Eur. J. Biochem.* (1991) 196:1; Kerlavage, *Curr. Opin. Struct. Biol.* (1991) 1:394; and Probst et al., *DNA Cell Biol.* (1992) 11:1; and Savarese et al., *Biochem. J.* (1992) 293:1) (also called R7G) are an extensive group of hormones, neurotransmitters, odorants and light receptors which transduce extracellular signals by interaction with guanine nucleotide-binding (G) proteins. The tertiary structure of these receptors is thought to be highly similar. They have seven hydrophobic regions, each of which most probably spans the membrane. The N-terminus is located on the extracellular side of the membrane and is often glycosylated, while the C-terminus is cytoplasmic and generally phosphorylated. Three extracellular loops alternate with three intracellular loops to link the seven transmembrane regions. Most, but not all of these receptors, lack a signal peptide. The most conserved parts of these proteins are the transmembrane regions and the first two cytoplasmic loops. A conserved acidic-Arg-aromatic triplet is present in the N-terminal extremity of the second cytoplasmic loop (Attwood et al., *Gene* (1991) 98:153) and could be implicated in the interaction with G proteins.

To detect this widespread family of proteins a pattern is used that contains the conserved triplet and that also spans the major part of the third transmembrane helix. Additional information about the seven transmembrane receptor family, and methods for their identification and use, is found in U.S. Pat. No. 5,759,804. Due in part to their expression on the cell surface and other attractive characteristics, seven transmembrane protein family members are of particular interest as drug targets, as surface antigen markers, and as drug delivery targets (e.g., using antibody-drug complexes and/or use of anti-seven transmembrane protein antibodies as therapeutics in their own right).

c) Ank Repeats. SEQ ID NOS: 116 and 251 represent polynucleotides encoding Ank repeat-containing proteins. The ankyrin motif is a 33 amino acid sequence named after the protein ankyrin which has 24 tandem 33-amino-acid motifs. Ank repeats were originally identified in the cell-cycle-control protein cdc10 (Breeden et al., *Nature* (1987) 329:651). Proteins containing ankyrin repeats include ankyrin, myotropin, I-kappaB proteins, cell cycle protein cdc10, the Notch receptor (Matsuno et al., *Development* (1997) 124(21):4265); G9a (or BAT8) of the class III region of the major histocompatibility complex (Biochem J. 290: 811-818, 1993), FABP, GABP, 53BP2, Lin12, glp-1, SW14, and SW16. The functions of the ankyrin repeats are compatible with a role in protein-protein interactions (Bork, *Proteins* (1993) 17(4):363; Lambert and Bennet, *Eur. J. Biochem.* (1993) 211:1; Kerr et al., *Current Op. Cell Biol.* (1992) 4:496; Bennet et al., *J. Biol. Chem.* (1980) 255:6424).

The 90 kD N-terminal domain of ankyrin contains a series of 24 33-amino-acid ank repeats. (Lux et al., *Nature* (1990) 344:36-42, Lambert et al., *PNAS USA* (1990) 87:1730.) The 24 ank repeats form four folded subdomains of 6 repeats each. These four repeat subdomains mediate interactions with at least 7 different families of membrane proteins. Ankyrin contains two separate binding sites for anion exchanger dimers. One site utilizes repeat subdomain two (repeats 7-12) and the other requires both repeat subdomains 3 and 4 (repeats 13-24). Since the anion exchangers exist in dimers, ankyrin binds 4 anion exchangers at the same time. (Michaely and Bennett, *J. Biol. Chem.* (1995) 270(37):22050) The repeat motifs are involved in ankyrin interaction with tubulin, spectrin, and other membrane proteins. (Lux et al., *Nature* (1990) 344:36.)

The Rel/NF-kappaB/Dorsal family of transcription factors have activity that is controlled by sequestration in the cytoplasm in association with inhibitory proteins referred to as I-kappaB. (Gilmore, *Cell* (1990) 62:841; Nolan and Baltimore, *Curr Opin Genet Dev.* (1992) 2:211; Baeuerle, *Biochim Biophys Acta* (1991) 1072:63; Schmitz et al., *Trends Cell Biol.* (1991) 1:130.) I-kappaB proteins contain 5 to 8 copies of 33 amino acid ankyrin repeats and certain NF-kappaB/rel proteins are also regulated by cis-acting ankyrin repeat containing domains including p105NF-kappaB which contains a series of ankyrin repeats (Diehl and Hannink, *J. Virol.* (1993) 67(12):7161). The I-kappaBs and Cactus (also containing ankyrin repeats) inhibit activators through differential interactions with the Rel-homology domain. The gene family includes proto-oncogenes, thus broadly implicating I-kappaB in the control of both normal gene expression and the aberrant gene expression that makes cells cancerous. (Nolan and Baltimore, *Curr Opin Genet Dev.* (1992) 2(2):211-

220). In the case of rel/NF-kappaB and pp40/I-kappaBβ, both the ankyrin repeats and the carboxy-terminal domain are required for inhibiting DNA-binding activity and direct association of pp40/I-kappaBβ with rel/NF-kappaB protein. The ankyrin repeats and the carboxy-terminal of pp40/I-kappaBβ (form a structure that associates with the rel homology domain to inhibit DNA binding activity (Inoue et al., *PNAS USA* (1992) 89:4333).

The 4 ankyrin repeats in the amino terminus of the transcription factor subunit GABPβ are required for its interaction with the GABPα subunit to form a functional high affinity DNA-binding protein. These repeats can be crosslinked to DNA when GABP is bound to its target sequence. (Thompson et al., *Science* (1991) 253:762; LaMarco et al., *Science* (1991) 253:789).

Myotrophin, a 12.5 kDa protein having a key role in the initiation of cardiac hypertrophy, comprises ankyrin repeats. The ankyrin repeats are characteristic of a hairpin-like protruding tip followed by a helix-turn-helix motif. The V-shaped helix-turn-helix of the repeats stack sequentially in bundles and are stabilized by compact hydrophobic cores, whereas the protruding tips are less ordered.

d) ATPases Associated with Various Cellular Activities (AAA). SEQ ID NOS: 63, 116, 134, 136, 151, 384, and 404 polynucleotides encoding novel members of the "ATPases Associated with diverse cellular Activities" (AAA) protein family The AAA protein family is composed of a large number of ATPases that share a conserved region of about 220 amino acids that contains an ATP-binding site (Froehlich et al., J. Cell Biol. (1991) 114:443; Erdmann et al. Cell (1991) 64:499; Peters et al., EMBO J. (1990) 9:1757; Kunau et al., Biochimie (1993) 75:209-224; Confalonieri et al., BioEssays (1995) 17:639; see internet site at yeamob.pci.chemie.uni-tuebingen.de/A-AA/Description.html). The proteins that belong to this family either contain one or two AAA domains.

Proteins containing two AAA domains include: 1) Mammalian and drosophila NSF (N-ethylmaleimide-sensitive fusion protein) and the fungal homolog, SEC18, which are involved in intracellular transport between the endoplasmic reticulum and Golgi, as well as between different Golgi cisternae; 2) Mammalian transitional endoplasmic reticulum ATPase (previously known as p97 or VCP), which is involved in the transfer of membranes from the endoplasmic reticulum to the golgi apparatus. This ATPase forms a ring-shaped homooligomer composed of six subunits. The yeast homolog, CDC48, plays a role in spindle pole proliferation; 3) Yeast protein PAS1 essential for peroxisome assembly and the related protein PAS1 from *Pichia pastoris;* 4) Yeast protein AFG2; 5) *Sulfolobus acidocaldarius* protein SAV and *Halobacterium salinarium* cdcH; which may be part of a transduction pathway connecting light to cell division.

Proteins containing a single AAA domain include: 1) *Escherichia coli* and other bacteria ftsH (or hflB) protein. FtsH is an ATP-dependent zinc metallopeptidase that degrades the heat-shock sigma-32 factor, and is an integral membrane protein with a large cytoplasmic C-terminal domain that contain both the AAA and the protease domains; 2) Yeast protein YME1, a protein important for maintaining the integrity of the mitochondrial compartment. YME1 is also a zinc-dependent protease; 3) Yeast protein AFG3 (or YTA10). This protein also contains an AAA domain followed by a zinc-dependent protease domain; 4) Subunits from regulatory complex of the 26S proteasome (Hilt et al., *Trends Biochem. Sci.* (1996) 21:96), which is involved in the ATP-dependent degradation of ubiquitinated proteins, which subunits include: a) Mammalian 4 and homologs in other higher eukaryotes, in yeast (gene YTA5) and fission yeast (gene mts2); b) Mammalian 6 (TBP7) and homologs in other higher eukaryotes and in yeast (gene YTA2); c) Mammalian subunit 7 (MSS1) and homologs in other higher eukaryotes and in yeast (gene CIM5 or YTA3); d) Mammalian subunit 8 (P45) and homologs in other higher eukaryotes and in yeast (SUG1 or CIM3 or TBY1) and fission yeast (gene let1); e) Other probable subunits include human TBP1, which influences HIV gene expression by interacting with the virus tat transactivator protein, and yeast YTA1 and YTA6; 5) Yeast protein BCS1, a mitochondrial protein essential for the expression of the Rieske iron-sulfur protein; 6) Yeast protein MSP1, a protein involved in intramitochondrial sorting of proteins; 7) Yeast protein PAS8, and the corresponding proteins PAS5 from *Pichia pastoris* and PAY4 from *Yarrowia lipolytica;* 8) Mouse protein SKD1 and its fission yeast homolog (SpAC2G11.06); 9) *Caenorhabditis elegans* meiotic spindle formation protein mei-1; 10) Yeast protein SAP1' 11) Yeast protein YTA7; and 12) *Mycobacterium leprae* hypothetical protein A2126A.

In general, the AAA domains in these proteins act as ATP-dependent protein clamps (Confalonieri et al. (1995) *BioEssays* 17:639). In addition to the ATP-binding 'A' and 'B' motifs, which are located in the N-terminal half of this domain, there is a highly conserved region located in the central part of the domain which was used in the development of the signature pattern.

e) Basic Region Plus Leucine Zipper Transcription Factors. SEQ ID NO:374 correspond to a polynucleotide encoding a novel member of the family of basic region plus leucine zipper transcription factors. The bZIP superfamily (Hurst, *Protein Prof.* (1995) 2:105; and Ellenberger, *Curr. Opin. Struct. Biol.* (1994) 4:12) of eukaryotic DNA-binding transcription factors encompasses proteins that contain a basic region mediating sequence-specific DNA-binding followed by a leucine zipper required for dimerization. Members of the family include transcription factor AP-1, which binds selectively to enhancer elements in the cis control regions of SV40 and metallothionein IIA. AP-1, also known as c-jun, is the cellular homolog of the avian sarcoma virus 17 (ASV17) oncogene v-jun.

Other members of this protein family include jun-B and jun-D, probable transcription factors that are highly similar to jun/AP-1; the fos protein, a proto-oncogene that forms a non-covalent dimer with c-jun; the fos-related proteins fra-1, and fos B; and mammalian cAMP response element (CRE) binding proteins CREB, CREM, ATF-1, ATF-3, ATF-4, ATF-5, ATF-6 and LRF-1.

f) Bromodomain. SEQ ID NO:97 corresponds to a polynucleotide encoding a polypeptide having a bromodomain region (Haynes et al., 1992, Nucleic Acids Res. 20:2693-2603, Tamkun et al., 1992, Cell 68:561-572, and Tamkun, 1995, Curr. Opin. Genet. Dev. 5:473-477), which is a conserved region of about 70 amino acids found in the following proteins: 1) Higher eukaryotes transcription initiation factor TFIID 250 Kd subunit (TBP-associated factor p250) (gene CCG1); P250 is associated with the TFIID TATA-box binding protein and seems essential for progression of the G1 phase of the cell cycle. 2) Human RING3, a protein of unknown function encoded in the MHC class II locus; 3) Mammalian CREB-binding protein (CBP), which mediates cAMP-gene regulation by binding specifically to phosphorylated CREB protein; 4) Mammalian homologs of brahma, including three brahma-like human: SNF2a(hBRM), SNF2b, and BRG1; 5) Human BS69, a protein that binds to adenovirus E1A and inhibits E1A transactivation; 6) Human peregrin (or Br140).

The bromodomain is thought to be involved in protein-protein interactions and may be important for the assembly or activity of multicomponent complexes involved in transcriptional activation.

g) EF-Hand. SEQ ID NOS:136, 242, and 379 correspond to polynucleotides encoding a novel protein in the family of EF-hand proteins. Many calcium-binding proteins belong to the same evolutionary family and share a type of calcium-binding domain known as the EF-hand (Kawasaki et al., *Protein. Prof.* (1995) 2:305-490). This type of domain consists of a twelve residue loop flanked on both sides by a twelve residue alpha-helical domain. In an EF-hand loop the calcium ion is coordinated in a pentagonal bipyramidal configuration. The six residues involved in the binding are in positions 1, 3, 5, 7, 9 and 12; these residues are denoted by X, Y, Z, -Y, -X and -Z. The invariant Glu or Asp at position 12 provides two oxygens for liganding Ca (bidentate ligand).

Proteins known to contain EF-hand regions include: Calmodulin (Ca=4, except in yeast where Ca=3) ("Ca=" indicates approximate number of EF-hand regions); diacylglycerol kinase (EC 2.7.1.107) (DGK) (Ca=2); 2) FAD-dependent glycerol-3-phosphate dehydrogenase (EC 1.1.99.5) from mammals (Ca=1); guanylate cyclase activating protein (GCAP) (Ca=3); MIF related proteins 8 (MRP-8 or CFAG) and 14 (MRP-14) (Ca=2); myosin regulatory light chains (Ca=1); oncomodulin (Ca=2); osteonectin (basement membrane protein BM-40) (SPARC); and proteins that contain an "osteonectin" domain (QR1, matrix glycoprotein SC1).

The consensus pattern includes the complete EF-hand loop as well as the first residue which follows the loop and which seem to always be hydrophobic.

h) Eukaryotic Aspartyl Proteases. SEQ ID NO:308 corresponds to a gene encoding a novel eukaryotic aspartyl protease. Aspartyl proteases, known as acid proteases, (EC 3.4.23.-) are a widely distributed family of proteolytic enzymes (Foltmann B., *Essays Biochem.* (1981) 17:52; Davies D. R., *Annu. Rev. Biophys. Chem.* (1990) 19:189; Rao J. K. M., et al., *Biochemistry* (1991) 30:4663) known to exist in vertebrates, fungi, plants, retroviruses and some plant viruses. Aspartate proteases of eukaryotes are monomeric enzymes which consist of two domains. Each domain contains an active site centered on a catalytic aspartyl residue. The two domains most probably evolved from the duplication of an ancestral gene encoding a primordial domain. Currently known eukaryotic aspartyl proteases include: 1) Vertebrate gastric pepsins A and C (also known as gastricsin); 2) Vertebrate chymosin (rennin), involved in digestion and used for making cheese; 3) Vertebrate lysosomal cathepsins D (EC 3.4.23.5) and E (EC 3.4.23.34); 4) Mammalian renin (EC 3.4.23.15) whose function is to generate angiotensin I from angiotensinogen in the plasma; 5) Fungal proteases such as aspergillopepsin A (EC 3.4.23.18), candidapepsin (EC 3.4.23.24), mucoropepsin (EC 3.4.23.23) (mucor rennin), endothiapepsin (EC 3.4.23.22), polyporopepsin (EC 3.4.23.29), and rhizopuspepsin (EC 3.4.23.21); and 6) Yeast saccharopepsin (EC 3.4.23.25) (proteinase A) (gene PEP4). PEP4 is implicated in posttranslational regulation of vacuolar hydrolases; 7) Yeast barrierpepsin (EC 3.4.23.35) (gene BAR1); a protease that cleaves alpha-factor and thus acts as an antagonist of the mating pheromone; and 8) Fission yeast sxa1 which is involved in degrading or processing the mating pheromones.

Most retroviruses and some plant viruses, such as badnaviruses, encode for an aspartyl protease which is an homodimer of a chain of about 95 to 125 amino acids. In most retroviruses, the protease is encoded as a segment of a polyprotein which is cleaved during the maturation process of the virus. It is generally part of the pol polyprotein and, more rarely, of the gag polyprotein. Because the sequence around the two aspartates of eukaryotic aspartyl proteases and around the single active site of the viral proteases is conserved, a single signature pattern can be used to identify members of both groups of proteases.

i) GATA Family of Transcription Factors. SEQ ID NO:213 corresponds to a novel member of the GATA family of transcription factors. The GATA family of transcription factors are proteins that bind to DNA sites with the consensus sequence (A/T)GATA(A/G), found within the regulatory region of a number of genes. Proteins currently known to belong to this family are: 1) GATA-1 (Trainor, C. D., et al., *Nature* (1990) 343:92) (also known as Eryf1, GF-1 or NF-E1), which binds to the GATA region of globin genes and other genes expressed in erythroid cells. It is a transcriptional activator which probably serves as a general 'switch' factor for erythroid development; 2) GATA-2 (Lee, M. E., et al., *J. Biol. Chem.* (1991) 266:16188), a transcriptional activator which regulates endothelin-1 gene expression in endothelial cells; 3) GATA-3 (Ho, I.-C., et al., *EMBO J.* (1991) 10:1187), a transcriptional activator which binds to the enhancer of the T-cell receptor alpha and delta genes; 4) GATA-4 (Spieth, J., et al., *Mol. Cell. Biol.* (1991) 11:4651), a transcriptional activator expressed in endodermally derived tissues and heart; 5) *Drosophila* protein pannier (or DGATAa) (gene pnr) which acts as a repressor of the achaete-scute complex (as-c); 6) *Bombyx mori* BCFI (Drevet, J. R., et al., *J. Biol. Chem.* (1994) 269:10660), which regulates the expression of chorion genes; 7) *Caenorhabditis elegans* elt-1 and elt-2, transcriptional activators of genes containing the GATA region, including vitellogenin genes (Hawkins, M. G., et al., *J. Biol. Chem.* (1995) 270:14666); 8) *Ustilago maydis* urbs1 (Voisard, C. P. O., et al., *Mol. Cell. Biol.* (1993) 13:7091), a protein involved in the repression of the biosynthesis of siderophores; 9) Fission yeast protein GAF2.

All these transcription factors contain a pair of highly similar 'zinc finger' type domains with the consensus sequence C-x2-C-x17-C-x2-C. Some other proteins contain a single zinc finger motif highly related to those of the GATA transcription factors. These proteins are: 1) *Drosophila* box A-binding factor (ABF) (also known as protein serpent (gene srp)) which may function as a transcriptional activator protein and may play a key role in the organogenesis of the fat body; 2) *Emericella nidulans* are (Arst, H. N., Jr., et al., *Trends Genet.* (1989) 5:291) a transcriptional activator which mediates nitrogen metabolite repression; 3) *Neurospora crassa* nit-2 (Fu, Y.-H., et al., *Mol. Cell. Biol.* (1990) 10:1056), a transcriptional activator which turns on the expression of genes coding for enzymes required for the use of a variety of secondary nitrogen sources, during conditions of nitrogen limitation; 4) *Neurospora crassa* white collar proteins 1 and 2 (WC-1 and WC-2), which control expression of light-regulated genes; 5) *Saccharomyces cerevisiae* DAL81 (or UGA43), a negative nitrogen regulatory protein; 6) *Saccharomyces cerevisiae* GLN3, a positive nitrogen regulatory protein; 7) *Saccharomyces cerevisiae* GAT1; 8) *Saccharomyces cerevisiae* GZF3.

j) G-Protein Alpha Subunit. SEQ ID NO:367 corresponds to a gene encoding a novel polypeptide of the G-protein alpha subunit family. Guanine nucleotide binding proteins (G-proteins) are a family of membrane-associated proteins that couple extracellularly-activated integral-membrane receptors to intracellular effectors, such as ion channels and enzymes that vary the concentration of second messenger molecules. G-proteins are composed of 3 subunits (alpha, beta and gamma) which, in the resting state, associate as a trimer at the inner face of the plasma membrane. The alpha subunit has a molecule of guanosine diphosphate (GDP) bound to it. Stimulation of the G-protein by an activated receptor leads to its exchange for GTP (guanosine triphosphate). This results in the separation of the alpha from the beta and gamma subunits, which always remain tightly associated as a dimer. Both the alpha and beta-gamma subunits are then able to interact with effectors, either individually or in a cooperative manner. The intrinsic GTPase activity of the alpha subunit hydrolyses the bound GTP to GDP. This returns the alpha subunit to its inactive conformation and allows it to reassociate with the beta-gamma subunit, thus restoring the system to its resting state.

G-protein alpha subunits are 350-400 amino acids in length and have molecular weights in the range 40-45 kDa. Seventeen distinct types of alpha subunit have been identified in mammals. These fall into 4 main groups on the basis of both sequence similarity and function: alpha-s, alpha-q, alpha-i and alpha-12 (Simon et al., *Science* (1993) 252:802). Many alpha subunits are substrates for ADP-ribosylation by cholera or pertussis toxins. They are often N-terminally acylated, usually with myristate and/or palmitoylate, and these fatty acid modifications are probably important for membrane association and high-affinity interactions with other proteins. The atomic structure of the alpha subunit of the G-protein involved in mammalian vision, transducin, has been elucidated in both GTP- and GDB-bound forms, and shows considerable similarity in both primary and tertiary structure in the nucleotide-binding regions to other guanine nucleotide binding proteins, such as p21-ras and EF-Tu.

k) Phorbol Esters/Diacylglycerol Binding. SEQ ID NO:188 and 251 represent polynucleotides encoding a protein belonging to the family including phorbol esters/diacylglycerol binding proteins. Diacylglycerol (DAG) is an important second messenger. Phorbol esters (PE) are analogues of DAG and potent tumor promoters that cause a variety of physiological changes when administered to both cells and tissues. DAG activates a family of serine/threonine protein kinases, collectively known as protein kinase C (PKC) (Azzi et al., *Eur. J. Biochem.* (1992) 208:547). Phorbol esters can directly stimulate PKC. The N-terminal region of PKC, known as C1, has been shown (Ono et al., *Proc. Natl. Acad. Sci. USA* (1989) 86:4868) to bind PE and DAG in a phospholipid and zinc-dependent fashion. The C1 region contains one or two copies (depending on the isozyme of PKC) of a cysteine-rich domain about 50 amino-acid residues long and essential for DAG/PE-binding. Such a domain has also been found in, for example, the following proteins.

(1) Diacylglycerol kinase (EC 2.7.1.107) (DGK) (Sakane et al., *Nature* (1990) 344:345), the enzyme that converts DAG into phosphatidate. It contains two copies of the DAG/PE-binding domain in its N-terminal section. At least five different forms of DGK are known in mammals; and (2) N-chimaerin, a brain specific protein which shows sequence similarities with the BCR protein at its C-terminal part and contains a single copy of the DAG/PE-binding domain at its N-terminal part. It has been shown (Ahmed et al., *Biochem. J.* (1990) 272:767, and Ahmed et al., *Biochem. J.* (1991) 280:233) to be able to bind phorbol esters.

The DAG/PE-binding domain binds two zinc ions; the ligands of these metal ions are probably the six cysteines and two histidines that are conserved in this domain. The signature pattern completely spans the DAG/PE domain. The consensus pattern is: H-x-[LIVMFYW]-x(8,11)-C-x(2)-C-x(3)-[LIVMFC]-x(5,10)-C-x(2)-C-x(4)-[HD]-x(2)-C-x(5,9)-C. All the C and H are probably involved in binding zinc.

l) Protein Kinase. SEQ ID NOS:202, 315, 367, and 397 represent polynucleotides encoding protein kinases. Protein kinases catalyze phosphorylation of proteins in a variety of pathways, and are implicated in cancer. Eukaryotic protein kinases (Hanks S. K., et al., *FASEB J.* (1995) 9:576; Hunter T., *Meth. Enzymol.* (1991) 200:3; Hanks S. K., et al., *Meth. Enzymol.* (1991) 200:38; Hanks S. K., *Curr. Opin. Struct. Biol.* (1991) 1:369; Hanks S. K., et al., *Science* (1988) 241:42) are enzymes that belong to a very extensive family of proteins which share a conserved catalytic core common to both serine/threonine and tyrosine protein kinases. There are a number of conserved regions in the catalytic domain of protein kinases. Two of the conserved regions are the basis for the signature pattern in the protein kinase profile. The first region, which is located in the N-terminal extremity of the catalytic domain, is a glycine-rich stretch of residues in the vicinity of a lysine residue, which has been shown to be involved in ATP binding. The second region, which is located in the central part of the catalytic domain, contains a conserved aspartic acid residue which is important for the catalytic activity of the enzyme (Knighton D. R., et al., *Science* (1991) 253:407). The protein kinase profile includes two signature patterns for this second region: one specific for serine/threonine kinases and the other for tyrosine kinases. A third profile is based on the alignment in (Hanks S. K., et al., *FASEB J.* (1995) 9:576) and covers the entire catalytic domain.

The protein kinase profile also detects receptor guanylate cyclases and 2-5A-dependent ribonucleases. Sequence similarities between these two families and the eukaryotic protein kinase family have been noticed previously. The profile also detects *Arabidopsis thaliana* kinase-like protein TMKL1 which seems to have lost its catalytic activity.

If a protein analyzed includes the two of the above protein kinase signatures, the probability of it being a protein kinase is close to 100%. Eukaryotic-type protein kinases have also been found in prokaryotes such as *Myxococcus xanthus* (Munoz-Dorado J., et al, *Cell* (1991) 67:995) and *Yersinia pseudotuberculosis*. The patterns shown above has been updated since their publication in (Bairoch A., et al., *Nature* (1988) 331:22).

m) Protein Phosphatase 2C, SEQ ID NO:256 corresponds to a polynucleotide encoding a novel protein phosphatase 2C (PP2C), which is one of the four major classes of mammalian serine/threonine specific protein phosphatases. PP2C (Wenk et al., *FEBS Lett.* (1992) 297:135) is a monomeric enzyme of about 42 Kd which shows broad substrate specificity and is dependent on divalent cations (mainly manganese and magnesium) for its activity. Three isozymes are currently known in mammals: PP2C-alpha, -beta and -gamma.

n) Protein Tyrosine Phosphatase. SEQ ID NO:382 represents a polynucleotide encoding a protein tyrosine kinase. Tyrosine specific protein phosphatases (EC 3.1.3.48) (PTPase) (Fischer et al., *Science* (1991) 253:401; Charbonneau et al., *Annu. Rev. Cell Biol.* (1992) 8:463; Trowbridge, *J. Biol. Chem.* (1991) 266:23517; Tonks et al., *Trends Biochem. Sci.* (1989) 14:497; and Hunter, *Cell* (1989) 58:1013) catalyze the removal of a phosphate group attached to a tyrosine residue. These enzymes are very important in the control of cell growth, proliferation, differentiation and transformation. Multiple forms of PTPase have been characterized and can be classified into two categories: soluble PTPases and transmembrane receptor proteins that contain PTPase domain(s).

Soluble PTPases include PTPN3 (H1) and PTPN4 (MEG), enzymes that contain an N-terminal band 4.1-like domain and could act at junctions between the membrane and cytoskeleton; PTPN6 (PTP-1C; HCP; SHP) and PTPN11 (PTP-2C;

SH-PTP3; Syp), enzymes that contain two copies of the SH2 domain at its N-terminal extremity.

Dual specificity PTPases include DUSP1 (PTPN10; MAP kinase phosphatase-1; MKP-1) which dephosphorylates MAP kinase on both Thr-183 and Tyr-185; and DUSP2 (PAC-1), a nuclear enzyme that dephosphorylates MAP kinases ERK1 and ERK2 on both Thr and Tyr residues.

Structurally, all known receptor PTPases are made up of a variable length extracellular domain, followed by a transmembrane region and a C-terminal catalytic cytoplasmic domain. Some of the receptor PTPases contain fibronectin type III (FN-III) repeats, immunoglobulin-like domains, MAM domains or carbonic anhydrase-like domains in their extracellular region. The cytoplasmic region generally contains two copies of the PTPAse domain. The first seems to have enzymatic activity, while the second is inactive but seems to affect substrate specificity of the first. In these domains, the catalytic cysteine is generally conserved but some other, presumably important, residues are not.

PTPase domains consist of about 300 amino acids. There are two conserved cysteines and the second one has been shown to be absolutely required for activity. Furthermore, a number of conserved residues in its immediate vicinity have also been shown to be important. The consensus pattern for PTPases is: [LIVMF]-H-C-x(2)-G-x(3)-[STC]-[STAGP]-x-[LIVMFY]; C is the active site residue.

o) SH3 Domain. SEQ ID NO:306 and 386 represent polynucleotides encoding SH3 domain proteins. The Src homology 3 (SH3) domain is a small protein domain of about 60 amino acid residues first identified as a conserved sequence in the non-catalytic part of several cytoplasmic protein tyrosine kinases (e.g. Src, Abl, Lck) (Mayer et al., *Nature* (1988) 332:272). The domain has also been found in a variety of intracellular or membrane-associated proteins (Musacchio et al., *FEBS Lett.* (1992) 307:55; Pawson et al., *Curr. Biol.* (1993) 3:434; Mayer et al., *Trends Cell Biol.* (1993) 3:8; and Pawson et al., *Nature* (1995) 373:573).

The SH3 domain has a characteristic fold that consists of five or six beta-strands arranged as two tightly packed antiparallel beta sheets. The linker regions may contain short helices (Kuriyan et al., *Curr. Opin. Struct. Biol.* (1993) 3:828). It is believed that SH3 domain-containing proteins mediate assembly of specific protein complexes via binding to proline-rich peptides (Morton et al., *Curr. Biol.* (1994) 4:615). In general, SH3 domains are found as single copies in a given protein, but there is a significant number of proteins with two SH3 domains and a few with 3 or 4 copies.

SH3 domains have been identified in, for example, protein tyrosine kinases, such as the Src, Abl, Bkt, Csk and ZAP70 families of kinases; mammalian phosphatidylinositol-specific phospholipase C-gamma-1 and -2; mammalian phosphatidyl inositol 3-kinase regulatory p85 subunit; mammalian Ras GTPase-activating protein (GAP); mammalian Vav oncoprotein, a guanine nucleotide exchange factor of the CDC24 family; *Drosophila* lethal(1)discs large-1 tumor suppressor protein (gene Dlg1); mammalian tight junction protein ZO-1; vertebrate erythrocyte membrane protein p55; *Caenorhabditis elegans* protein lin-2; rat protein CASK; and mammalian synaptic proteins SAP90/PSD-95, CHAPSYN-110/PSD-93, SAP97/DLG1 and SAP102. Novel SH3-domain containing polypeptides will facilitate elucidation of the role of such proteins in important biological pathways, such as ras activation.

p) Trypsin. SEQ ID NO:169 corresponds to a novel serine protease of the trypsin family. The catalytic activity of the serine proteases from the trypsin family is provided by a charge relay system involving an aspartic acid residue hydrogen-bonded to a histidine, which itself is hydrogen-bonded to a serine. The sequences in the vicinity of the active site serine and histidine residues are well conserved in this family of proteases (Brenner S., *Nature* (1988) 334:528). Proteases known to belong to the trypsin family include: 1) Acrosin; 2) Blood coagulation factors VII, IX, X, XI and XII, thrombin, plasminogen, and protein C; 3) Cathepsin G; 4) Chymotrypsins; 5) Complement components C1r, C1s, C2, and complement factors B, D and I; 6) Complement-activating component of RA-reactive factor; 7) Cytotoxic cell proteases (granzymes A to H); 8) Duodenase I; 9) Elastases 1, 2, 3A, 3B (protease E), leukocyte (medullasin); 10) Enterokinase (EC 3.4.21.9) (enteropeptidase); 11) Hepatocyte growth factor activator; 12) Hepsin; 13) Glandular (tissue) kallikreins (including EGF-binding protein types A, B, and C, NGF-gamma chain, gamma-renin, prostate specific antigen (PSA) and tonin); 14) Plasma kallikrein; 15) Mast cell proteases (MCP) 1 (chymase) to 8; 16) Myeloblastin (proteinase 3) (Wegener's autoantigen); 17) Plasminogen activators (urokinase-type, and tissue-type); 18) Trypsins I, II, III, and IV; 19) Tryptases; 20) Snake venom proteases such as ancrod, batroxobin, cerastobin, flavoxobin, and protein C activator; 21) Collagenase from common cattle grub and collagenolytic protease from Atlantic sand fiddler crab; 22) Apolipoprotein(a); 23) Blood fluke cercarial protease; 24) *Drosophila* trypsin like proteases: alpha, easter, snake-locus; 25) *Drosophila* protease stubble (gene sb); and 26) Major mite fecal allergen Der p III. All the above proteins belong to family S1 in the classification of peptidases (Rawlings N. D., et al., Meth. Enzymol. (1994) 244:19; see worldwide web site at expasy.ch/cgi-bin/lists?peptidas.txt and originate from eukaryotic species. It should be noted that bacterial proteases that belong to family S2A are similar enough in the regions of the active site residues that they can be picked up by the same patterns.

q) WD Domain, G-Beta Repeats. SEQ ID NOS:188 and 335 represent novel members of the WD domain/G-beta repeat family. Beta-transducin (G-beta) is one of the three subunits (alpha, beta, and gamma) of the guanine nucleotide-binding proteins (G proteins) which act as intermediaries in the transduction of signals generated by transmembrane receptors (Gilman, *Annu. Rev. Biochem.* (1987) 56:615). The alpha subunit binds to and hydrolyzes GTP; the functions of the beta and gamma subunits are less clear but they seem to be required for the replacement of GDP by GTP as well as for membrane anchoring and receptor recognition.

In higher eukaryotes, G-beta exists as a small multigene family of highly conserved proteins of about 340 amino acid residues. Structurally, G-beta consists of eight tandem repeats of about 40 residues, each containing a central Trp-Asp motif (this type of repeat is sometimes called a WD-40 repeat). Such a repetitive segment has been shown to exist in a number of other proteins including: human LIS1, a neuronal protein involved in type-1 lissencephaly; and mammalian coatomer beta' subunit (beta'-COP), a component of a cytosolic protein complex that reversibly associates with Golgi membranes to form vesicles that mediate biosynthetic protein transport.

r) wnt Family of Developmental Signaling Proteins. SEQ ID NO: 23, 291, 324, 330, 341, and 353 correspond to novel members of the wnt family of developmental signaling proteins. Wnt-1 (previously known as int-1), the seminal member of this family, (Nusse R., *Trends Genet.* (1988) 4:291) is a proto-oncogene induced by the integration of the mouse mammary tumor virus. It is thought to play a role in intercellular communication and seems to be a signalling molecule important in the development of the central nervous system (CNS). The sequence of wnt-1 is highly conserved in mammals, fish, and amphibians. Wnt-1 was found to be a member of a large family of related proteins (Nusse R., et al., *Cell* (1992) 69:1073; McMahon A. P., *Trends Genet.* (1992) 8:1; Moon R. T., *BioEssays* (1993) 15:91) that are all thought to be developmental regulators. These proteins are known as wnt-2 (also known as irp), wnt-3, -3A, -4, -5A, -5B, -6, -7A, -7B, -8, -8B, -9 and -10. At least four members of this family are present in *Drosophila*; one of them, wingless (wg), is implicated in segmentation polarity. All these proteins share the following features characteristics of secretory proteins: a signal peptide, several potential N-glycosylation sites and 22 conserved cysteines that are probably involved in disulfide bonds. The Wnt proteins seem to adhere to the plasma membrane of the secreting cells and are therefore likely to signal over only few cell diameters. The consensus pattern, which is based upon a highly conserved region including three cysteines, is as follows: C-K-C-H-G-[LIVMT]-S-G-x-C. All sequences known to belong to this family are detected by the provided consensus pattern.

s) Ww/rsp5/WWP Domain-Containing Proteins. SEQ ID NOS:188, 379, and 395 represent polynucleotides encoding a polypeptide in the family of WW/rsp5/WWP domain-containing proteins. The WW domain (Bork et al., *Trends Biochem. Sci.* (1994) 19:531; Andre et al., *Biochem. Biophys. Res. Commun.* (1994) 205:1201; Hofmann et al., *FEBS Lett.* (1995) 358:153; and Sudol et al., *FEBS Lett.* (1995) 369:67), also known as rsp5 or WWP), was originally discovered as a short conserved region in a number of unrelated proteins, among them dystrophin, the gene responsible for Duchenne muscular dystrophy. The domain, which spans about 35 residues, is repeated up to 4 times in some proteins. It has been shown (Chen et al., *Proc. Natl. Acad. Sci. USA* (1995) 92:7819) to bind proteins with particular proline-motifs, [AP]-P-P-[AP]-Y, and thus resembles somewhat SH3 domains. It appears to contain beta-strands grouped around four conserved aromatic positions, generally Trp. The name WW or WWP derives from the presence of these Trp as well as that of a conserved Pro. It is frequently associated with other domains typical for proteins in signal transduction processes.

Proteins containing the WW domain include:

1. Dystrophin, a multidomain cytoskeletal protein. Its longest alternatively spliced form consists of an N-terminal actin-binding domain, followed by 24 spectrin-like repeats, a cysteine-rich calcium-binding domain and a C-terminal globular domain. Dystrophins form tetramers and is thought to have multiple functions including involvement in membrane stability, transduction of contractile forces to the extracellular environment and organization of membrane specialization. Mutations in the dystrophin gene lead to muscular dystrophy of Duchenne or Becker type. Dystrophin contains one WW domain C-terminal of the spectrin-repeats.

2. Vertebrate YAP protein, which is a substrate of an unknown serine kinase. It binds to the SH3 domain of the Yes oncoprotein via a proline-rich region. This protein appears in alternatively spliced isoforms, containing either one or two WW domains.

3. IQGAP, which is a human GTPase activating protein acting on ras. It contains an N-terminal domain similar to fly muscle mp20 protein and a C-terminal ras GTPase activator domain.

For the sensitive detection of WW domains, the profile spans the whole homology region as well as a pattern.

t) Zinc Finger, C2H2 Type. SEQ ID NO:61, 306, and 386 correspond to polynucleotides encoding novel members of the of the C2H2 type zinc finger protein family. Zinc finger domains (Klug et al., *Trends Biochem. Sci.* (1987) 12:464; Evans et al., *Cell* (1988) 52:1; Payre et al., *FEBS Lett.* (1988) 234:245; Miller et al, *EMBO J.* (1985) 4:1609; and Berg, *Proc. Natl. Acad. Sci. USA* (1988) 85:99) are nucleic acid-binding protein structures first identified in the *Xenopus* transcription factor TFIIIA. These domains have since been found in numerous nucleic acid-binding proteins. A zinc finger domain is composed of 25 to 30 amino acid residues. Two cysteine or histidine residues are positioned at both extremities of the domain, which are involved in the tetrahedral coordination of a zinc atom. It has been proposed that such a domain interacts with about five nucleotides.

Many classes of zinc fingers are characterized according to the number and positions of the histidine and cysteine residues involved in the zinc atom coordination. In the first class to be characterized, called C2H2, the first pair of zinc coordinating residues are cysteines, while the second pair are histidines. A number of experimental reports have demonstrated the zinc-dependent DNA or RNA binding property of some members of this class.

Mammalian proteins having a C2H2 zipper include (number in parenthesis indicates number of zinc finger regions in the protein): basonuclin (6), BCL-6/LAZ-3 (6), erythroid krueppel-like transcription factor (3), transcription factors Sp1 (3), Sp2 (3), Sp3 (3) and Sp(4) 3, transcriptional repressor YY1 (4), Wilms' tumor protein (4), EGR1/Krox24 (3), EGR2/Krox20 (3), EGR3/Pilot (3), EGR4/AT133 (4), Evi-1 (10), GLI1 (5), GLI2 (4+), GLI3 (3+), HIV-EP1/ZNF40 (4), HIV-EP2 (2), KR1 (9+), KR2 (9), KR3 (15+), KR4 (14+), KR5 (11+), HF.12 (6+), REX-1 (4), ZfX (13), ZfY (13), Zfp-35 (18), ZNF7 (15), ZNF8 (7), ZNF35 (10), ZNF42/MZF-1 (13), ZNF43 (22), ZNF46/Kup (2), ZNF76 (7), ZNF91 (36), ZNF133 (3).

In addition to the conserved zinc ligand residues, it has been shown that a number of other positions are also important for the structural integrity of the C2H2 zinc fingers. (Rosenfeld et al., *J. Biomol. Struct. Dyn.* (1993) 11:557) The best conserved position is found four residues after the second cysteine; it is generally an aromatic or aliphatic residue. The consensus pattern for C2H2 zinc fingers is: C-x(2,4)-C-x(3)-[LIVMFYWC]-x(8)-H-x(3,5)-H. The two C's and two H's are zinc ligands.

u) Zinc Finger, CCHC Class. SEQ ID NO:322 corresponds to a polynucleotide encoding a novel member of the zinc finger CCHC family. The CCHC zinc finger protein family to date has been mostly composed of retroviral gag proteins (nucleocapsid). The prototype structure of this family is from HIV. The family also contains members involved in eukaryotic gene regulation, such as *C. elegans* GLH-1. The consensus sequence of this family is based upon the common structure of an 18-residue zinc finger.

v) Zinc-Binding Metalloprotease Domain. SEQ ID NO:306 and 395 represent polynucleotides encoding novel members of the zinc-binding metalloprotease domain protein family. The majority of zinc-dependent metallopeptidases (with the notable exception of the carboxypeptidases) share a common pattern of primary structure (Jongeneel et al., *FEBS Lett.* (1989) 242:211; Murphy et al., *FEBS Lett.* (1991) 289:4; and Bode et al., *Zoology* (1996) 99:237) in the part of their sequence involved in the binding of zinc, and can be grouped together as a superfamily, known as the metzincins, on the basis of this sequence similarity. Examples of these proteins include: 1) Angiotensin-converting enzyme (EC 3.4.15.1) (dipeptidyl carboxypeptidase I) (ACE), the enzyme responsible for hydrolyzing angiotensin I to angiotensin II. 2) Mammalian extracellular matrix metalloproteinases (known as matrixins) (Woessner, *FASEB J.* (1991) 5:2145): MMP-1 (EC 3.4.24.7) (interstitial collagenase), MMP-2 (EC 3.4.24.24) (72 Kd gelatinase), MMP-9 (EC 3.4.24.35) (92 Kd gelatinase), MMP-7 (EC 3.4.24.23) (matrylisin), MMP-8 (EC 3.4.24.34) (neutrophil collagenase), MMP-3 (EC 3.4.24.17) (stromelysin-1), MMP-10 (EC 3.4.24.22) (stromelysin-2), and MMP-11 (stromelysin-3), MMP-12 (EC 3.4.24.65) (macrophage metalloelastase). 3) Endothelin-converting enzyme 1 (EC 3.4.24.71) (ECE-1), which processes the precursor of endothelin to release the active peptide.

Example 4

Differential Expression of Polynucleotides of the Invention: Description of Libraries and Detection of Differential Expression The relative expression levels of the polynucleotides of the invention was assessed in several libraries prepared from various sources, including cell lines and patient tissue samples. Table 4 provides a summary of these libraries, including the shortened library name (used hereafter), the mRNA source used to prepared the cDNA library, the "nickname" of the library that is used in the tables below (in quotes), and the approximate number of clones in the library.

TABLE 4

Description of cDNA Libraries

| Library (lib #) | Description | Number of Clones in this Clustering |
|---|---|---|
| 1 | Km12 L4<br>Human Colon Cell Line, High Metastatic Potential (derived from Km12C)<br>"High Colon" | 307133 |
| 2 | Km12C<br>Human Colon Cell Line, Low Metastatic Potential<br>"Low Colon" | 284755 |
| 3 | MDA-MB-231<br>Human Breast Cancer Cell Line, High Metastatic Potential; micro-metastases in lung<br>"High Breast" | 326937 |
| 4 | MCF7<br>Human Breast Cancer Cell, Non Metastatic<br>"Low Breast" | 318979 |
| 8 | MV-522<br>Human Lung Cancer Cell Line, High Metastatic Potential<br>"High Lung" | 223620 |
| 9 | UCP-3<br>Human Lung Cancer Cell Line, Low Metastatic Potential "Low Lung" | 312503 |
| 12 | Human microvascular endothelial cells (HMEC) - Untreated<br>PCR (OligodT) cDNA library | 41938 |
| 13 | Human microvascular endothelial cells (HMEC) - bFGF treated<br>PCR (OligodT) cDNA library | 42100 |
| 14 | Human microvascular endothelial cells (HMEC) - VEGF treated<br>PCR (OligodT) cDNA library | 42825 |
| 15 | Normal Colon - UC#2 Patient<br>PCR (OligodT) cDNA library<br>"Normal Colon Tumor Tissue" | 34285 |
| 16 | Colon Tumor - UC#2 Patient<br>PCR (OligodT) cDNA library<br>"Normal Colon Tumor Tissue" | 35625 |
| 17 | Liver Metastasis from Colon Tumor of UC#2 Patient PCR (OligodT) cDNA library<br>"High Colon Metastasis Tissue" | 36984 |
| 18 | Normal Colon - UC#3 Patient<br>PCR (OligodT) cDNA library<br>"Normal Colon Tumor Tissue" | 36216 |

TABLE 4-continued

Description of cDNA Libraries

| Library (lib #) | Description | Number of Clones in this Clustering |
|---|---|---|
| 19 | Colon Tumor - UC#3 Patient<br>PCR (OligodT) cDNA library<br>"High Colon Tumor Tissue" | 41388 |
| 20 | Liver Metastasis from Colon Tumor of UC#3 Patient PCR (OligodT) cDNA library<br>"High Colon Metastasis Tissue" | 30956 |

The KM12L4 and KM12C cell lines are described in Example 1 above. The MDA-MB-231 cell line was originally isolated from pleural effusions (Cailleau, *J. Natl. Cancer. Inst.* (1974) 53:661), is of high metastatic potential, and forms poorly differentiated adenocarcinoma grade II in nude mice consistent with breast carcinoma. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., *Cancer Res.* (1979) 39:870 (MDA-MB-231 and MCF-7); Gastpar et al., *J Med Chem* (1998) 41:4965 (MDA-MB-231 and MCF-7); Ranson et al., *Br J Cancer* (1998) 77:1586 (MDA-MB-231 and MCF-7); Kuang et al., *Nucleic Acids Res* (1998) 26:1116 (MDA-MB-231 and MCF-7); Varki et al., *Int J Cancer* (1987) 40:46 (UCP-3); Varki et al., *Tumour Biol.* (1990) 11:327; (MV-522 and UCP-3); Varki et al., *Anticancer Res.* (1990) 10:637; (MV-522); Kelner et al., *Anticancer Res* (1995) 15:867 (MV-522); and Zhang et al., *Anticancer Drugs* (1997) 8:696 (MV522)). The samples of libraries 15-20 are derived from two different patients (UC#2, and UC#3).

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., *Genomics* (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences between Proportions," pp 296-298 (1974).

Tables 5 to 7 (inserted before the claims) show the number of clones in each of the above libraries that were analyzed for differential expression. Examples of differentially expressed polynucleotides of particular interest are described in more detail below.

TABLE 5

| Clone Name | Cluster ID | Clones in Lib1 | Clones in Lib2 | Clones in Lib3 | Clones in Lib4 | Clones in Lib8 | Clones in Lib9 |
|---|---|---|---|---|---|---|---|
| M00001340B:A06 | 17062 | 3 | 0 | 0 | 0 | 0 | 0 |
| M00001340D:F10 | 11589 | 2 | 2 | 1 | 3 | 3 | 8 |
| M00001341A:E12 | 4443 | 10 | 6 | 2 | 6 | 3 | 11 |
| M00001342B:E06 | 39805 | 2 | 0 | 0 | 0 | 1 | 0 |
| M00001343C:F10 | 2790 | 7 | 15 | 13 | 14 | 6 | 0 |
| M00001343D:H07 | 23255 | 3 | 0 | 1 | 1 | 0 | 0 |
| M00001345A:E01 | 6420 | 8 | 0 | 2 | 0 | 1 | 0 |
| M00001346A:F09 | 5007 | 4 | 8 | 3 | 6 | 2 | 6 |
| M00001346D:E03 | 6806 | 5 | 2 | 1 | 2 | 0 | 3 |
| M00001346D:G06 | 5779 | 5 | 4 | 3 | 4 | 0 | 0 |
| M00001346D:G06 | 5779 | 5 | 4 | 3 | 4 | 0 | 0 |
| M00001347A:B10 | 13576 | 5 | 0 | 0 | 0 | 12 | 11 |
| M00001348B:B04 | 16927 | 4 | 0 | 0 | 2 | 0 | 0 |
| M00001348B:G06 | 16985 | 4 | 0 | 0 | 0 | 0 | 0 |
| M00001349B:B08 | 3584 | 5 | 11 | 5 | 0 | 0 | 2 |
| M00001350A:H01 | 7187 | 5 | 3 | 1 | 0 | 1 | 0 |
| M00001351B:A08 | 3162 | 10 | 14 | 1 | 6 | 6 | 5 |
| M00001351B:A08 | 3162 | 10 | 14 | 1 | 6 | 6 | 5 |
| M00001352A:E02 | 16245 | 4 | 0 | 0 | 0 | 0 | 0 |
| M00001353A:G12 | 8078 | 4 | 3 | 1 | 0 | 1 | 0 |
| M00001353D:D10 | 14929 | 4 | 0 | 0 | 1 | 23 | 16 |
| M00001355B:G10 | 14391 | 3 | 1 | 0 | 0 | 0 | 0 |
| M00001357D:D11 | 4059 | 8 | 6 | 8 | 16 | 0 | 1 |
| M00001361A:A05 | 4141 | 5 | 2 | 10 | 16 | 4 | 27 |
| M00001361D:F08 | 2379 | 26 | 13 | 4 | 2 | 2 | 3 |
| M00001362B:D10 | 5622 | 7 | 4 | 2 | 13 | 1 | 2 |
| M00001362C:H11 | 945 | 9 | 21 | 2 | 1 | 0 | 0 |
| M00001365C:C10 | 40132 | 2 | 0 | 0 | 0 | 3 | 0 |
| M00001370A:C09 | 6867 | 7 | 3 | 0 | 0 | 0 | 0 |
| M00001371C:E09 | 7172 | 3 | 5 | 1 | 2 | 0 | 1 |
| M00001376B:G06 | 17732 | 1 | 3 | 5 | 0 | 1 | 4 |
| M00001378B:B02 | 39833 | 2 | 0 | 0 | 0 | 0 | 0 |
| M00001379A:A05 | 1334 | 27 | 38 | 35 | 28 | 3 | 0 |
| M00001380D:B09 | 39886 | 2 | 0 | 0 | 0 | 0 | 0 |
| M00001382C:A02 | 22979 | 2 | 1 | 0 | 0 | 0 | 0 |
| M00001383A:C03 | 39648 | 2 | 0 | 0 | 0 | 0 | 0 |
| M00001383A:C03 | 39648 | 2 | 0 | 0 | 0 | 0 | 0 |
| M00001386C:B12 | 5178 | 5 | 5 | 4 | 2 | 5 | 2 |
| M00001387A:C05 | 2464 | 5 | 19 | 25 | 16 | 1 | 0 |
| M00001387B:G03 | 7587 | 6 | 2 | 1 | 0 | 0 | 0 |
| M00001388D:G05 | 5832 | 10 | 3 | 0 | 1 | 5 | 0 |
| M00001389A:C08 | 16269 | 3 | 0 | 0 | 0 | 1 | 1 |
| M00001394A:F01 | 6583 | 2 | 7 | 3 | 2 | 0 | 0 |
| M00001395A:C03 | 4016 | 5 | 14 | 0 | 6 | 0 | 0 |
| M00001396A:C03 | 4009 | 6 | 4 | 13 | 5 | 4 | 10 |
| M00001402A:E08 | 39563 | 2 | 0 | 0 | 0 | 0 | 0 |
| M00001407B:D11 | 5556 | 8 | 1 | 5 | 0 | 2 | 0 |
| M00001409C:D12 | 9577 | 5 | 2 | 0 | 1 | 11 | 12 |
| M00001410A:D07 | 7005 | 8 | 2 | 0 | 0 | 0 | 0 |
| M00001412B:B10 | 8551 | 4 | 4 | 0 | 3 | 0 | 0 |

TABLE 5-continued

| Clone Name | Cluster ID | Clones in Lib1 | Clones in Lib2 | Clones in Lib3 | Clones in Lib4 | Clones in Lib8 | Clones in Lib9 |
|---|---|---|---|---|---|---|---|
| M00001415A:H06 | 13538 | 5 | 0 | 0 | 0 | 9 | 1 |
| M00001416A:H01 | 7674 | 5 | 2 | 0 | 5 | 0 | 0 |
| M00001416B:H11 | 8847 | 4 | 1 | 3 | 0 | 6 | 1 |
| M00001417A:E02 | 36393 | 2 | 0 | 0 | 1 | 0 | 0 |
| M00001418B:F03 | 9952 | 4 | 2 | 1 | 1 | 0 | 0 |
| M00001418D:B06 | 8526 | 3 | 2 | 1 | 5 | 1 | 0 |
| M00001421C:F01 | 9577 | 5 | 2 | 0 | 1 | 11 | 12 |
| M00001423B:E07 | 15066 | 4 | 0 | 0 | 0 | 0 | 0 |
| M00001424B:G09 | 10470 | 5 | 1 | 0 | 2 | 0 | 1 |
| M00001425B:H08 | 22195 | 3 | 0 | 0 | 0 | 0 | 0 |
| M00001426D:C08 | 4261 | 4 | 9 | 7 | 9 | 12 | 15 |
| M00001428A:H10 | 84182 | 1 | 0 | 0 | 0 | 0 | 0 |
| M00001429A:H04 | 2797 | 15 | 11 | 18 | 16 | 1 | 14 |
| M00001429B:A11 | 4635 | 7 | 9 | 2 | 0 | 0 | 0 |
| M00001429D:D07 | 40392 | 2 | 0 | 1 | 8 | 12 | 16 |
| M00001439C:F08 | 40054 | 1 | 0 | 0 | 0 | 0 | 0 |
| M00001442C:D07 | 16731 | 3 | 1 | 0 | 0 | 0 | 0 |
| M00001445A:F05 | 13532 | 3 | 2 | 1 | 0 | 1 | 2 |
| M00001446A:F05 | 7801 | 5 | 2 | 4 | 6 | 1 | 0 |
| M00001447A:G03 | 10717 | 7 | 2 | 0 | 5 | 8 | 0 |
| M00001448D:C09 | 8 | 1850 | 2127 | 1703 | 3133 | 1355 | 122 |
| M00001448D:H01 | 36313 | 2 | 0 | 0 | 0 | 1 | 30 |
| M00001449A:A12 | 5857 | 6 | 2 | 3 | 4 | 0 | 0 |
| M00001449A:B12 | 41633 | 1 | 1 | 0 | 0 | 0 | 0 |
| M00001449A:D12 | 3681 | 12 | 5 | 10 | 1 | 2 | 5 |
| M00001449A:G10 | 36535 | 2 | 0 | 0 | 0 | 0 | 0 |
| M00001449C:D06 | 86110 | 1 | 0 | 0 | 0 | 0 | 0 |
| M00001450A:A02 | 39304 | 2 | 0 | 0 | 0 | 0 | 0 |
| M00001450A:A11 | 32663 | 1 | 1 | 0 | 0 | 0 | 0 |
| M00001450A:B12 | 82498 | 1 | 0 | 0 | 0 | 0 | 0 |
| M00001450A:D08 | 27250 | 2 | 0 | 0 | 0 | 0 | 0 |
| M00001452A:B04 | 84328 | 1 | 0 | 0 | 0 | 0 | 0 |
| M00001452A:B12 | 86859 | 1 | 0 | 0 | 0 | 0 | 0 |
| M00001452A:D08 | 1120 | 44 | 41 | 5 | 11 | 5 | 0 |
| M00001452A:F05 | 85064 | 1 | 0 | 0 | 0 | 0 | 0 |
| M00001452C:B06 | 16970 | 4 | 0 | 0 | 0 | 3 | 4 |
| M00001453A:E11 | 16130 | 3 | 1 | 0 | 0 | 0 | 1 |
| M00001453C:F06 | 16653 | 3 | 1 | 0 | 0 | 0 | 0 |
| M00001454A:A09 | 83103 | 1 | 0 | 0 | 0 | 0 | 0 |
| M00001454B:C12 | 7005 | 8 | 2 | 0 | 0 | 0 | 0 |
| M00001454D:G03 | 689 | 58 | 95 | 17 | 36 | 66 | 95 |
| M00001455A:E09 | 13238 | 4 | 1 | 0 | 0 | 0 | 0 |
| M00001455B:E12 | 13072 | 4 | 1 | 0 | 0 | 0 | 0 |
| M00001455D:F09 | 9283 | 4 | 1 | 0 | 1 | 0 | 1 |
| M00001455D:F09 | 9283 | 4 | 1 | 0 | 1 | 0 | 1 |
| M00001460A:F06 | 2448 | 23 | 22 | 2 | 3 | 3 | 1 |
| M00001460A:F12 | 39498 | 2 | 0 | 0 | 0 | 0 | 0 |
| M00001461A:D06 | 1531 | 20 | 23 | 32 | 17 | 14 | 14 |
| M00001463C:B11 | 19 | 1415 | 1203 | 1364 | 525 | 479 | 774 |
| M00001465A:B11 | 10145 | 2 | 0 | 2 | 0 | 0 | 0 |
| M00001466A:E07 | 4275 | 11 | 2 | 5 | 0 | 4 | 2 |
| M00001467A:B07 | 38759 | 2 | 0 | 0 | 0 | 1 | 1 |
| M00001467A:D04 | 39508 | 2 | 0 | 0 | 0 | 0 | 0 |
| M00001467A:D08 | 16283 | 3 | 0 | 0 | 0 | 0 | 0 |
| M00001467A:D08 | 16283 | 3 | 0 | 0 | 0 | 0 | 0 |
| M00001467A:E10 | 39442 | 2 | 0 | 0 | 0 | 0 | 0 |
| M00001468A:F05 | 7589 | 6 | 2 | 1 | 1 | 1 | 0 |
| M00001469A:C10 | 12081 | 4 | 0 | 0 | 0 | 0 | 0 |
| M00001469A:H12 | 19105 | 2 | 0 | 2 | 0 | 1 | 0 |
| M00001470A:B10 | 1037 | 53 | 48 | 4 | 22 | 0 | 0 |
| M00001470A:C04 | 39425 | 2 | 0 | 0 | 0 | 0 | 0 |
| M00001471A:B01 | 39478 | 2 | 0 | 0 | 0 | 0 | 0 |
| M00001481D:A05 | 7985 | 3 | 1 | 4 | 0 | 1 | 0 |
| M00001490B:C04 | 18699 | 2 | 1 | 0 | 0 | 0 | 3 |
| M00001494D:F06 | 7206 | 4 | 3 | 3 | 1 | 2 | 0 |
| M00001497A:G02 | 2623 | 12 | 4 | 31 | 4 | 6 | 1 |
| M00001499B:A11 | 10539 | 2 | 1 | 1 | 0 | 1 | 0 |
| M00001500A:C05 | 5336 | 9 | 2 | 4 | 8 | 3 | 15 |
| M00001500A:E11 | 2623 | 12 | 4 | 31 | 4 | 6 | 1 |
| M00001500C:E04 | 9443 | 4 | 2 | 1 | 1 | 0 | 0 |
| M00001501D:C02 | 9685 | 3 | 2 | 0 | 7 | 2 | 3 |
| M00001504C:A07 | 10185 | 5 | 1 | 0 | 0 | 2 | 4 |
| M00001504C:H06 | 6974 | 7 | 3 | 0 | 1 | 0 | 0 |
| M00001504D:G06 | 6420 | 8 | 0 | 2 | 0 | 1 | 0 |
| M00001507A:H05 | 39168 | 2 | 0 | 0 | 0 | 0 | 0 |
| M00001511A:H06 | 39412 | 2 | 0 | 0 | 0 | 0 | 0 |
| M00001512A:A09 | 39186 | 2 | 0 | 0 | 0 | 0 | 0 |

TABLE 5-continued

| Clone Name | Cluster ID | Clones in Lib1 | Clones in Lib2 | Clones in Lib3 | Clones in Lib4 | Clones in Lib8 | Clones in Lib9 |
|---|---|---|---|---|---|---|---|
| M00001512D:G09 | 3956 | 9 | 9 | 5 | 2 | 0 | 0 |
| M00001513A:B06 | 4568 | 10 | 4 | 0 | 9 | 2 | 0 |
| M00001513C:E08 | 14364 | 1 | 0 | 0 | 0 | 0 | 0 |
| M00001514C:D11 | 40044 | 2 | 0 | 0 | 0 | 0 | 0 |
| M00001517A:B07 | 4313 | 13 | 6 | 1 | 0 | 1 | 0 |
| M00001518C:B11 | 8952 | 3 | 4 | 0 | 4 | 2 | 0 |
| M00001528A:C04 | 7337 | 4 | 4 | 3 | 16 | 12 | 21 |
| M00001528A:F09 | 18957 | 3 | 0 | 0 | 0 | 0 | 0 |
| M00001528B:H04 | 8358 | 3 | 3 | 2 | 0 | 0 | 0 |
| M00001531A:D01 | 38085 | 2 | 0 | 0 | 0 | 0 | 0 |
| M00001532B:A06 | 3990 | 6 | 12 | 4 | 1 | 3 | 1 |
| M00001533A:C11 | 2428 | 14 | 14 | 13 | 9 | 2 | 19 |
| M00001534A:C04 | 16921 | 4 | 0 | 0 | 1 | 2 | 1 |
| M00001534A:D09 | 5097 | 6 | 5 | 1 | 1 | 3 | 2 |
| M00001534A:F09 | 5321 | 11 | 7 | 1 | 5 | 10 | 26 |
| M00001534C:A01 | 4119 | 9 | 4 | 2 | 2 | 5 | 3 |
| M00001535A:B01 | 7665 | 3 | 1 | 5 | 0 | 0 | 0 |
| M00001535A:C06 | 20212 | 2 | 0 | 1 | 1 | 0 | 0 |
| M00001535A:F10 | 39423 | 2 | 0 | 0 | 0 | 0 | 0 |
| M00001536A:B07 | 2696 | 23 | 11 | 9 | 18 | 10 | 21 |
| M00001536A:C08 | 39392 | 2 | 0 | 0 | 0 | 0 | 0 |
| M00001537A:F12 | 39420 | 2 | 0 | 0 | 0 | 0 | 0 |
| M00001537B:G07 | 3389 | 4 | 11 | 13 | 2 | 0 | 0 |
| M00001540A:D06 | 8286 | 6 | 1 | 0 | 3 | 4 | 0 |
| M00001541A:D02 | 3765 | 19 | 6 | 0 | 0 | 0 | 0 |
| M00001541A:F07 | 22085 | 3 | 0 | 0 | 0 | 0 | 1 |
| M00001541A:H03 | 39174 | 2 | 0 | 0 | 0 | 0 | 0 |
| M00001542A:A09 | 22113 | 3 | 0 | 0 | 0 | 0 | 0 |
| M00001542A:E06 | 39453 | 2 | 0 | 0 | 0 | 0 | 0 |
| M00001544A:E03 | 12170 | 2 | 1 | 2 | 0 | 0 | 0 |
| M00001544A:G02 | 19829 | 2 | 0 | 1 | 0 | 0 | 0 |
| M00001544B:B07 | 6974 | 7 | 3 | 0 | 1 | 0 | 0 |
| M00001545A:C03 | 19255 | 2 | 0 | 0 | 0 | 0 | 0 |
| M00001545A:D08 | 13864 | 3 | 0 | 2 | 1 | 2 | 4 |
| M00001546A:G11 | 1267 | 43 | 55 | 5 | 0 | 0 | 0 |
| M00001548A:E10 | 5892 | 5 | 1 | 4 | 4 | 1 | 3 |
| M00001548A:H09 | 1058 | 40 | 44 | 37 | 47 | 39 | 59 |
| M00001549A:B02 | 4015 | 10 | 5 | 8 | 15 | 2 | 0 |
| M00001549A:D08 | 10944 | 3 | 0 | 3 | 1 | 0 | 7 |
| M00001549B:F06 | 4193 | 12 | 7 | 2 | 2 | 0 | 1 |
| M00001549C:E06 | 16347 | 4 | 0 | 0 | 0 | 0 | 0 |
| M00001550A:A03 | 7239 | 5 | 2 | 1 | 0 | 2 | 0 |
| M00001550A:G01 | 5175 | 8 | 1 | 3 | 2 | 0 | 0 |
| M00001551A:B10 | 6268 | 6 | 4 | 3 | 18 | 5 | 0 |
| M00001551A:F05 | 39180 | 2 | 0 | 0 | 0 | 0 | 0 |
| M00001551A:G06 | 22390 | 2 | 1 | 0 | 0 | 0 | 1 |
| M00001551C:G09 | 3266 | 12 | 14 | 0 | 1 | 0 | 6 |
| M00001552A:B12 | 307 | 73 | 60 | 196 | 75 | 79 | 27 |
| M00001552A:D11 | 39458 | 2 | 0 | 0 | 0 | 0 | 0 |
| M00001552B:D04 | 5708 | 5 | 4 | 4 | 3 | 1 | 4 |
| M00001553A:H06 | 8298 | 4 | 3 | 1 | 3 | 0 | 0 |
| M00001553B:F12 | 4573 | 5 | 7 | 2 | 5 | 0 | 1 |
| M00001553D:D10 | 22814 | 3 | 0 | 0 | 0 | 0 | 0 |
| M00001555A:B02 | 39539 | 2 | 0 | 0 | 0 | 1 | 0 |
| M00001555A:C01 | 39195 | 2 | 0 | 0 | 0 | 0 | 0 |
| M00001555D:G10 | 4561 | 8 | 4 | 4 | 8 | 0 | 0 |
| M00001556A:C09 | 9244 | 2 | 0 | 3 | 2 | 10 | 17 |
| M00001556A:F11 | 1577 | 12 | 40 | 25 | 3 | 4 | 0 |
| M00001556A:H01 | 15855 | 2 | 1 | 1 | 2 | 12 | 213 |
| M00001556B:C08 | 4386 | 7 | 8 | 3 | 1 | 3 | 21 |
| M00001556B:G02 | 11294 | 4 | 0 | 2 | 0 | 0 | 1 |
| M00001557A:D02 | 7065 | 5 | 3 | 2 | 1 | 0 | 0 |
| M00001557A:D02 | 7065 | 5 | 3 | 2 | 1 | 0 | 0 |
| M00001557A:F01 | 9635 | 3 | 0 | 2 | 1 | 0 | 0 |
| M00001557A:F03 | 39490 | 2 | 0 | 0 | 0 | 1 | 0 |
| M00001557B:H10 | 5192 | 8 | 5 | 0 | 5 | 0 | 0 |
| M00001557D:D09 | 8761 | 3 | 4 | 0 | 1 | 0 | 1 |
| M00001558B:H11 | 7514 | 5 | 3 | 0 | 0 | 0 | 0 |
| M00001560D:F10 | 6558 | 4 | 3 | 4 | 0 | 0 | 5 |
| M00001561A:C05 | 39486 | 2 | 0 | 0 | 0 | 0 | 0 |
| M00001563B:F06 | 102 | 289 | 233 | 278 | 116 | 123 | 184 |
| M00001564A:B12 | 5053 | 11 | 4 | 2 | 2 | 1 | 1 |
| M00001571C:H06 | 5749 | 4 | 1 | 9 | 0 | 0 | 0 |
| M00001578B:E04 | 23001 | 2 | 1 | 0 | 2 | 0 | 0 |
| M00001579D:C03 | 6539 | 8 | 3 | 0 | 0 | 0 | 1 |
| M00001583D:A10 | 6293 | 3 | 5 | 2 | 6 | 0 | 0 |
| M00001586C:C05 | 4623 | 3 | 4 | 12 | 2 | 1 | 1 |

TABLE 5-continued

| Clone Name | Cluster ID | Clones in Lib1 | Clones in Lib2 | Clones in Lib3 | Clones in Lib4 | Clones in Lib8 | Clones in Lib9 |
|---|---|---|---|---|---|---|---|
| M00001587A:B11 | 39380 | 2 | 0 | 0 | 0 | 0 | 0 |
| M00001594B:H04 | 260 | 189 | 188 | 27 | 2 | 15 | 0 |
| M00001597C:H02 | 4837 | 6 | 2 | 10 | 0 | 3 | 1 |
| M00001597D:C05 | 10470 | 5 | 1 | 0 | 2 | 0 | 1 |
| M00001598A:G03 | 16999 | 4 | 0 | 0 | 0 | 0 | 0 |
| M00001601A:D08 | 22794 | 2 | 0 | 0 | 0 | 0 | 0 |
| M00001604A:B10 | 1399 | 49 | 27 | 19 | 7 | 10 | 23 |
| M00001604A:F05 | 39391 | 2 | 0 | 0 | 0 | 0 | 0 |
| M00001607A:E11 | 11465 | 5 | 0 | 0 | 0 | 0 | 0 |
| M00001608A:B03 | 7802 | 5 | 4 | 0 | 1 | 0 | 0 |
| M00001608B:E03 | 22155 | 3 | 0 | 0 | 0 | 0 | 0 |
| M00001614C:F10 | 13157 | 4 | 1 | 0 | 3 | 1 | 0 |
| M00001617C:E02 | 17004 | 4 | 0 | 1 | 0 | 1 | 0 |
| M00001619C:F12 | 40314 | 2 | 0 | 0 | 0 | 1 | 0 |
| M00001621C:C08 | 40044 | 2 | 0 | 0 | 0 | 0 | 0 |
| M00001623D:F10 | 13913 | 2 | 1 | 2 | 0 | 0 | 1 |
| M00001624A:B06 | 3277 | 10 | 11 | 8 | 3 | 5 | 1 |
| M00001624C:F01 | 4309 | 4 | 13 | 3 | 10 | 0 | 0 |
| M00001630B:H09 | 5214 | 10 | 2 | 2 | 2 | 4 | 3 |
| M00001644C:B07 | 39171 | 2 | 0 | 0 | 0 | 0 | 0 |
| M00001645A:C12 | 19267 | 2 | 0 | 0 | 0 | 0 | 1 |
| M00001648C:A01 | 4665 | 5 | 9 | 0 | 0 | 0 | 0 |
| M00001657D:C03 | 23201 | 3 | 0 | 0 | 0 | 3 | 0 |
| M00001657D:F08 | 76760 | 1 | 0 | 2 | 2 | 0 | 5 |
| M00001662C:A09 | 23218 | 3 | 0 | 0 | 0 | 0 | 0 |
| M00001663A:E04 | 35702 | 2 | 0 | 0 | 0 | 0 | 0 |
| M00001669B:F02 | 6468 | 4 | 3 | 3 | 8 | 1 | 0 |
| M00001670C:H02 | 14367 | 3 | 0 | 0 | 0 | 0 | 0 |
| M00001673C:H02 | 7015 | 6 | 3 | 1 | 2 | 1 | 1 |
| M00001675A:C09 | 8773 | 4 | 1 | 4 | 4 | 4 | 6 |
| M00001676B:F05 | 11460 | 4 | 2 | 0 | 0 | 0 | 0 |
| M00001677C:E10 | 14627 | 1 | 2 | 1 | 0 | 1 | 0 |
| M00001677D:A07 | 7570 | 5 | 3 | 0 | 0 | 0 | 0 |
| M00001678D:F12 | 4416 | 9 | 5 | 2 | 6 | 1 | 3 |
| M00001679A:A06 | 6660 | 7 | 0 | 4 | 2 | 1 | 0 |
| M00001679A:F10 | 26875 | 1 | 0 | 0 | 0 | 1 | 0 |
| M00001679B:F01 | 6298 | 2 | 4 | 5 | 3 | 1 | 0 |
| M00001679C:F01 | 78091 | 1 | 0 | 0 | 0 | 0 | 0 |
| M00001679D:D03 | 10751 | 3 | 2 | 0 | 1 | 0 | 1 |
| M00001679D:D03 | 10751 | 3 | 2 | 0 | 1 | 0 | 1 |
| M00001680D:F08 | 10539 | 2 | 1 | 1 | 0 | 1 | 0 |
| M00001682C:B12 | 17055 | 4 | 0 | 0 | 0 | 0 | 0 |
| M00001686A:E06 | 4622 | 7 | 6 | 4 | 2 | 3 | 0 |
| M00001688C:F09 | 5382 | 6 | 2 | 6 | 2 | 0 | 3 |
| M00001693C:G01 | 4393 | 10 | 6 | 2 | 4 | 1 | 1 |
| M00001716D:H05 | 67252 | 1 | 0 | 0 | 1 | 0 | 0 |
| M00003741D:C09 | 40108 | 2 | 0 | 0 | 0 | 0 | 0 |
| M00003747D:C05 | 11476 | 6 | 0 | 0 | 0 | 0 | 0 |
| M00003759B:B09 | 697 | 76 | 52 | 30 | 72 | 21 | 30 |
| M00003762C:B08 | 17076 | 4 | 0 | 0 | 0 | 0 | 0 |
| M00003763A:F06 | 3108 | 14 | 11 | 7 | 5 | 0 | 1 |
| M00003774C:A03 | 67907 | 1 | 0 | 0 | 0 | 0 | 0 |
| M00003796C:D05 | 5619 | 3 | 5 | 3 | 3 | 0 | 4 |
| M00003826B:A06 | 11350 | 3 | 3 | 0 | 0 | 1 | 0 |
| M00003833A:E05 | 21877 | 2 | 1 | 0 | 0 | 0 | 1 |
| M00003837D:A01 | 7899 | 5 | 4 | 0 | 2 | 1 | 0 |
| M00003839A:D08 | 7798 | 5 | 2 | 2 | 0 | 0 | 1 |
| M00003844C:B11 | 6539 | 8 | 3 | 0 | 0 | 0 | 1 |
| M00003846B:D06 | 6874 | 6 | 3 | 0 | 0 | 0 | 0 |
| M00003851B:D10 | 13595 | 4 | 0 | 1 | 0 | 0 | 1 |
| M00003853A:D04 | 5619 | 3 | 5 | 3 | 3 | 0 | 4 |
| M00003853A:F12 | 10515 | 5 | 1 | 0 | 1 | 1 | 2 |
| M00003856B:C02 | 4622 | 7 | 6 | 4 | 2 | 3 | 0 |
| M00003857A:G10 | 3389 | 4 | 11 | 13 | 2 | 0 | 0 |
| M00003857A:H03 | 4718 | 4 | 5 | 5 | 2 | 4 | 6 |
| M00003871C:E02 | 4573 | 5 | 7 | 2 | 5 | 0 | 1 |
| M00003875B:F04 | 12977 | 5 | 0 | 0 | 0 | 0 | 0 |
| M00003875B:F04 | 12977 | 5 | 0 | 0 | 0 | 0 | 0 |
| M00003875C:G07 | 8479 | 4 | 3 | 1 | 1 | 2 | 4 |
| M00003876D:E12 | 7798 | 5 | 2 | 2 | 0 | 0 | 1 |
| M00003879B:C11 | 5345 | 7 | 1 | 7 | 4 | 6 | 27 |
| M00003879B:D10 | 31587 | 1 | 1 | 0 | 0 | 1 | 0 |
| M00003879D:A02 | 14507 | 3 | 1 | 0 | 0 | 3 | 1 |
| M00003885C:A02 | 13576 | 5 | 0 | 0 | 0 | 12 | 11 |
| M00003885C:A02 | 13576 | 5 | 0 | 0 | 0 | 12 | 11 |
| M00003906C:E10 | 9285 | 4 | 3 | 0 | 0 | 1 | 2 |
| M00003907D:A09 | 39809 | 1 | 0 | 0 | 0 | 2 | 1 |

TABLE 5-continued

| Clone Name | Cluster ID | Clones in Lib1 | Clones in Lib2 | Clones in Lib3 | Clones in Lib4 | Clones in Lib8 | Clones in Lib9 |
|---|---|---|---|---|---|---|---|
| M00003907D:H04 | 16317 | 3 | 0 | 0 | 0 | 0 | 0 |
| M00003909D:C03 | 8672 | 4 | 4 | 0 | 0 | 0 | 0 |
| M00003912B:D01 | 12532 | 4 | 1 | 0 | 1 | 0 | 1 |
| M00003914C:F05 | 3900 | 9 | 6 | 8 | 1 | 7 | 13 |
| M00003922A:E06 | 23255 | 3 | 0 | 1 | 1 | 0 | 0 |
| M00003958A:H02 | 18957 | 3 | 0 | 0 | 0 | 0 | 0 |
| M00003958A:H02 | 18957 | 3 | 0 | 0 | 0 | 0 | 0 |
| M00003958C:G10 | 40455 | 2 | 0 | 0 | 0 | 0 | 0 |
| M00003958C:G10 | 40455 | 2 | 0 | 0 | 0 | 0 | 0 |
| M00003968B:F06 | 24488 | 2 | 0 | 1 | 4 | 0 | 0 |
| M00003970C:B09 | 40122 | 2 | 0 | 0 | 0 | 0 | 0 |
| M00003974D:E07 | 23210 | 3 | 0 | 0 | 0 | 0 | 0 |
| M00003974D:H02 | 23358 | 3 | 0 | 0 | 0 | 1 | 0 |
| M00003975A:G11 | 12439 | 4 | 0 | 0 | 0 | 0 | 0 |
| M00003978B:G05 | 5693 | 7 | 4 | 1 | 3 | 1 | 1 |
| M00003981A:E10 | 3430 | 9 | 10 | 7 | 3 | 0 | 0 |
| M00003982C:C02 | 2433 | 10 | 13 | 21 | 18 | 8 | 8 |
| M00003983A:A05 | 9105 | 5 | 1 | 1 | 1 | 0 | 0 |
| M00004028D:A06 | 6124 | 4 | 8 | 1 | 9 | 1 | 0 |
| M00004028D:C05 | 40073 | 2 | 0 | 1 | 0 | 0 | 1 |
| M00004031A:A12 | 9061 | 5 | 2 | 0 | 0 | 0 | 0 |
| M00004031A:A12 | 9061 | 5 | 2 | 0 | 0 | 0 | 0 |
| M00004035C:A07 | 37285 | 2 | 0 | 0 | 1 | 0 | 1 |
| M00004035D:B06 | 17036 | 4 | 0 | 0 | 0 | 0 | 0 |
| M00004059A:D06 | 5417 | 10 | 4 | 0 | 9 | 2 | 0 |
| M00004068B:A01 | 3706 | 7 | 14 | 4 | 22 | 1 | 0 |
| M00004072B:B05 | 17036 | 4 | 0 | 0 | 0 | 0 | 0 |
| M00004081C:D10 | 15069 | 3 | 0 | 0 | 1 | 0 | 0 |
| M00004081C:D12 | 14391 | 3 | 1 | 0 | 0 | 0 | 0 |
| M00004086D:G06 | 9285 | 4 | 3 | 0 | 0 | 1 | 2 |
| M00004087D:A01 | 6880 | 2 | 6 | 1 | 1 | 0 | 0 |
| M00004093D:B12 | 5325 | 5 | 5 | 2 | 0 | 2 | 1 |
| M00004093D:B12 | 5325 | 5 | 5 | 2 | 0 | 2 | 1 |
| M00004105C:A04 | 7221 | 5 | 2 | 2 | 2 | 0 | 0 |
| M00004108A:E06 | 4937 | 4 | 9 | 3 | 1 | 3 | 1 |
| M00004111D:A08 | 6874 | 6 | 3 | 0 | 0 | 0 | 0 |
| M00004114C:F11 | 13183 | 2 | 3 | 0 | 7 | 0 | 1 |
| M00004138B:H02 | 13272 | 3 | 2 | 0 | 3 | 0 | 0 |
| M00004146C:C11 | 5257 | 2 | 8 | 5 | 5 | 5 | 25 |
| M00004151D:B08 | 16977 | 4 | 0 | 0 | 0 | 0 | 0 |
| M00004157C:A09 | 6455 | 3 | 1 | 6 | 0 | 0 | 0 |
| M00004169C:C12 | 5319 | 6 | 2 | 8 | 2 | 2 | 3 |
| M00004171D:B03 | 4908 | 6 | 7 | 2 | 2 | 2 | 0 |
| M00004172C:D08 | 11494 | 4 | 0 | 0 | 0 | 0 | 0 |
| M00004183C:D07 | 16392 | 3 | 0 | 0 | 0 | 0 | 0 |
| M00004185C:C03 | 11443 | 5 | 1 | 0 | 0 | 0 | 0 |
| M00004197D:H01 | 8210 | 2 | 6 | 0 | 0 | 0 | 0 |
| M00004203B:C12 | 14311 | 4 | 0 | 0 | 0 | 1 | 2 |
| M00004212B:C07 | 2379 | 26 | 13 | 4 | 2 | 2 | 3 |
| M00004214C:H05 | 11451 | 3 | 2 | 1 | 2 | 1 | 1 |
| M00004223A:G10 | 16918 | 4 | 0 | 0 | 0 | 0 | 0 |
| M00004223B:D09 | 7899 | 5 | 4 | 0 | 2 | 1 | 0 |
| M00004223D:E04 | 12971 | 4 | 0 | 0 | 0 | 1 | 0 |
| M00004229B:F08 | 6455 | 3 | 1 | 6 | 0 | 0 | 0 |
| M00004230B:C07 | 7212 | 3 | 5 | 2 | 1 | 3 | 0 |
| M00004269D:D06 | 4905 | 7 | 6 | 3 | 1 | 3 | 1 |
| M00004275C:C11 | 16914 | 3 | 0 | 0 | 1 | 0 | 0 |
| M00004283B:A04 | 14286 | 3 | 1 | 0 | 1 | 1 | 1 |
| M00004285B:E08 | 56020 | 1 | 0 | 0 | 0 | 0 | 0 |
| M00004295D:F12 | 16921 | 4 | 0 | 0 | 1 | 2 | 1 |
| M00004296C:H07 | 13046 | 4 | 1 | 0 | 1 | 0 | 0 |
| M00004307C:A06 | 9457 | 2 | 0 | 5 | 0 | 3 | 0 |
| M00004312A:G03 | 26295 | 2 | 0 | 0 | 0 | 0 | 0 |
| M00004318C:D10 | 21847 | 2 | 1 | 0 | 0 | 0 | 0 |
| M00004372A:A03 | 2030 | 13 | 10 | 32 | 4 | 0 | 0 |
| M00004377C:F05 | 2102 | 12 | 20 | 23 | 21 | 6 | 5 |

TABLE 6

| Clone Name | Cluster ID | Clones in Lib15 | Clones in Lib16b | Clones in Lib17 | Clones in Lib18 | Clones in Lib19 | Clones in Lib20 |
|---|---|---|---|---|---|---|---|
| M00001340B:A06 | 17062 | 0 | 0 | 0 | 0 | 0 | 0 |
| M00001340D:F10 | 11589 | 0 | 0 | 0 | 0 | 0 | 0 |

TABLE 6-continued

| Clone Name | Cluster ID | Clones in Lib15 | Clones in Lib16b | Clones in Lib17 | Clones in Lib18 | Clones in Lib19 | Clones in Lib20 |
|---|---|---|---|---|---|---|---|
| M00001341A:E12 | 4443 | 0 | 0 | 0 | 1 | 0 | 0 |
| M00001342B:E06 | 39805 | 0 | 0 | 0 | 0 | 0 | 0 |
| M00001343C:F10 | 2790 | 0 | 0 | 0 | 0 | 0 | 0 |
| M00001343D:H07 | 23255 | 0 | 0 | 0 | 0 | 0 | 0 |
| M00001345A:E01 | 6420 | 0 | 0 | 0 | 0 | 0 | 0 |
| M00001346A:F09 | 5007 | 0 | 0 | 0 | 0 | 0 | 0 |
| M00001346D:E03 | 6806 | 0 | 0 | 0 | 0 | 0 | 0 |
| M00001346D:G06 | 5779 | 0 | 0 | 0 | 0 | 0 | 0 |
| M00001346D:G06 | 5779 | 0 | 0 | 0 | 0 | 0 | 0 |
| M00001347A:B10 | 13576 | 0 | 0 | 0 | 0 | 0 | 0 |
| M00001348B:B04 | 16927 | 0 | 0 | 0 | 0 | 0 | 0 |
| M00001348B:G06 | 16985 | 0 | 0 | 0 | 0 | 0 | 0 |
| M00001349B:B08 | 3584 | 0 | 0 | 0 | 0 | 0 | 0 |
| M00001350A:H01 | 7187 | 0 | 0 | 0 | 0 | 0 | 0 |
| M00001351B:A08 | 3162 | 0 | 1 | 0 | 0 | 1 | 0 |
| M00001351B:A08 | 3162 | 0 | 1 | 0 | 0 | 1 | 0 |
| M00001352A:E02 | 16245 | 0 | 0 | 0 | 0 | 0 | 0 |
| M00001353A:G12 | 8078 | 0 | 0 | 0 | 0 | 0 | 0 |
| M00001353D:D10 | 14929 | 0 | 3 | 1 | 0 | 5 | 0 |
| M00001355B:G10 | 14391 | 0 | 0 | 0 | 0 | 0 | 0 |
| M00001357D:D11 | 4059 | 0 | 0 | 0 | 0 | 0 | 0 |
| M00001361A:A05 | 4141 | 0 | 0 | 0 | 0 | 0 | 0 |
| M00001361D:F08 | 2379 | 0 | 0 | 0 | 0 | 0 | 0 |
| M00001362B:D10 | 5622 | 0 | 0 | 0 | 0 | 0 | 0 |
| M00001362C:H11 | 945 | 0 | 0 | 0 | 0 | 0 | 1 |
| M00001365C:C10 | 40132 | 0 | 0 | 0 | 0 | 0 | 0 |
| M00001370A:C09 | 6867 | 0 | 0 | 0 | 0 | 0 | 0 |
| M00001371C:E09 | 7172 | 0 | 0 | 0 | 0 | 0 | 0 |
| M00001376B:G06 | 17732 | 0 | 0 | 0 | 0 | 0 | 1 |
| M00001378B:B02 | 39833 | 0 | 0 | 0 | 0 | 0 | 0 |
| M00001379A:A05 | 1334 | 0 | 0 | 0 | 0 | 0 | 1 |
| M00001380D:B09 | 39886 | 0 | 0 | 0 | 0 | 0 | 0 |
| M00001382C:A02 | 22979 | 0 | 0 | 0 | 0 | 0 | 0 |
| M00001383A:C03 | 39648 | 0 | 0 | 0 | 0 | 0 | 0 |
| M00001383A:C03 | 39648 | 0 | 0 | 0 | 0 | 0 | 0 |
| M00001386C:B12 | 5178 | 0 | 0 | 0 | 0 | 0 | 0 |
| M00001387A:C05 | 2464 | 0 | 0 | 0 | 0 | 0 | 0 |
| M00001387B:G03 | 7587 | 0 | 0 | 0 | 0 | 0 | 0 |
| M00001388D:G05 | 5832 | 0 | 0 | 0 | 0 | 0 | 0 |
| M00001389A:C08 | 16269 | 0 | 1 | 0 | 0 | 0 | 0 |
| M00001394A:F01 | 6583 | 1 | 4 | 1 | 0 | 0 | 0 |
| M00001395A:C03 | 4016 | 0 | 0 | 0 | 0 | 0 | 0 |
| M00001396A:C03 | 4009 | 0 | 0 | 0 | 0 | 0 | 0 |
| M00001402A:E08 | 39563 | 0 | 0 | 0 | 0 | 0 | 0 |
| M00001407B:D11 | 5556 | 0 | 0 | 0 | 0 | 0 | 0 |
| M00001409C:D12 | 9577 | 0 | 0 | 0 | 0 | 0 | 0 |
| M00001410A:D07 | 7005 | 0 | 0 | 0 | 0 | 0 | 0 |
| M00001412B:B10 | 8551 | 0 | 0 | 0 | 0 | 0 | 0 |
| M00001415A:H06 | 13538 | 0 | 0 | 0 | 0 | 0 | 0 |
| M00001416A:H01 | 7674 | 0 | 0 | 0 | 0 | 0 | 0 |
| M00001416B:H11 | 8847 | 0 | 0 | 0 | 0 | 0 | 0 |
| M00001417A:E02 | 36393 | 0 | 0 | 0 | 0 | 0 | 0 |
| M00001418B:F03 | 9952 | 0 | 0 | 0 | 0 | 0 | 0 |
| M00001418D:B06 | 8526 | 0 | 0 | 0 | 0 | 0 | 0 |
| M00001421C:F01 | 9577 | 0 | 0 | 0 | 0 | 0 | 0 |
| M00001423B:E07 | 15066 | 0 | 0 | 0 | 0 | 0 | 0 |
| M00001424B:G09 | 10470 | 0 | 0 | 0 | 0 | 0 | 0 |
| M00001425B:H08 | 22195 | 0 | 0 | 0 | 0 | 0 | 0 |
| M00001426D:C08 | 4261 | 0 | 0 | 1 | 0 | 0 | 1 |
| M00001428A:H10 | 84182 | 0 | 0 | 0 | 0 | 0 | 0 |
| M00001429A:H04 | 2797 | 0 | 0 | 0 | 0 | 0 | 0 |
| M00001429B:A11 | 4635 | 0 | 0 | 0 | 0 | 0 | 0 |
| M00001429D:D07 | 40392 | 0 | 0 | 0 | 0 | 0 | 0 |
| M00001439C:F08 | 40054 | 0 | 0 | 0 | 0 | 0 | 0 |
| M00001442C:D07 | 16731 | 0 | 0 | 0 | 0 | 0 | 0 |
| M00001445A:F05 | 13532 | 0 | 0 | 0 | 0 | 0 | 0 |
| M00001446A:F05 | 7801 | 0 | 0 | 0 | 0 | 0 | 0 |
| M00001447A:G03 | 10717 | 0 | 0 | 0 | 0 | 0 | 0 |
| M00001448D:C09 | 8 | 1 | 6 | 6 | 1 | 14 | 1 |
| M00001448D:H01 | 36313 | 0 | 3 | 0 | 0 | 3 | 0 |
| M00001449A:A12 | 5857 | 0 | 0 | 0 | 0 | 0 | 0 |
| M00001449A:B12 | 41633 | 0 | 0 | 0 | 0 | 0 | 0 |
| M00001449A:D12 | 3681 | 0 | 0 | 0 | 0 | 0 | 0 |
| M00001449A:G10 | 36535 | 0 | 0 | 0 | 0 | 0 | 0 |
| M00001449C:D06 | 86110 | 0 | 0 | 0 | 0 | 0 | 0 |
| M00001450A:A02 | 39304 | 0 | 0 | 0 | 0 | 0 | 0 |
| M00001450A:A11 | 32663 | 0 | 0 | 0 | 0 | 0 | 0 |

TABLE 6-continued

| Clone Name | Cluster ID | Clones in Lib15 | Clones in Lib16b | Clones in Lib17 | Clones in Lib18 | Clones in Lib19 | Clones in Lib20 |
|---|---|---|---|---|---|---|---|
| M00001450A:B12 | 82498 | 0 | 0 | 0 | 0 | 0 | 0 |
| M00001450A:D08 | 27250 | 0 | 0 | 0 | 0 | 0 | 0 |
| M00001452A:B04 | 84328 | 0 | 0 | 0 | 0 | 0 | 0 |
| M00001452A:B12 | 86859 | 0 | 0 | 0 | 0 | 0 | 0 |
| M00001452A:D08 | 1120 | 0 | 0 | 0 | 0 | 0 | 0 |
| M00001452A:F05 | 85064 | 0 | 0 | 0 | 0 | 0 | 0 |
| M00001452C:B06 | 16970 | 0 | 0 | 2 | 0 | 1 | 0 |
| M00001453A:E11 | 16130 | 0 | 0 | 0 | 0 | 0 | 0 |
| M00001453C:F06 | 16653 | 0 | 0 | 0 | 0 | 0 | 0 |
| M00001454A:A09 | 83103 | 0 | 0 | 0 | 0 | 0 | 0 |
| M00001454B:C12 | 7005 | 0 | 0 | 0 | 0 | 0 | 0 |
| M00001454D:G03 | 689 | 0 | 2 | 2 | 0 | 4 | 2 |
| M00001455A:E09 | 13238 | 0 | 0 | 0 | 0 | 0 | 0 |
| M00001455B:E12 | 13072 | 0 | 0 | 0 | 0 | 0 | 0 |
| M00001455D:F09 | 9283 | 0 | 0 | 0 | 0 | 0 | 0 |
| M00001455D:F09 | 9283 | 0 | 0 | 0 | 0 | 0 | 0 |
| M00001460A:F06 | 2448 | 0 | 0 | 0 | 0 | 0 | 0 |
| M00001460A:F12 | 39498 | 0 | 0 | 0 | 0 | 0 | 0 |
| M00001461A:D06 | 1531 | 0 | 0 | 0 | 0 | 0 | 0 |
| M00001463C:B11 | 19 | 2 | 13 | 13 | 0 | 69 | 10 |
| M00001465A:B11 | 10145 | 0 | 0 | 0 | 0 | 0 | 0 |
| M00001466A:E07 | 4275 | 0 | 0 | 0 | 0 | 0 | 0 |
| M00001467A:B07 | 38759 | 0 | 0 | 0 | 0 | 0 | 0 |
| M00001467A:D04 | 39508 | 0 | 0 | 0 | 0 | 0 | 0 |
| M00001467A:D08 | 16283 | 0 | 0 | 0 | 0 | 0 | 0 |
| M00001467A:D08 | 16283 | 0 | 0 | 0 | 0 | 0 | 0 |
| M00001467A:E10 | 39442 | 0 | 0 | 0 | 0 | 0 | 0 |
| M00001468A:F05 | 7589 | 0 | 0 | 0 | 0 | 0 | 0 |
| M00001469A:C10 | 12081 | 0 | 0 | 0 | 0 | 0 | 0 |
| M00001469A:H12 | 19105 | 0 | 0 | 0 | 0 | 0 | 0 |
| M00001470A:B10 | 1037 | 0 | 0 | 0 | 0 | 0 | 0 |
| M00001470A:C04 | 39425 | 0 | 0 | 0 | 0 | 0 | 0 |
| M00001471A:B01 | 39478 | 0 | 0 | 0 | 0 | 0 | 0 |
| M00001481D:A05 | 7985 | 0 | 0 | 0 | 0 | 0 | 0 |
| M00001490B:C04 | 18699 | 0 | 0 | 0 | 0 | 0 | 0 |
| M00001494D:F06 | 7206 | 0 | 0 | 0 | 0 | 0 | 0 |
| M00001497A:G02 | 2623 | 0 | 0 | 0 | 0 | 0 | 0 |
| M00001499B:A11 | 10539 | 0 | 0 | 0 | 0 | 0 | 0 |
| M00001500A:C05 | 5336 | 0 | 0 | 0 | 0 | 0 | 0 |
| M00001500A:E11 | 2623 | 0 | 0 | 0 | 0 | 0 | 0 |
| M00001500C:E04 | 9443 | 0 | 0 | 0 | 0 | 0 | 0 |
| M00001501D:C02 | 9685 | 0 | 0 | 0 | 0 | 0 | 0 |
| M00001504C:A07 | 10185 | 0 | 0 | 0 | 0 | 0 | 0 |
| M00001504C:H06 | 6974 | 0 | 0 | 0 | 0 | 0 | 0 |
| M00001504D:G06 | 6420 | 0 | 0 | 0 | 0 | 0 | 0 |
| M00001507A:H05 | 39168 | 0 | 0 | 0 | 0 | 0 | 0 |
| M00001511A:H06 | 39412 | 0 | 0 | 0 | 0 | 0 | 0 |
| M00001512A:A09 | 39186 | 0 | 0 | 0 | 0 | 0 | 0 |
| M00001512D:G09 | 3956 | 0 | 0 | 1 | 0 | 0 | 0 |
| M00001513A:B06 | 4568 | 0 | 0 | 0 | 0 | 0 | 0 |
| M00001513C:E08 | 14364 | 0 | 0 | 0 | 0 | 0 | 0 |
| M00001514C:D11 | 40044 | 0 | 1 | 0 | 0 | 0 | 0 |
| M00001517A:B07 | 4313 | 0 | 0 | 0 | 0 | 0 | 0 |
| M00001518C:B11 | 8952 | 0 | 0 | 0 | 0 | 0 | 0 |
| M00001528A:C04 | 7337 | 0 | 0 | 0 | 0 | 0 | 0 |
| M00001528A:F09 | 18957 | 0 | 0 | 0 | 0 | 0 | 0 |
| M00001528B:H04 | 8358 | 0 | 0 | 0 | 0 | 0 | 0 |
| M00001531A:D01 | 38085 | 0 | 0 | 0 | 0 | 0 | 0 |
| M00001532B:A06 | 3990 | 1 | 1 | 0 | 0 | 0 | 0 |
| M00001533A:C11 | 2428 | 0 | 0 | 1 | 0 | 0 | 0 |
| M00001534A:C04 | 16921 | 0 | 0 | 0 | 0 | 0 | 0 |
| M00001534A:D09 | 5097 | 0 | 0 | 0 | 0 | 0 | 0 |
| M00001534A:F09 | 5321 | 0 | 1 | 0 | 0 | 2 | 0 |
| M00001534C:A01 | 4119 | 0 | 0 | 0 | 0 | 0 | 0 |
| M00001535A:B01 | 7665 | 0 | 0 | 0 | 0 | 0 | 0 |
| M00001535A:C06 | 20212 | 0 | 0 | 0 | 0 | 0 | 0 |
| M00001535A:F10 | 39423 | 0 | 0 | 0 | 0 | 0 | 0 |
| M00001536A:B07 | 2696 | 0 | 0 | 0 | 0 | 3 | 0 |
| M00001536A:C08 | 39392 | 0 | 0 | 0 | 0 | 0 | 0 |
| M00001537A:F12 | 39420 | 0 | 0 | 0 | 0 | 0 | 0 |
| M00001537B:G07 | 3389 | 0 | 0 | 0 | 0 | 0 | 0 |
| M00001540A:D06 | 8286 | 0 | 0 | 0 | 0 | 0 | 0 |
| M00001541A:D02 | 3765 | 0 | 0 | 0 | 0 | 0 | 0 |
| M00001541A:F07 | 22085 | 0 | 0 | 0 | 0 | 0 | 0 |
| M00001541A:H03 | 39174 | 0 | 0 | 0 | 0 | 0 | 0 |
| M00001542A:A09 | 22113 | 0 | 0 | 0 | 0 | 0 | 0 |
| M00001542A:E06 | 39453 | 0 | 0 | 0 | 0 | 0 | 0 |

TABLE 6-continued

| Clone Name | Cluster ID | Clones in Lib15 | Clones in Lib16b | Clones in Lib17 | Clones in Lib18 | Clones in Lib19 | Clones in Lib20 |
|---|---|---|---|---|---|---|---|
| M00001544A:E03 | 12170 | 0 | 0 | 0 | 0 | 0 | 0 |
| M00001544A:G02 | 19829 | 0 | 0 | 0 | 0 | 0 | 0 |
| M00001544B:B07 | 6974 | 0 | 0 | 0 | 0 | 0 | 0 |
| M00001545A:C03 | 19255 | 0 | 0 | 0 | 0 | 0 | 0 |
| M00001545A:D08 | 13864 | 0 | 0 | 0 | 0 | 0 | 0 |
| M00001546A:G11 | 1267 | 1 | 0 | 0 | 0 | 7 | 0 |
| M00001548A:E10 | 5892 | 0 | 0 | 0 | 0 | 0 | 0 |
| M00001548A:H09 | 1058 | 0 | 0 | 1 | 0 | 0 | 0 |
| M00001549A:B02 | 4015 | 0 | 0 | 0 | 0 | 0 | 0 |
| M00001549A:D08 | 10944 | 0 | 0 | 0 | 0 | 0 | 0 |
| M00001549B:F06 | 4193 | 0 | 0 | 0 | 0 | 0 | 0 |
| M00001549C:E06 | 16347 | 0 | 0 | 0 | 0 | 0 | 0 |
| M00001550A:A03 | 7239 | 0 | 0 | 0 | 0 | 0 | 0 |
| M00001550A:G01 | 5175 | 0 | 0 | 0 | 0 | 0 | 0 |
| M00001551A:B10 | 6268 | 0 | 0 | 0 | 0 | 0 | 0 |
| M00001551A:F05 | 39180 | 0 | 0 | 0 | 0 | 0 | 0 |
| M00001551A:G06 | 22390 | 0 | 0 | 0 | 0 | 0 | 0 |
| M00001551C:G09 | 3266 | 0 | 0 | 1 | 0 | 0 | 0 |
| M00001552A:B12 | 307 | 0 | 0 | 0 | 0 | 3 | 0 |
| M00001552A:D11 | 39458 | 0 | 0 | 0 | 0 | 0 | 0 |
| M00001552B:D04 | 5708 | 0 | 1 | 0 | 0 | 0 | 0 |
| M00001553A:H06 | 8298 | 0 | 0 | 0 | 0 | 0 | 0 |
| M00001553B:F12 | 4573 | 0 | 0 | 0 | 0 | 0 | 0 |
| M00001553D:D10 | 22814 | 0 | 0 | 0 | 0 | 0 | 0 |
| M00001555A:B02 | 39539 | 0 | 0 | 0 | 0 | 0 | 0 |
| M00001555A:C01 | 39195 | 0 | 0 | 0 | 0 | 0 | 0 |
| M00001555D:G10 | 4561 | 0 | 0 | 0 | 0 | 0 | 0 |
| M00001556A:C09 | 9244 | 0 | 0 | 0 | 0 | 0 | 0 |
| M00001556A:F11 | 1577 | 0 | 0 | 0 | 0 | 0 | 0 |
| M00001556A:H01 | 15855 | 3 | 5 | 5 | 0 | 3 | 1 |
| M00001556B:C08 | 4386 | 1 | 2 | 0 | 0 | 0 | 0 |
| M00001556B:G02 | 11294 | 0 | 0 | 0 | 0 | 0 | 0 |
| M00001557A:D02 | 7065 | 0 | 0 | 0 | 0 | 0 | 0 |
| M00001557A:D02 | 7065 | 0 | 0 | 0 | 0 | 0 | 0 |
| M00001557A:F01 | 9635 | 0 | 0 | 0 | 0 | 0 | 0 |
| M00001557A:F03 | 39490 | 0 | 0 | 0 | 0 | 0 | 0 |
| M00001557B:H10 | 5192 | 0 | 0 | 0 | 0 | 0 | 0 |
| M00001557D:D09 | 8761 | 0 | 0 | 0 | 0 | 0 | 0 |
| M00001558B:H11 | 7514 | 0 | 0 | 0 | 0 | 0 | 0 |
| M00001560D:F10 | 6558 | 0 | 0 | 0 | 0 | 0 | 0 |
| M00001561A:C05 | 39486 | 0 | 0 | 0 | 0 | 0 | 0 |
| M00001563B:F06 | 102 | 22 | 38 | 65 | 7 | 43 | 10 |
| M00001564A:B12 | 5053 | 0 | 0 | 1 | 0 | 0 | 0 |
| M00001571C:H06 | 5749 | 0 | 0 | 0 | 0 | 0 | 0 |
| M00001578B:E04 | 23001 | 0 | 0 | 0 | 0 | 0 | 0 |
| M00001579D:C03 | 6539 | 0 | 0 | 0 | 0 | 0 | 0 |
| M00001583D:A10 | 6293 | 0 | 0 | 0 | 0 | 0 | 0 |
| M00001586C:C05 | 4623 | 0 | 0 | 0 | 0 | 1 | 0 |
| M00001587A:B11 | 39380 | 0 | 0 | 0 | 0 | 0 | 0 |
| M00001594B:H04 | 260 | 0 | 0 | 0 | 0 | 1 | 0 |
| M00001597C:H02 | 4837 | 0 | 0 | 0 | 0 | 0 | 0 |
| M00001597D:C05 | 10470 | 0 | 0 | 0 | 0 | 0 | 0 |
| M00001598A:G03 | 16999 | 1 | 1 | 1 | 0 | 0 | 0 |
| M00001601A:D08 | 22794 | 0 | 0 | 0 | 0 | 0 | 0 |
| M00001604A:B10 | 1399 | 0 | 0 | 0 | 0 | 0 | 0 |
| M00001604A:F05 | 39391 | 0 | 0 | 0 | 0 | 0 | 0 |
| M00001607A:E11 | 11465 | 0 | 0 | 0 | 0 | 0 | 0 |
| M00001608A:B03 | 7802 | 0 | 0 | 0 | 0 | 0 | 0 |
| M00001608B:E03 | 22155 | 0 | 0 | 0 | 0 | 0 | 0 |
| M00001614C:F10 | 13157 | 0 | 0 | 0 | 0 | 0 | 0 |
| M00001617C:E02 | 17004 | 0 | 0 | 0 | 0 | 1 | 0 |
| M00001619C:F12 | 40314 | 0 | 0 | 0 | 0 | 0 | 0 |
| M00001621C:C08 | 40044 | 0 | 1 | 0 | 0 | 0 | 0 |
| M00001623D:F10 | 13913 | 0 | 0 | 0 | 0 | 0 | 0 |
| M00001624A:B06 | 3277 | 0 | 0 | 0 | 0 | 0 | 0 |
| M00001624C:F01 | 4309 | 0 | 0 | 0 | 0 | 0 | 0 |
| M00001630B:H09 | 5214 | 1 | 0 | 0 | 1 | 1 | 0 |
| M00001644C:B07 | 39171 | 0 | 0 | 0 | 0 | 0 | 0 |
| M00001645A:C12 | 19267 | 0 | 0 | 0 | 0 | 1 | 0 |
| M00001648C:A01 | 4665 | 0 | 0 | 0 | 0 | 0 | 0 |
| M00001657D:C03 | 23201 | 0 | 0 | 0 | 0 | 0 | 0 |
| M00001657D:F08 | 76760 | 0 | 0 | 0 | 0 | 0 | 0 |
| M00001662C:A09 | 23218 | 0 | 0 | 0 | 0 | 0 | 0 |
| M00001663A:E04 | 35702 | 0 | 0 | 0 | 0 | 0 | 0 |
| M00001669B:F02 | 6468 | 0 | 0 | 0 | 0 | 0 | 0 |
| M00001670C:H02 | 14367 | 0 | 0 | 0 | 0 | 0 | 0 |
| M00001673C:H02 | 7015 | 0 | 0 | 0 | 0 | 0 | 0 |

TABLE 6-continued

| Clone Name | Cluster ID | Clones in Lib15 | Clones in Lib16b | Clones in Lib17 | Clones in Lib18 | Clones in Lib19 | Clones in Lib20 |
|---|---|---|---|---|---|---|---|
| M00001675A:C09 | 8773 | 0 | 0 | 0 | 0 | 0 | 0 |
| M00001676B:F05 | 11460 | 0 | 0 | 0 | 0 | 0 | 0 |
| M00001677C:E10 | 14627 | 0 | 1 | 0 | 0 | 0 | 0 |
| M00001677D:A07 | 7570 | 0 | 0 | 0 | 0 | 0 | 0 |
| M00001678D:F12 | 4416 | 0 | 0 | 0 | 0 | 0 | 0 |
| M00001679A:A06 | 6660 | 0 | 0 | 0 | 0 | 0 | 0 |
| M00001679A:F10 | 26875 | 0 | 0 | 0 | 0 | 0 | 0 |
| M00001679B:F01 | 6298 | 0 | 0 | 0 | 0 | 0 | 0 |
| M00001679C:F01 | 78091 | 0 | 0 | 0 | 0 | 0 | 0 |
| M00001679D:D03 | 10751 | 0 | 0 | 0 | 0 | 0 | 0 |
| M00001679D:D03 | 10751 | 0 | 0 | 0 | 0 | 0 | 0 |
| M00001680D:F08 | 10539 | 0 | 0 | 0 | 0 | 0 | 0 |
| M00001682C:B12 | 17055 | 0 | 0 | 0 | 0 | 0 | 0 |
| M00001686A:E06 | 4622 | 0 | 0 | 0 | 0 | 0 | 0 |
| M00001688C:F09 | 5382 | 0 | 0 | 0 | 0 | 0 | 0 |
| M00001693C:G01 | 4393 | 0 | 0 | 0 | 0 | 0 | 0 |
| M00001716D:H05 | 67252 | 0 | 0 | 0 | 0 | 0 | 0 |
| M00003741D:C09 | 40108 | 0 | 0 | 0 | 0 | 0 | 0 |
| M00003747D:C05 | 11476 | 0 | 0 | 0 | 0 | 0 | 0 |
| M00003759B:B09 | 697 | 0 | 0 | 0 | 0 | 1 | 0 |
| M00003762C:B08 | 17076 | 0 | 0 | 0 | 0 | 0 | 0 |
| M00003763A:F06 | 3108 | 0 | 0 | 0 | 0 | 0 | 0 |
| M00003774C:A03 | 67907 | 0 | 0 | 0 | 0 | 0 | 0 |
| M00003796C:D05 | 5619 | 0 | 0 | 0 | 0 | 0 | 0 |
| M00003826B:A06 | 11350 | 0 | 0 | 0 | 0 | 0 | 0 |
| M00003833A:E05 | 21877 | 0 | 0 | 0 | 0 | 0 | 0 |
| M00003837D:A01 | 7899 | 0 | 0 | 0 | 0 | 0 | 0 |
| M00003839A:D08 | 7798 | 0 | 0 | 0 | 0 | 0 | 0 |
| M00003844C:B11 | 6539 | 0 | 0 | 0 | 0 | 0 | 0 |
| M00003846B:D06 | 6874 | 0 | 0 | 1 | 0 | 0 | 0 |
| M00003851B:D10 | 13595 | 0 | 0 | 0 | 0 | 0 | 0 |
| M00003853A:D04 | 5619 | 0 | 0 | 0 | 0 | 0 | 0 |
| M00003853A:F12 | 10515 | 0 | 0 | 0 | 0 | 0 | 0 |
| M00003856B:C02 | 4622 | 0 | 0 | 0 | 0 | 0 | 0 |
| M00003857A:G10 | 3389 | 0 | 0 | 0 | 0 | 0 | 0 |
| M00003857A:H03 | 4718 | 0 | 0 | 0 | 0 | 0 | 0 |
| M00003871C:E02 | 4573 | 0 | 0 | 0 | 0 | 0 | 0 |
| M00003875B:F04 | 12977 | 0 | 0 | 0 | 0 | 0 | 0 |
| M00003875B:F04 | 12977 | 0 | 0 | 0 | 0 | 0 | 0 |
| M00003875C:G07 | 8479 | 0 | 0 | 0 | 0 | 0 | 1 |
| M00003876D:E12 | 7798 | 0 | 0 | 0 | 0 | 0 | 0 |
| M00003879B:C11 | 5345 | 0 | 0 | 0 | 2 | 0 | 1 |
| M00003879B:D10 | 31587 | 0 | 0 | 0 | 0 | 0 | 0 |
| M00003879D:A02 | 14507 | 0 | 0 | 0 | 0 | 0 | 0 |
| M00003885C:A02 | 13576 | 0 | 0 | 0 | 0 | 0 | 0 |
| M00003885C:A02 | 13576 | 0 | 0 | 0 | 0 | 0 | 0 |
| M00003906C:E10 | 9285 | 0 | 0 | 0 | 0 | 0 | 0 |
| M00003907D:A09 | 39809 | 0 | 0 | 0 | 0 | 0 | 0 |
| M00003907D:H04 | 16317 | 0 | 0 | 0 | 0 | 0 | 0 |
| M00003909D:C03 | 8672 | 0 | 0 | 0 | 0 | 0 | 0 |
| M00003912B:D01 | 12532 | 0 | 0 | 0 | 0 | 0 | 0 |
| M00003914C:F05 | 3900 | 0 | 0 | 0 | 0 | 1 | 0 |
| M00003922A:E06 | 23255 | 0 | 0 | 0 | 0 | 0 | 0 |
| M00003958A:H02 | 18957 | 0 | 0 | 0 | 0 | 0 | 0 |
| M00003958A:H02 | 18957 | 0 | 0 | 0 | 0 | 0 | 0 |
| M00003958C:G10 | 40455 | 0 | 0 | 0 | 0 | 0 | 0 |
| M00003958C:G10 | 40455 | 0 | 0 | 0 | 0 | 0 | 0 |
| M00003968B:F06 | 24488 | 0 | 0 | 0 | 0 | 0 | 0 |
| M00003970C:B09 | 40122 | 0 | 0 | 0 | 0 | 0 | 0 |
| M00003974D:E07 | 23210 | 0 | 0 | 0 | 0 | 0 | 0 |
| M00003974D:H02 | 23358 | 0 | 0 | 0 | 0 | 0 | 0 |
| M00003975A:G11 | 12439 | 0 | 0 | 0 | 0 | 0 | 0 |
| M00003978B:G05 | 5693 | 0 | 0 | 0 | 0 | 0 | 0 |
| M00003981A:E10 | 3430 | 0 | 0 | 0 | 0 | 1 | 0 |
| M00003982C:C02 | 2433 | 0 | 0 | 0 | 0 | 0 | 0 |
| M00003983A:A05 | 9105 | 0 | 0 | 0 | 0 | 0 | 0 |
| M00004028D:A06 | 6124 | 0 | 0 | 0 | 0 | 0 | 0 |
| M00004028D:C05 | 40073 | 0 | 0 | 0 | 0 | 0 | 0 |
| M00004031A:A12 | 9061 | 0 | 0 | 0 | 0 | 0 | 0 |
| M00004031A:A12 | 9061 | 0 | 0 | 0 | 0 | 0 | 0 |
| M00004035C:A07 | 37285 | 0 | 0 | 0 | 0 | 0 | 0 |
| M00004035D:B06 | 17036 | 0 | 0 | 0 | 0 | 0 | 0 |
| M00004059A:D06 | 5417 | 0 | 0 | 0 | 0 | 0 | 0 |
| M00004068B:A01 | 3706 | 0 | 0 | 0 | 0 | 0 | 0 |
| M00004072B:B05 | 17036 | 0 | 0 | 0 | 0 | 0 | 0 |
| M00004081C:D10 | 15069 | 0 | 0 | 0 | 0 | 0 | 0 |
| M00004081C:D12 | 14391 | 0 | 0 | 0 | 0 | 0 | 0 |

TABLE 6-continued

| Clone Name | Cluster ID | Clones in Lib15 | Clones in Lib16b | Clones in Lib17 | Clones in Lib18 | Clones in Lib19 | Clones in Lib20 |
|---|---|---|---|---|---|---|---|
| M00004086D:G06 | 9285 | 0 | 0 | 0 | 0 | 0 | 0 |
| M00004087D:A01 | 6880 | 0 | 0 | 0 | 0 | 0 | 0 |
| M00004093D:B12 | 5325 | 1 | 1 | 0 | 1 | 0 | 1 |
| M00004093D:B12 | 5325 | 1 | 1 | 0 | 1 | 0 | 1 |
| M00004105C:A04 | 7221 | 0 | 0 | 0 | 0 | 0 | 0 |
| M00004108A:E06 | 4937 | 0 | 0 | 0 | 0 | 0 | 0 |
| M00004111D:A08 | 6874 | 0 | 0 | 1 | 0 | 0 | 0 |
| M00004114C:F11 | 13183 | 0 | 0 | 0 | 0 | 0 | 0 |
| M00004138B:H02 | 13272 | 0 | 0 | 0 | 0 | 0 | 0 |
| M00004146C:C11 | 5257 | 0 | 1 | 0 | 0 | 0 | 0 |
| M00004151D:B08 | 16977 | 0 | 0 | 0 | 0 | 0 | 0 |
| M00004157C:A09 | 6455 | 0 | 0 | 0 | 0 | 0 | 0 |
| M00004169C:C12 | 5319 | 0 | 0 | 0 | 0 | 0 | 0 |
| M00004171D:B03 | 4908 | 0 | 0 | 0 | 0 | 0 | 0 |
| M00004172C:D08 | 11494 | 0 | 0 | 0 | 0 | 0 | 0 |
| M00004183C:D07 | 16392 | 0 | 0 | 0 | 0 | 0 | 0 |
| M00004185C:C03 | 11443 | 0 | 0 | 0 | 0 | 0 | 0 |
| M00004197D:H01 | 8210 | 0 | 0 | 0 | 0 | 0 | 0 |
| M00004203B:C12 | 14311 | 0 | 0 | 0 | 0 | 0 | 0 |
| M00004212B:C07 | 2379 | 0 | 0 | 0 | 0 | 0 | 0 |
| M00004214C:H05 | 11451 | 0 | 0 | 0 | 0 | 0 | 0 |
| M00004223A:G10 | 16918 | 0 | 0 | 0 | 0 | 0 | 0 |
| M00004223B:D09 | 7899 | 0 | 0 | 0 | 0 | 0 | 0 |
| M00004223D:E04 | 12971 | 0 | 0 | 0 | 0 | 0 | 0 |
| M00004229B:F08 | 6455 | 0 | 0 | 0 | 0 | 0 | 0 |
| M00004230B:C07 | 7212 | 0 | 0 | 0 | 0 | 0 | 0 |
| M00004269D:D06 | 4905 | 0 | 0 | 0 | 0 | 0 | 0 |
| M00004275C:C11 | 16914 | 0 | 0 | 0 | 0 | 0 | 0 |
| M00004283C:A04 | 14286 | 0 | 0 | 0 | 0 | 0 | 0 |
| M00004285B:E08 | 56020 | 0 | 0 | 0 | 0 | 0 | 0 |
| M00004295D:F12 | 16921 | 0 | 0 | 0 | 0 | 0 | 0 |
| M00004296C:H07 | 13046 | 0 | 0 | 0 | 0 | 0 | 0 |
| M00004307C:A06 | 9457 | 0 | 0 | 0 | 0 | 0 | 0 |
| M00004312A:G03 | 26295 | 0 | 0 | 0 | 0 | 0 | 0 |
| M00004318C:D10 | 21847 | 0 | 0 | 0 | 0 | 0 | 0 |
| M00004372A:A03 | 2030 | 0 | 0 | 0 | 0 | 0 | 0 |
| M00004377C:F05 | 2102 | 0 | 0 | 0 | 0 | 0 | 0 |

TABLE 7

| Clone Name | Cluster ID | Clones in Lib12 | Clones in Lib13 | Clones in Lib14 |
|---|---|---|---|---|
| M00001340B:A06 | 17062 | 0 | 0 | 0 |
| M00001340D:F10 | 11589 | 0 | 0 | 0 |
| M00001341A:E12 | 4443 | 4 | 2 | 0 |
| M00001342B:E06 | 39805 | 0 | 0 | 0 |
| M00001343C:F10 | 2790 | 0 | 0 | 0 |
| M00001343D:H07 | 23255 | 0 | 0 | 0 |
| M00001345A:E01 | 6420 | 0 | 0 | 0 |
| M00001346A:F09 | 5007 | 0 | 0 | 0 |
| M00001346D:E03 | 6806 | 0 | 1 | 1 |
| M00001346D:G06 | 5779 | 0 | 0 | 0 |
| M00001346D:G06 | 5779 | 0 | 0 | 0 |
| M00001347A:B10 | 13576 | 0 | 0 | 0 |
| M00001348B:B04 | 16927 | 0 | 0 | 0 |
| M00001348B:G06 | 16985 | 0 | 0 | 0 |
| M00001349B:B08 | 3584 | 0 | 0 | 0 |
| M00001350A:H01 | 7187 | 0 | 0 | 0 |
| M00001351A:A08 | 3162 | 0 | 0 | 1 |
| M00001351B:A08 | 3162 | 0 | 0 | 1 |
| M00001352A:E02 | 16245 | 0 | 0 | 0 |
| M00001353A:G12 | 8078 | 0 | 0 | 0 |
| M00001353D:D10 | 14929 | 0 | 1 | 0 |
| M00001355B:G10 | 14391 | 0 | 0 | 0 |
| M00001357D:D11 | 4059 | 0 | 0 | 0 |
| M00001361A:A05 | 4141 | 1 | 2 | 1 |
| M00001361D:F08 | 2379 | 0 | 0 | 0 |
| M00001362B:D10 | 5622 | 0 | 2 | 1 |
| M00001362C:H11 | 945 | 0 | 0 | 0 |
| M00001365C:C10 | 40132 | 0 | 0 | 0 |
| M00001370A:C09 | 6867 | 0 | 0 | 0 |
| M00001371C:E09 | 7172 | 0 | 0 | 1 |
| M00001376B:G06 | 17732 | 2 | 0 | 0 |
| M00001378B:B02 | 39833 | 0 | 0 | 0 |
| M00001379A:A05 | 1334 | 0 | 0 | 0 |
| M00001380D:B09 | 39886 | 0 | 0 | 0 |
| M00001382C:A02 | 22979 | 1 | 0 | 0 |
| M00001383A:C03 | 39648 | 0 | 0 | 0 |
| M00001383A:C03 | 39648 | 0 | 0 | 0 |
| M00001386C:B12 | 5178 | 0 | 0 | 0 |
| M00001387A:C05 | 2464 | 0 | 0 | 0 |
| M00001387B:G03 | 7587 | 0 | 0 | 0 |
| M00001388D:G05 | 5832 | 0 | 0 | 0 |
| M00001389A:C08 | 16269 | 2 | 0 | 0 |
| M00001394A:F01 | 6583 | 0 | 0 | 0 |
| M00001395A:C03 | 4016 | 0 | 0 | 0 |
| M00001396A:C03 | 4009 | 2 | 0 | 0 |
| M00001402A:E08 | 39563 | 0 | 0 | 0 |
| M00001407B:D11 | 5556 | 0 | 0 | 0 |
| M00001409C:D12 | 9577 | 0 | 0 | 0 |
| M00001410A:D07 | 7005 | 0 | 0 | 0 |
| M00001412B:B10 | 8551 | 0 | 0 | 0 |
| M00001415A:H06 | 13538 | 0 | 0 | 0 |
| M00001416A:H01 | 7674 | 0 | 0 | 0 |
| M00001416B:H11 | 8847 | 1 | 0 | 0 |
| M00001417A:E02 | 36393 | 0 | 0 | 0 |
| M00001418B:F03 | 9952 | 0 | 0 | 0 |
| M00001418D:B06 | 8526 | 0 | 0 | 0 |
| M00001421C:F01 | 9577 | 0 | 0 | 0 |
| M00001423B:E07 | 15066 | 0 | 0 | 0 |
| M00001424B:G09 | 10470 | 0 | 0 | 0 |
| M00001425B:H08 | 22195 | 0 | 0 | 0 |
| M00001426D:C08 | 4261 | 0 | 0 | 0 |
| M00001428A:H10 | 84182 | 0 | 0 | 0 |

TABLE 7-continued

| Clone Name | Cluster ID | Clones in Lib12 | Clones in Lib13 | Clones in Lib14 |
|---|---|---|---|---|
| M00001429A:H04 | 2797 | 0 | 0 | 0 |
| M00001429B:A11 | 4635 | 0 | 0 | 0 |
| M00001429D:D07 | 40392 | 0 | 0 | 0 |
| M00001439C:F08 | 40054 | 0 | 0 | 0 |
| M00001442C:D07 | 16731 | 0 | 0 | 0 |
| M00001445A:F05 | 13532 | 0 | 0 | 0 |
| M00001446A:F05 | 7801 | 0 | 1 | 0 |
| M00001447A:G03 | 10717 | 0 | 0 | 0 |
| M00001448D:C09 | 8 | 7 | 6 | 9 |
| M00001448D:H01 | 36313 | 1 | 0 | 0 |
| M00001449A:A12 | 5857 | 0 | 0 | 0 |
| M00001449A:B12 | 41633 | 0 | 0 | 0 |
| M00001449A:D12 | 3681 | 1 | 0 | 0 |
| M00001449A:G10 | 36535 | 0 | 0 | 0 |
| M00001449C:D06 | 86110 | 0 | 0 | 0 |
| M00001450A:A02 | 39304 | 0 | 1 | 0 |
| M00001450A:A11 | 32663 | 0 | 0 | 0 |
| M00001450A:B12 | 82498 | 0 | 0 | 0 |
| M00001450A:D08 | 27250 | 0 | 0 | 0 |
| M00001452A:B04 | 84328 | 0 | 0 | 0 |
| M00001452A:B12 | 86859 | 0 | 0 | 0 |
| M00001452A:D08 | 1120 | 0 | 0 | 0 |
| M00001452A:F05 | 85064 | 0 | 0 | 0 |
| M00001452C:B06 | 16970 | 1 | 0 | 0 |
| M00001453A:E11 | 16130 | 0 | 0 | 0 |
| M00001453C:F06 | 16653 | 0 | 0 | 0 |
| M00001454A:A09 | 83103 | 0 | 0 | 0 |
| M00001454B:C12 | 7005 | 0 | 0 | 0 |
| M00001454D:G03 | 689 | 0 | 0 | 1 |
| M00001455A:E09 | 13238 | 0 | 0 | 0 |
| M00001455B:E12 | 13072 | 0 | 0 | 0 |
| M00001455D:F09 | 9283 | 0 | 0 | 0 |
| M00001455D:F09 | 9283 | 0 | 0 | 0 |
| M00001460A:F06 | 2448 | 0 | 0 | 0 |
| M00001460A:F12 | 39498 | 0 | 0 | 0 |
| M00001461A:D06 | 1531 | 0 | 0 | 1 |
| M00001463C:B11 | 19 | 17 | 32 | 31 |
| M00001465A:B11 | 10145 | 0 | 0 | 0 |
| M00001466A:E07 | 4275 | 0 | 0 | 0 |
| M00001467A:B07 | 38759 | 0 | 0 | 0 |
| M00001467A:D04 | 39508 | 0 | 0 | 0 |
| M00001467A:D08 | 16283 | 0 | 0 | 0 |
| M00001467A:D08 | 16283 | 0 | 0 | 0 |
| M00001467A:E10 | 39442 | 0 | 0 | 0 |
| M00001468A:F05 | 7589 | 0 | 0 | 0 |
| M00001469A:C10 | 12081 | 0 | 0 | 0 |
| M00001469A:H12 | 19105 | 0 | 0 | 0 |
| M00001470A:B10 | 1037 | 0 | 0 | 0 |
| M00001470A:C04 | 39425 | 0 | 0 | 0 |
| M00001471A:B01 | 39478 | 0 | 0 | 0 |
| M00001481D:A05 | 7985 | 0 | 0 | 0 |
| M00001490B:C04 | 18699 | 0 | 0 | 0 |
| M00001494D:F06 | 7206 | 0 | 0 | 0 |
| M00001497A:G02 | 2623 | 1 | 0 | 0 |
| M00001499B:A11 | 10539 | 0 | 1 | 0 |
| M00001500A:C05 | 5336 | 0 | 0 | 0 |
| M00001500A:E11 | 2623 | 1 | 0 | 0 |
| M00001500C:E04 | 9443 | 0 | 0 | 0 |
| M00001501D:C02 | 9685 | 0 | 0 | 0 |
| M00001504C:A07 | 10185 | 0 | 0 | 0 |
| M00001504C:H06 | 6974 | 0 | 0 | 0 |
| M00001504D:G06 | 6420 | 0 | 0 | 0 |
| M00001507A:H05 | 39168 | 0 | 0 | 0 |
| M00001511A:H06 | 39412 | 0 | 0 | 0 |
| M00001512A:A09 | 39186 | 0 | 0 | 0 |
| M00001512D:G09 | 3956 | 0 | 0 | 0 |
| M00001513A:B06 | 4568 | 0 | 0 | 0 |
| M00001513C:E08 | 14364 | 0 | 0 | 0 |
| M00001514C:D11 | 40044 | 0 | 0 | 0 |
| M00001517A:B07 | 4313 | 0 | 0 | 0 |
| M00001518C:B11 | 8952 | 0 | 0 | 0 |
| M00001528A:C04 | 7337 | 1 | 2 | 2 |
| M00001528A:F09 | 18957 | 0 | 0 | 0 |
| M00001528B:H04 | 8358 | 0 | 0 | 0 |
| M00001531A:D01 | 38085 | 0 | 0 | 0 |
| M00001532B:A06 | 3990 | 0 | 0 | 0 |
| M00001533A:C11 | 2428 | 0 | 0 | 0 |
| M00001534A:C04 | 16921 | 0 | 0 | 0 |
| M00001534A:D09 | 5097 | 0 | 0 | 0 |
| M00001534A:F09 | 5321 | 4 | 7 | 6 |
| M00001534C:A01 | 4119 | 0 | 0 | 0 |
| M00001535A:B01 | 7665 | 0 | 2 | 4 |
| M00001535A:C06 | 20212 | 0 | 0 | 0 |
| M00001535A:F10 | 39423 | 0 | 0 | 0 |
| M00001536A:B07 | 2696 | 0 | 0 | 0 |
| M00001536A:C08 | 39392 | 0 | 0 | 0 |
| M00001537A:F12 | 39420 | 0 | 0 | 0 |
| M00001537B:G07 | 3389 | 0 | 0 | 0 |
| M00001540A:D06 | 8286 | 0 | 0 | 0 |
| M00001541A:D02 | 3765 | 0 | 0 | 0 |
| M00001541A:F07 | 22085 | 0 | 0 | 0 |
| M00001541A:H03 | 39174 | 0 | 0 | 0 |
| M00001542A:A09 | 22113 | 0 | 0 | 0 |
| M00001542A:E06 | 39453 | 0 | 0 | 0 |
| M00001544A:E03 | 12170 | 0 | 0 | 0 |
| M00001544A:G02 | 19829 | 0 | 0 | 0 |
| M00001544B:B07 | 6974 | 0 | 0 | 0 |
| M00001545A:C03 | 19255 | 0 | 0 | 0 |
| M00001545A:D08 | 13864 | 0 | 0 | 0 |
| M00001546A:G11 | 1267 | 0 | 0 | 0 |
| M00001548A:E10 | 5892 | 0 | 1 | 0 |
| M00001548A:H09 | 1058 | 1 | 3 | 0 |
| M00001549A:B02 | 4015 | 0 | 1 | 0 |
| M00001549A:D08 | 10944 | 1 | 0 | 0 |
| M00001549B:F06 | 4193 | 0 | 0 | 0 |
| M00001549C:E06 | 16347 | 0 | 0 | 0 |
| M00001550A:A03 | 7239 | 0 | 1 | 0 |
| M00001550A:G01 | 5175 | 1 | 0 | 0 |
| M00001551A:B10 | 6268 | 0 | 0 | 1 |
| M00001551A:F05 | 39180 | 0 | 0 | 0 |
| M00001551A:G06 | 22390 | 0 | 0 | 1 |
| M00001551C:G09 | 3266 | 0 | 0 | 0 |
| M00001552A:B12 | 307 | 6 | 11 | 4 |
| M00001552A:D11 | 39458 | 0 | 0 | 0 |
| M00001552B:D04 | 5708 | 0 | 0 | 0 |
| M00001553A:H06 | 8298 | 0 | 0 | 0 |
| M00001553B:F12 | 4573 | 0 | 0 | 0 |
| M00001553D:D10 | 22814 | 0 | 0 | 0 |
| M00001555A:B02 | 39539 | 0 | 0 | 0 |
| M00001555A:C01 | 39195 | 0 | 0 | 0 |
| M00001555D:G10 | 4561 | 0 | 0 | 0 |
| M00001556A:C09 | 9244 | 0 | 1 | 0 |
| M00001556A:F11 | 1577 | 0 | 0 | 2 |
| M00001556A:H01 | 15855 | 1 | 1 | 0 |
| M00001556B:C08 | 4386 | 3 | 0 | 1 |
| M00001556B:G02 | 11294 | 0 | 0 | 0 |
| M00001557A:D02 | 7065 | 0 | 0 | 0 |
| M00001557A:D02 | 7065 | 0 | 0 | 0 |
| M00001557A:F01 | 9635 | 0 | 0 | 0 |
| M00001557A:F03 | 39490 | 0 | 0 | 0 |
| M00001557B:H10 | 5192 | 0 | 0 | 0 |
| M00001557D:D09 | 8761 | 0 | 0 | 0 |
| M00001558B:H11 | 7514 | 0 | 0 | 0 |
| M00001560D:F10 | 6558 | 0 | 0 | 0 |
| M00001561A:C05 | 39486 | 0 | 0 | 0 |
| M00001563B:F06 | 102 | 2 | 1 | 2 |
| M00001564A:B12 | 5053 | 0 | 0 | 0 |
| M00001571C:H06 | 5749 | 0 | 0 | 0 |
| M00001578B:E04 | 23001 | 0 | 0 | 0 |
| M00001579D:C03 | 6539 | 0 | 0 | 0 |
| M00001583D:A10 | 6293 | 0 | 0 | 0 |
| M00001586C:C05 | 4623 | 0 | 0 | 0 |
| M00001587A:B11 | 39380 | 0 | 0 | 0 |
| M00001594B:H04 | 260 | 1 | 0 | 0 |
| M00001597C:H02 | 4837 | 1 | 0 | 0 |
| M00001597D:C05 | 10470 | 0 | 0 | 0 |
| M00001598A:G03 | 16999 | 4 | 2 | 6 |
| M00001601A:D08 | 22794 | 0 | 0 | 0 |
| M00001604A:B10 | 1399 | 6 | 3 | 3 |
| M00001604A:F05 | 39391 | 0 | 0 | 0 |
| M00001607A:E11 | 11465 | 0 | 0 | 0 |
| M00001608A:B03 | 7802 | 0 | 0 | 0 |
| M00001608B:E03 | 22155 | 0 | 0 | 0 |
| M00001614C:F10 | 13157 | 0 | 0 | 0 |

TABLE 7-continued

| Clone Name | Cluster ID | Clones in Lib12 | Clones in Lib13 | Clones in Lib14 |
|---|---|---|---|---|
| M00001617C:E02 | 17004 | 0 | 0 | 0 |
| M00001619C:F12 | 40314 | 0 | 0 | 0 |
| M00001621C:C08 | 40044 | 0 | 0 | 0 |
| M00001623D:F10 | 13913 | 0 | 0 | 0 |
| M00001624A:B06 | 3277 | 0 | 0 | 0 |
| M00001624C:F01 | 4309 | 0 | 0 | 0 |
| M00001630B:H09 | 5214 | 0 | 1 | 2 |
| M00001644C:B07 | 39171 | 0 | 0 | 0 |
| M00001645A:C12 | 19267 | 0 | 0 | 0 |
| M00001648C:A01 | 4665 | 0 | 0 | 0 |
| M00001657D:C03 | 23201 | 0 | 0 | 0 |
| M00001657D:F08 | 76760 | 0 | 0 | 0 |
| M00001662C:A09 | 23218 | 0 | 0 | 0 |
| M00001663A:E04 | 35702 | 0 | 0 | 0 |
| M00001669B:F02 | 6468 | 0 | 0 | 0 |
| M00001670C:H02 | 14367 | 0 | 0 | 0 |
| M00001673C:H02 | 7015 | 0 | 0 | 0 |
| M00001675A:C09 | 8773 | 0 | 0 | 0 |
| M00001676B:F05 | 11460 | 2 | 0 | 0 |
| M00001677C:E10 | 14627 | 0 | 0 | 0 |
| M00001677D:A07 | 7570 | 0 | 0 | 0 |
| M00001678D:F12 | 4416 | 1 | 2 | 0 |
| M00001679A:A06 | 6660 | 0 | 0 | 0 |
| M00001679A:F10 | 26875 | 0 | 0 | 0 |
| M00001679B:F01 | 6298 | 0 | 0 | 0 |
| M00001679C:F01 | 78091 | 0 | 0 | 0 |
| M00001679D:D03 | 10751 | 0 | 0 | 0 |
| M00001679D:D03 | 10751 | 0 | 0 | 0 |
| M00001680D:F08 | 10539 | 0 | 1 | 0 |
| M00001682C:B12 | 17055 | 0 | 0 | 0 |
| M00001686A:E06 | 4622 | 0 | 0 | 0 |
| M00001688C:F09 | 5382 | 0 | 0 | 0 |
| M00001693C:G01 | 4393 | 0 | 0 | 0 |
| M00001716D:H05 | 67252 | 0 | 0 | 0 |
| M00003741D:C09 | 40108 | 0 | 0 | 0 |
| M00003747D:C05 | 11476 | 0 | 0 | 0 |
| M00003759B:B09 | 697 | 0 | 0 | 0 |
| M00003762C:B08 | 17076 | 0 | 0 | 0 |
| M00003763A:F06 | 3108 | 0 | 0 | 0 |
| M00003774C:A03 | 67907 | 0 | 0 | 0 |
| M00003796C:D05 | 5619 | 0 | 1 | 0 |
| M00003826B:A06 | 11350 | 0 | 0 | 0 |
| M00003833A:E05 | 21877 | 0 | 0 | 0 |
| M00003837D:A01 | 7899 | 0 | 0 | 0 |
| M00003839A:D08 | 7798 | 0 | 0 | 0 |
| M00003844C:B11 | 6539 | 0 | 0 | 0 |
| M00003846B:D06 | 6874 | 0 | 0 | 0 |
| M00003851B:D10 | 13595 | 0 | 0 | 0 |
| M00003853A:D04 | 5619 | 0 | 1 | 0 |
| M00003853A:F12 | 10515 | 0 | 0 | 1 |
| M00003856B:C02 | 4622 | 0 | 0 | 0 |
| M00003857A:G10 | 3389 | 0 | 0 | 0 |
| M00003857A:H03 | 4718 | 0 | 0 | 0 |
| M00003871C:E02 | 4573 | 0 | 0 | 0 |
| M00003875B:F04 | 12977 | 0 | 0 | 0 |
| M00003875B:F04 | 12977 | 0 | 0 | 0 |
| M00003875C:G07 | 8479 | 1 | 0 | 0 |
| M00003876D:E12 | 7798 | 0 | 0 | 0 |
| M00003879B:C11 | 5345 | 4 | 8 | 3 |
| M00003879B:D10 | 31587 | 0 | 0 | 0 |
| M00003879D:A02 | 14507 | 0 | 0 | 0 |
| M00003885C:A02 | 13576 | 0 | 0 | 0 |
| M00003885C:A02 | 13576 | 0 | 0 | 0 |
| M00003906C:E10 | 9285 | 0 | 0 | 0 |
| M00003907D:A09 | 39809 | 0 | 0 | 0 |
| M00003907D:H04 | 16317 | 0 | 0 | 0 |
| M00003909D:C03 | 8672 | 0 | 0 | 0 |
| M00003912B:D01 | 12532 | 0 | 0 | 0 |
| M00003914C:F05 | 3900 | 0 | 1 | 0 |
| M00003922A:E06 | 23255 | 0 | 0 | 0 |
| M00003958A:H02 | 18957 | 0 | 0 | 0 |
| M00003958A:H02 | 18957 | 0 | 0 | 0 |
| M00003958C:G10 | 40455 | 0 | 0 | 0 |
| M00003958C:G10 | 40455 | 0 | 0 | 0 |
| M00003968B:F06 | 24488 | 0 | 0 | 0 |
| M00003970C:B09 | 40122 | 0 | 0 | 0 |
| M00003974D:E07 | 23210 | 0 | 0 | 0 |
| M00003974D:H02 | 23358 | 0 | 0 | 0 |
| M00003975A:G11 | 12439 | 0 | 0 | 0 |
| M00003978B:G05 | 5693 | 0 | 0 | 0 |
| M00003981A:E10 | 3430 | 0 | 0 | 0 |
| M00003982C:C02 | 2433 | 2 | 4 | 0 |
| M00003983A:A05 | 9105 | 0 | 0 | 0 |
| M00004028D:A06 | 6124 | 0 | 0 | 0 |
| M00004028D:C05 | 40073 | 0 | 1 | 0 |
| M00004031A:A12 | 9061 | 0 | 0 | 0 |
| M00004031A:A12 | 9061 | 0 | 0 | 0 |
| M00004035C:A07 | 37285 | 0 | 0 | 0 |
| M00004035D:B06 | 17036 | 0 | 0 | 0 |
| M00004059A:D06 | 5417 | 0 | 0 | 0 |
| M00004068B:A01 | 3706 | 0 | 0 | 0 |
| M00004072B:B05 | 17036 | 0 | 0 | 0 |
| M00004081C:D10 | 15069 | 0 | 0 | 0 |
| M00004081C:D12 | 14391 | 0 | 0 | 0 |
| M00004086D:G06 | 9285 | 0 | 0 | 0 |
| M00004087D:A01 | 6880 | 0 | 0 | 0 |
| M00004093D:B12 | 5325 | 0 | 0 | 0 |
| M00004093D:B12 | 5325 | 0 | 0 | 0 |
| M00004105C:A04 | 7221 | 0 | 0 | 0 |
| M00004108A:E06 | 4937 | 0 | 0 | 0 |
| M00004111D:A08 | 6874 | 0 | 0 | 0 |
| M00004114C:F11 | 13183 | 0 | 0 | 0 |
| M00004138B:H02 | 13272 | 0 | 0 | 0 |
| M00004146C:C11 | 5257 | 0 | 0 | 1 |
| M00004151D:B08 | 16977 | 0 | 0 | 0 |
| M00004157C:A09 | 6455 | 0 | 0 | 0 |
| M00004169C:C12 | 5319 | 0 | 0 | 0 |
| M00004171D:B03 | 4908 | 0 | 0 | 0 |
| M00004172C:D08 | 11494 | 0 | 0 | 0 |
| M00004183C:D07 | 16392 | 0 | 0 | 0 |
| M00004185C:C03 | 11443 | 2 | 0 | 0 |
| M00004197D:H01 | 8210 | 0 | 0 | 0 |
| M00004203B:C12 | 14311 | 0 | 0 | 0 |
| M00004212B:C07 | 2379 | 0 | 0 | 0 |
| M00004214C:H05 | 11451 | 0 | 0 | 0 |
| M00004223A:G10 | 16918 | 0 | 0 | 0 |
| M00004223B:D09 | 7899 | 0 | 0 | 0 |
| M00004223D:E04 | 12971 | 0 | 0 | 0 |
| M00004229B:F08 | 6455 | 0 | 0 | 0 |
| M00004230B:C07 | 7212 | 0 | 0 | 1 |
| M00004269D:D06 | 4905 | 0 | 0 | 0 |
| M00004275C:C11 | 16914 | 0 | 0 | 0 |
| M00004283B:A04 | 14286 | 0 | 0 | 0 |
| M00004285B:E08 | 56020 | 0 | 0 | 0 |
| M00004295D:F12 | 16921 | 0 | 0 | 0 |
| M00004296C:H07 | 13046 | 0 | 0 | 0 |
| M00004307C:A06 | 9457 | 1 | 0 | 0 |
| M00004312A:G03 | 26295 | 0 | 0 | 0 |
| M00004318C:D10 | 21847 | 0 | 0 | 0 |
| M00004372A:A03 | 2030 | 0 | 0 | 0 |
| M00004377C:F05 | 2102 | 0 | 0 | 0 |

Example 5

Polynucleotides Differentially Expressed in High Metastatic Potential Breast Cancer Cells Versus Low Metastatic Breast Cancer Cells A number of polynucleotide sequences have been identified that are differentially expressed between cells derived from high metastatic potential breast cancer tissue and low metastatic breast cancer cells. Expression of these sequences in breast cancer can be valuable in determining diagnostic, prognostic and/or treatment information. For example, sequences that are highly expressed in the high metastatic potential cells can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

The differential expression of these polynucleotides can be used as a diagnostic marker, a prognostic marker, for risk assessment, patient treatment and the like. These polynucleotide sequences can also be used in combination with other known molecular and/or biochemical markers.

The following table summarizes identified polynucleotides with differential expression between high metastatic potential breast cancer cells and low metastatic potential breast cancer cells.

prognostic and/or treatment information. For example, sequences that are highly expressed in the high metastatic potential cells are associated can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

TABLE 8

Differentially expressed polynucleotides: High metastatic potential breast cancer vs. low metastatic breast cancer cells

| SEQ ID NO. | Differential Expression | Cluster ID | Clones in 1$^{st}$ Library | Clones in 2$^{nd}$ Library | Ratio |
|---|---|---|---|---|---|
| 9 | High Breast > Low Breast (Lib3 > Lib4) | 2623 | 31 | 4 | 7.561356 |
| 42 | High Breast > Low Breast (Lib3 > Lib4) | 307 | 196 | 75 | 2.549721 |
| 52 | High Breast > Low Breast (Lib3 > Lib4) | 19 | 1364 | 525 | 2.534854 |
| 62 | High Breast > Low Breast (Lib3 > Lib4) | 2623 | 31 | 4 | 7.561356 |
| 65 | High Breast > Low Breast (Lib3 > Lib4) | 5749 | 9 | 0 | 8.780930 |
| 66 | High Breast > Low Breast (Lib3 > Lib4) | 6455 | 6 | 0 | 5.853953 |
| 68 | High Breast > Low Breast (Lib3 > Lib4) | 6455 | 6 | 0 | 5.853953 |
| 114 | High Breast > Low Breast (Lib3 > Lib4) | 2030 | 32 | 4 | 7.805271 |
| 123 | High Breast > Low Breast (Lib3 > Lib4) | 3389 | 13 | 2 | 6.341782 |
| 144 | High Breast > Low Breast (Lib3 > Lib4) | 4623 | 12 | 2 | 5.853953 |
| 172 | High Breast > Low Breast (Lib3 > Lib4) | 102 | 278 | 116 | 2.338217 |
| 178 | High Breast > Low Breast (Lib3 > Lib4) | 3681 | 10 | 1 | 9.756589 |
| 214 | High Breast > Low Breast (Lib3 > Lib4) | 3900 | 8 | 1 | 7.805271 |
| 219 | High Breast > Low Breast (Lib3 > Lib4) | 3389 | 13 | 2 | 6.341782 |
| 223 | High Breast > Low Breast (Lib3 > Lib4) | 1399 | 19 | 7 | 2.648217 |
| 258 | High Breast > Low Breast (Lib3 > Lib4) | 4837 | 10 | 0 | 9.756589 |
| 317 | High Breast > Low Breast (Lib3 > Lib4) | 1577 | 25 | 3 | 8.130490 |
| 379 | High Breast > Low Breast (Lib3 > Lib4) | 260 | 27 | 2 | 13.17139 |
| 4 | Low Breast > High Breast (Lib4 > Lib3) | 3706 | 22 | 4 | 5.637215 |
| 39 | Low Breast > High Breast (Lib4 > Lib3) | 4016 | 6 | 0 | 6.149690 |
| 74 | Low Breast > High Breast (Lib4 > Lib3) | 6268 | 18 | 3 | 6.149690 |
| 81 | Low Breast > High Breast (Lib4 > Lib3) | 40392 | 8 | 1 | 8.199586 |
| 130 | Low Breast > High Breast (Lib4 > Lib3) | 13183 | 7 | 0 | 7.174638 |
| 157 | Low Breast > High Breast (Lib4 > Lib3) | 5417 | 9 | 0 | 9.224535 |
| 162 | Low Breast > High Breast (Lib4 > Lib3) | 9685 | 7 | 0 | 7.174638 |
| 183 | Low Breast > High Breast (Lib4 > Lib3) | 7337 | 16 | 3 | 5.466391 |
| 202 | Low Breast > High Breast (Lib4 > Lib3) | 6124 | 9 | 1 | 9.224535 |
| 298 | Low Breast > High Breast (Lib4 > Lib3) | 1037 | 22 | 4 | 5.637215 |
| 338 | Low Breast > High Breast (Lib4 > Lib3) | 689 | 36 | 17 | 2.170478 |
| 384 | Low Breast > High Breast (Lib4 > Lib3) | 697 | 72 | 30 | 2.459876 |
| 386 | Low Breast > High Breast (Lib4 > Lib3) | 4568 | 9 | 0 | 9.224535 |
| 388 | Low Breast > High Breast (Lib4 > Lib3) | 5622 | 13 | 2 | 6.662164 |

Example 6

Polynucleotides Differentially Expressed in High Metastatic Potential Lung Cancer Cells Versus Low Metastatic Lung Cancer Cells A number of polynucleotide sequences have been identified that are differentially expressed between cells derived from high metastatic potential lung cancer tissue and low metastatic lung cancer cells. Expression of these sequences in lung cancer tissue can be valuable in determining diagnostic, The differential expression of these polynucleotides can be used as a diagnostic marker, a prognostic marker, for risk assessment, patient treatment and the like. These polynucleotide sequences can also be used in combination with other known molecular and/or biochemical markers.

The following table summarizes identified polynucleotides with differential expression between high metastatic potential lung cancer cells and low metastatic potential lung cancer cells:

TABLE 9

Differentially expressed polynucleotides: High metastatic potential lung cancer vs. low metastatic lung cancer cells

| SEQ ID NO. | Differential Expression | Cluster ID | Clones in 1st Library | Clones in 2nd Library | Ratio |
|---|---|---|---|---|---|
| 400 | High Lung > Low Lung (Lib8 > Lib 9) | 14929 | 23 | 16 | 2.008868 |
| 9 | High Lung > Low Lung (Lib8 > Lib9) | 2623 | 6 | 1 | 8.384840 |
| 34 | High Lung > Low Lung (Lib8 > Lib9) | 5832 | 5 | 0 | 6.987366 |
| 42 | High Lung > Low Lung (Lib8 > Lib9) | 307 | 79 | 27 | 4.088903 |
| 62 | High Lung > Low Lung (Lib8 > Lib9) | 2623 | 6 | 1 | 8.384840 |
| 74 | High Lung > Low Lung (Lib8 > Lib9) | 6268 | 5 | 0 | 6.987366 |
| 106 | High Lung > Low Lung (Lib8 > Lib9) | 10717 | 8 | 0 | 11.17978 |
| 119 | High Lung > Low Lung (Lib8 > Lib9) | 8 | 1355 | 122 | 15.52111 |
| 361 | High Lung > Low Lung (Lib8 > Lib9) | 1120 | 5 | 0 | 6.987366 |
| 369 | High Lung > Low Lung (Lib8 > Lib9) | 2790 | 6 | 0 | 8.384840 |
| 371 | High Lung > Low Lung (Lib8 > Lib9) | 8847 | 6 | 1 | 8.384840 |
| 379 | High Lung > Low Lung (Lib8 > Lib9) | 260 | 15 | 0 | 20.96210 |
| 395 | High Lung > Low Lung (Lib8 > Lib9) | 13538 | 9 | 1 | 12.57726 |
| 135 | Low Lung > High Lung (Lib9 > Lib8) | 36313 | 30 | 1 | 21.46731 |
| 154 | Low Lung > High Lung (Lib9 > Lib8) | 5345 | 27 | 6 | 3.220097 |
| 160 | Low Lung > High Lung (Lib9 > Lib8) | 4386 | 21 | 3 | 5.009039 |
| 260 | Low Lung > High Lung (Lib9 > Lib8) | 4141 | 27 | 4 | 4.830145 |
| 308 | Low Lung > High Lung (Lib9 > Lib8) | 15855 | 213 | 12 | 12.70149 |
| 323 | Low Lung > High Lung (Lib9 > Lib8) | 5257 | 25 | 5 | 3.577885 |
| 349 | Low Lung > High Lung (Lib9 > Lib8) | 2797 | 14 | 1 | 10.01807 |
| 381 | Low Lung > High Lung (Lib9 > Lib8) | 2428 | 19 | 2 | 6.797982 |

Example 7

Polynucleotides Differentially Expressed in High Metastatic Potential Colon Cancer Cells Versus Low Metastatic Colon Cancer Cells A number of polynucleotide sequences have been identified that are differentially expressed between cells derived from high metastatic potential colon cancer tissue and low metastatic colon cancer cells. Expression of these sequences in colon cancer tissue can be valuable in determining diagnostic, prognostic and/or treatment information. For example, sequences that are highly expressed in the high metastatic potential cells can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest. The differential expression of these polynucleotides can be used as a diagnostic marker, a prognostic marker, for risk assessment, patient treatment and the like. These polynucleotide sequences can also be used in combination with other known molecular and/or biochemical markers.

The following table summarizes identified polynucleotides with differential expression between high metastatic potential colon cancer cells and low metastatic potential colon cancer cells:

TABLE 10

Differentially expressed polynucleotides: High metastatic potential colon cancer vs. low metastatic colon cancer cells

| SEQ ID NO. | Differential Expression | Cluster ID | Clones in 1st Library | Clones in 2nd Library | Ratio |
|---|---|---|---|---|---|
| 1 | High Colon > Low Colon (Lib1 > Lib2) | 6660 | 7 | 0 | 6.489973 |
| 176 | High Colon > Low Colon (Lib1 > Lib2) | 3765 | 19 | 6 | 2.935940 |
| 241 | High Colon > Low Colon (Lib1 > Lib2) | 4275 | 11 | 2 | 5.099264 |
| 362 | High Colon > Low Colon (Lib1 > Lib2) | 6420 | 8 | 0 | 7.417112 |
| 374 | High Colon > Low Colon (Lib1 > Lib2) | 6420 | 8 | 0 | 7.417112 |
| 39 | Low Colon > High Colon (Lib2 > Lib1) | 4016 | 14 | 5 | 3.020043 |
| 97 | Low Colon > High Colon (Lib2 > Lib1) | 945 | 21 | 9 | 2.516702 |
| 134 | Low Colon > High Colon (Lib2 > Lib1) | 2464 | 19 | 5 | 4.098630 |
| 317 | Low Colon > High Colon (Lib2 > Lib1) | 1577 | 40 | 12 | 3.595289 |
| 357 | Low Colon > High Colon (Lib2 > Lib1) | 4309 | 13 | 4 | 3.505407 |

Example 8

Polynucleotides Differentially Expressed at Higher Levels in High Metastatic Potential Colon Cancer Patient Tissue Versus Normal Patient Tissue A number of polynucleotide sequences have been identified that are differentially expressed between cells derived from high metastatic potential colon cancer tissue and normal tissue. Expression of these sequences in colon cancer tissue can be valuable in determining diagnostic, prognostic and/or treatment information. For example, sequences that are highly expressed in the high metastatic potential cells are associated can be indicative of increased expression of genes or regulatory sequences involved in the advanced disease state which involves processes such as angiogenesis, dedifferentiation, cell replication, and metastasis. A patient sample displaying an increased level of one or more of these polynucleotides may thus warrant more aggressive treatment.

The differential expression of these polynucleotides can be used as a diagnostic marker, a prognostic marker, for risk assessment, patient treatment and the like. These polynucleotide sequences can also be used in combination with other known molecular and/or biochemical markers.

The following table summarizes identified polynucleotides with differential expression between high metastatic potential colon cancer cells and normal colon cells:

TABLE 11

Differentially expressed polynucleotides: High metastatic potential colon tissue vs. normal colon tissue

| SEQ ID NO. | Differential Expression | Cluster ID | Clones in 1$^{st}$ Library | Clones in 2$^{nd}$ Library | Ratio |
|---|---|---|---|---|---|
| 52 | High Colon Metastasis Tissue > Normal Colon Tissue of UC#3 (Lib20 > Lib18) | 19 | 10 | 0 | 11.69918 |
| 52 | High Colon Metastasis Tissue > Normal Tissue in UC#2 (Lib17 > Lib15) | 19 | 13 | 2 | 6.025646 |
| 172 | High Colon Metastasis Tissue > Normal Tissue in UC#2 (Lib17 > Lib15) | 102 | 65 | 22 | 2.738930 |

Example 9

Polynucleotides Differentially Expressed at Higher Levels in High Colon Tumor Potential Patient Tissue Versus Metastasized Colon Cancer Patient Tissue A number of polynucleotide sequences have been identified that are differentially expressed between cells derived from high tumor potential colon cancer tissue and cells derived from high metastatic potential colon cancer cells. Expression of these sequences in colon cancer tissue can be valuable in determining diagnostic, prognostic and/or treatment information associated with the transformation of pre-cancerous tissue to malignant tissue. This information can be useful in the prevention of achieving the advanced malignant state in these tissues, and can be important in risk assessment for a patient.

The following table summarizes identified polynucleotides with differential expression between high tumor potential colon cancer tissue and cells derived from high metastatic potential colon cancer cells:

TABLE 12

Differentially expressed polynucleotides: High tumor potential colon tissue vs. metastatic colon tissue

| SEQ ID NO. | Differential Expression | Cluster ID | Clones in 1$^{st}$ Library | Clones in 2$^{nd}$ Library | Ratio |
|---|---|---|---|---|---|
| 52 | High Colon Tumor Tissue > Metastasis Tissue of UC#3 (Lib19 > Lib20) | 19 | 69 | 10 | 5.160829 |

TABLE 12-continued

Differentially expressed polynucleotides: High tumor potential colon tissue vs. metastatic colon tissue

| SEQ ID NO. | Differential Expression | Cluster ID | Clones in 1$^{st}$ Library | Clones in 2$^{nd}$ Library | Ratio |
|---|---|---|---|---|---|
| 119 | High Colon Tumor Tissue > Metastasis Tissue of UC#3 (Lib19 > Lib20) | 8 | 14 | 1 | 10.47124 |
| 172 | High Colon Tumor Tissue > Metastasis Tissue of UC#3 (Lib19 > Lib20) | 102 | 43 | 10 | 3.216168 |

Example 10

Polynucleotides Differentially Expressed at Higher Levels in High Tumor Potential Colon Cancer Patient Tissue Versus Normal Patient Tissue A number of polynucleotide sequences have been identified that are differentially expressed between cells derived from high tumor potential colon cancer tissue and normal tissue. Expression of these sequences in colon cancer tissue can be valuable in determining diagnostic, prognostic and/or treatment information associated with the prevention of achieving the malignant state in these tissues, and can be important in risk assessment for a patient. For example, sequences that are highly expressed in the potential colon cancer cells are associated with or can be indicative of increased expression of genes or regulatory sequences involved in early tumor progression. A patient sample displaying an increased level of one or more of these polynucleotides may thus warrant closer attention or more frequent screening procedures to catch the malignant state as early as possible.

The following table summarizes identified polynucleotides with differential expression between high metastatic potential colon cancer cells and normal colon cells:

TABLE 13

Differentially expressed polynucleotides: High tumor potential colon tissue vs. normal colon tissue

| SEQ ID NO. | Differential Expression | Cluster ID | Clones in 1$^{st}$ Library | Clones in 2$^{nd}$ Library | Ratio |
|---|---|---|---|---|---|
| 52 | High Colon Tumor Tissue > Normal Tissue of UC#2 (Lib16 > Lib15) | 19 | 13 | 2 | 6.255508 |
| 288 | High Colon Tumor Tissue > Normal Tissue of UC#2 (Lib16 > Lib15) | 1267 | 7 | 0 | 6.125253 |
| 52 | High Colon Tumor Tissue > Normal Tissue of UC#3 (Lib19 > Lib18) | 19 | 69 | 0 | 60.37750 |
| 119 | High Colon Tumor Tissue > Normal Tissue of UC#3 (Lib19 > Lib18) | 8 | 14 | 1 | 12.25050 |
| 172 | High Colon Tumor Tissue > Normal Tissue of UC#3 (Lib19 > Lib18) | 102 | 43 | 7 | 5.375222 |

Example 11

Polynucleotides Differentially Expressed Across Multiple Libraries

A number of polynucleotide sequences have been identified that are differentially expressed between cancerous cells and normal cells across all three tissue types tested (i.e., breast, colon, and lung). Expression of these sequences in a tissue or any origin can be valuable in determining diagnostic, prognostic and/or treatment information associated with the prevention of achieving the malignant state in these tissues, and can be important in risk assessment for a patient. These polynucleotides can also serve as non-tissue specific markers of, for example, risk of metastasis of a tumor. The following table summarizes identified polynucleotides that were differentially expressed but without tissue type-specificity in the breast, colon, and lung libraries tested.

TABLE 14

Polynucleotides Differentially Expressed Across Multiple Library Comparisons

| SEQ ID NO. | Differential Expression | Cluster ID | Clones in 1st Library | Clones in 2nd Library | Ratio |
|---|---|---|---|---|---|
| 9 | High Breast > Low Breast (Lib3 > Lib4) | 2623 | 31 | 4 | 7.561356 |
|  | High Lung > Low Lung (Lib8 > Lib9) | 2623 | 6 | 1 | 8.384840 |
| 39 | Low Breast > High Breast (Lib4 > Lib3) | 4016 | 6 | 0 | 6.149690 |
|  | Low Colon > High Colon (Lib2 > Lib1) | 4016 | 14 | 5 | 3.020043 |
| 42 | High Breast > Low Breast (Lib3 > Lib4) | 307 | 196 | 75 | 2.549721 |
|  | High Lung > Low Lung (Lib8 > Lib9) | 307 | 79 | 27 | 4.088903 |
| 52 | High Breast > Low Breast (Lib3 > Lib4) | 19 | 1364 | 525 | 2.534854 |
|  | High Colon Metastasis Tissue > Normal Colon Tissue of UC#3 (Lib20 > Lib18) | 19 | 10 | 0 | 11.69918 |
|  | High Colon Metastasis Tissue > Normal Tissue in UC#2 (Lib17 > Lib15) | 19 | 13 | 2 | 6.025646 |
|  | High Colon Tumor Tissue > Metastasis Tissue of UC#3 (Lib 19 > Lib20) | 19 | 69 | 10 | 5.160829 |
|  | High Colon Tumor Tissue > Normal Tissue of UC#2 (Lib16 > Lib15) | 19 | 13 | 2 | 6.255508 |
|  | High Colon Tumor Tissue > Normal Tissue of UC#3 (Lib19 > Lib18) | 19 | 69 | 0 | 60.37750 |
| 62 | High Breast > Low Breast (Lib3 > Lib4) | 2623 | 31 | 4 | 7.561356 |
|  | High Lung > Low Lung (Lib8 > Lib9) | 2623 | 6 | 1 | 8.384840 |
| 74 | High Lung > Low Lung (Lib8 > Lib9) | 6268 | 5 | 0 | 6.987366 |
|  | Low Breast > High Breast (Lib4 > Lib3) | 6268 | 18 | 3 | 6.149690 |
| 119 | High Colon Tumor Tissue > Metastasis Tissue of UC#3 (Lib19 > Lib20) | 8 | 14 | 1 | 10.47124 |
|  | High Colon Tumor Tissue > Normal Tissue of UC#3 (Lib19 > Lib18) | 8 | 14 | 1 | 12.25050 |
|  | High Lung > Low Lung (Lib8 > Lib9) | 8 | 1355 | 122 | 15.52111 |
| 172 | High Breast > Low Breast (Lib3 > Lib4) | 102 | 278 | 116 | 2.338217 |
|  | High Colon Metastasis Tissue > Normal Tissue in UC#2 (Lib17 > Lib15) | 102 | 65 | 22 | 2.738930 |
|  | High Colon Tumor Tissue > Metastasis Tissue of UC#3 (Lib19 > Lib20) | 102 | 43 | 10 | 3.216168 |
|  | High Colon Tumor Tissue > Normal Tissue of UC#3 (Lib19 > Lib18) | 102 | 43 | 7 | 5.375222 |
| 317 | High Breast > Low Breast (Lib3 > Lib4) | 1577 | 25 | 3 | 8.130490 |
|  | Low Colon > High Colon (Lib2 > Lib1) | 1577 | 40 | 12 | 3.595289 |
| 379 | High Breast > Low Breast (Lib3 > Lib4) | 260 | 27 | 2 | 13.17139 |
|  | High Lung > Low Lung (Lib8 > Lib9) | 260 | 15 | 0 | 20.96210 |

Example 12

Polynucleotides Exhibiting Colon-Specific Expression

The cDNA libraries described herein were also analyzed to identify those polynucleotides that were specifically expressed in colon cells or tissue, i.e., the polynucleotides were identified in libraries prepared from colon cell lines or tissue, but not in libraries of breast or lung origin. The polynucleotides that were expressed in a colon cell line and/or in colon tissue, but were present in the breast or lung cDNA libraries described herein, are shown in Table 15.

TABLE 15

Polynucleotides specifically expressed in colon cells.

| SEQ ID NO. | Cluster | Clones in 1st Library | Clones in 2nd Library |
|---|---|---|---|
| 5 | 36535 | 2 | 0 |
| 13 | 27250 | 2 | 0 |
| 19 | 16283 | 3 | 0 |
| 24 | 16918 | 4 | 0 |
| 26 | 40108 | 2 | 0 |
| 32 | 32663 | 1 | 1 |
| 43 | 39833 | 2 | 0 |
| 47 | 18957 | 3 | 0 |

TABLE 15-continued

Polynucleotides specifically expressed in colon cells.

| SEQ ID NO. | Cluster | Clones in 1st Library | Clones in 2nd Library |
|---|---|---|---|
| 48 | 39508 | 2 | 0 |
| 56 | 7005 | 8 | 2 |

TABLE 15-continued

Polynucleotides specifically expressed in colon cells.

| SEQ ID NO. | Cluster | Clones in 1$^{st}$ Library | Clones in 2$^{nd}$ Library |
|---|---|---|---|
| 58 | 18957 | 3 | 0 |
| 59 | 18957 | 3 | 0 |
| 60 | 16283 | 3 | 0 |
| 64 | 13238 | 4 | 1 |
| 70 | 39442 | 2 | 0 |
| 71 | 17036 | 4 | 0 |
| 73 | 7005 | 8 | 2 |
| 83 | 11476 | 6 | 0 |
| 86 | 39425 | 2 | 0 |
| 94 | 21847 | 2 | 1 |
| 100 | 16731 | 3 | 1 |
| 101 | 12439 | 4 | 0 |
| 113 | 17055 | 4 | 0 |
| 120 | 67907 | 1 | 0 |
| 121 | 12081 | 4 | 0 |
| 124 | 39174 | 2 | 0 |
| 126 | 8210 | 2 | 6 |
| 128 | 40455 | 2 | 0 |
| 139 | 22195 | 3 | 0 |
| 143 | 86859 | 1 | 0 |
| 150 | 8672 | 4 | 4 |
| 153 | 16977 | 4 | 0 |
| 156 | 17036 | 4 | 0 |
| 159 | 40044 | 2 | 0 |
| 161 | 40044 | 2 | 0 |
| 163 | 22155 | 3 | 0 |
| 166 | 15066 | 4 | 0 |
| 170 | 11465 | 5 | 0 |
| 176 | 3765 | 19 | 6 |
| 181 | 86110 | 1 | 0 |
| 182 | 39648 | 2 | 0 |
| 185 | 17076 | 4 | 0 |
| 186 | 22794 | 2 | 0 |
| 187 | 39171 | 2 | 0 |
| 194 | 40455 | 2 | 0 |
| 199 | 16317 | 3 | 0 |
| 210 | 39186 | 2 | 0 |
| 211 | 40122 | 2 | 0 |
| 218 | 26295 | 2 | 0 |
| 222 | 4665 | 5 | 9 |
| 226 | 82498 | 1 | 0 |
| 227 | 35702 | 2 | 0 |
| 229 | 39648 | 2 | 0 |
| 231 | 85064 | 1 | 0 |
| 234 | 39391 | 2 | 0 |
| 236 | 39498 | 2 | 0 |
| 242 | 22113 | 3 | 0 |
| 247 | 19255 | 2 | 0 |
| 252 | 22814 | 3 | 0 |
| 253 | 39563 | 2 | 0 |
| 254 | 39420 | 2 | 0 |
| 257 | 39412 | 2 | 0 |
| 261 | 38085 | 2 | 0 |
| 265 | 40054 | 1 | 0 |
| 266 | 39423 | 2 | 0 |
| 267 | 39453 | 2 | 0 |
| 270 | 78091 | 1 | 0 |
| 276 | 39168 | 2 | 0 |
| 277 | 39458 | 2 | 0 |
| 278 | 14391 | 3 | 1 |
| 279 | 39195 | 2 | 0 |
| 282 | 12977 | 5 | 0 |
| 284 | 14391 | 3 | 1 |
| 290 | 16347 | 4 | 0 |
| 293 | 39478 | 2 | 0 |
| 294 | 39392 | 2 | 0 |
| 297 | 39180 | 2 | 0 |
| 299 | 6867 | 7 | 3 |
| 301 | 41633 | 1 | 1 |
| 302 | 23218 | 3 | 0 |
| 303 | 39380 | 2 | 0 |
| 309 | 84328 | 1 | 0 |
| 314 | 14367 | 3 | 0 |
| 320 | 39886 | 2 | 0 |
| 324 | 9061 | 5 | 2 |
| 327 | 16653 | 3 | 1 |
| 328 | 16985 | 4 | 0 |
| 329 | 12977 | 5 | 0 |
| 330 | 9061 | 5 | 2 |
| 333 | 16392 | 3 | 0 |
| 342 | 39486 | 2 | 0 |
| 344 | 6874 | 6 | 3 |
| 345 | 6874 | 6 | 3 |
| 353 | 11494 | 4 | 0 |
| 354 | 17062 | 3 | 0 |
| 355 | 16245 | 4 | 0 |
| 356 | 83103 | 1 | 0 |
| 358 | 13072 | 4 | 1 |
| 366 | 14364 | 1 | 0 |
| 368 | 84182 | 1 | 0 |
| 372 | 56020 | 1 | 0 |
| 89 | 7514 | 5 | 3 |
| 391 | 7570 | 5 | 3 |
| 393 | 23210 | 3 | 0 |

In addition to the above, SEQ ID NOS:159 and 161 were each present in one clone in each of Lib16 (Normal Colon Tumor Tissue), and SEQ ID NOS:344 and 345 were each present in one clone in Lib17 (High Colon Metastasis Tissue). No clones corresponding to the colon-specific polynucleotides in the table above were present in any of Libraries 3, 4, 8, or 9. The polynucleotide provided above can be used as markers of cells of colon origin, and find particular use in reference arrays, as described above.

Example 13

Identification of Contiguous Sequences Having a Polynucleotide of the Invention

The novel polynucleotides were used to screen publicly available and proprietary databases to determine if any of the polynucleotides of SEQ ID NOS:1-404 would facilitate identification of a contiguous sequence, e.g., the polynucleotides would provide sequence that would result in 5' extension of another DNA sequence, resulting in production of a longer contiguous sequence composed of the provided polynucleotide and the other DNA sequence(s). Contiging was performed using the AssemblyLign program with the following parameters: 1) Overlap: Minimum Overlap Length: 30; % Stringency: 50; Minimum Repeat Length: 30; Alignment: gap creation penalty: 1.00, gap extension penalty: 1.00; 2) Consensus: % Base designation threshold: 80.

Using these parameters, 44 polynucleotides provided contiged sequences. These contiged sequences are provided as SEQ ID NOS:801-844. The contiged sequences can be correlated with the sequences of SEQ ID NOS:1-404 upon which the contiged sequences are based by identifying those sequences of SEQ ID NOS:1-404 and the contiged sequences of SEQ ID NOS:801-844 that share the same clone name in Table 1. It should be noted that of these 44 sequences that provided a contiged sequence, the following members of that group of 44 did not contig using the overlap settings indicated in parentheses (Stringency/Overlap): SEQ ID NO:804 (30%/10); SEQ ID NO:810 (20%/20); SEQ ID NO:812 (30%/10); SEQ ID NO:814 (40%/20); SEQ ID NO:816 (30%/10); SEQ ID NO:832 (30%/10); SEQ ID NO:840 (20%/20); SEQ ID NO:841 (40%/20). To generalize, the indicated polynucleotides did not contig using a minimum 20% stringency, 10 overlap. There was a corresponding increase in the number of degenerate codons in these sequences.

The contiged sequences (SEQ ID NO:801-844) thus represent longer sequences that encompass a polynucleotide sequence of the invention. The contiged sequences were then translated in all three reading frames to determine the best alignment with individual sequences using the BLAST programs as described above for SEQ ID NOS:1-404 and the validation sequences SEQ ID NOS:405-800. Again the sequences were masked using the XBLAST program for masking low complexity as described above in Example 1 (Table 2). Several of the contiged sequences were found to encode polypeptides having characteristics of a polypeptide belonging to a known protein families (and thus represent new members of these protein families) and/or comprising a known functional domain (Table 16). Thus the invention encompasses fragments, fusions, and variants of such polynucleotides that retain biological activity associated with the protein family and/or functional domain identified herein.

TABLE 16

Profile hits using contiged sequences

| SEQ ID NO. | Sequence Name | Profile | Start (Stop) | Score |
|---|---|---|---|---|
| 809 | Contig_RTA00000177AF.n.18.3.Seq_THC123051 | ATPases | 778 (1612) | 6040 |
| 824 | Contig_RTA00000187AF.g.24.1.Seq_THC168636 | homeobox | 531 (707) | 12080 |
| 824 | Contig_RTA00000187AF.g.24.1.Seq_THC168636 | MAP kinase kinase | 769 (1494) | 5784 |
| 833 | Contig_RTA00000190AF.j.4.1.Seq_THC228776 | protein kinase | 170 (1010) | 5027 |
| 833 | Contig_RTA00000190AF.j.4.1.Seq_THC228776 | protein kinase | 170 (1010) | 5027 |

All stop/start sequences are provided in the forward direction.

The profiles for the ATPases (AAA) and protein kinase families are described above in Example 2. The homeobox and MAP kinase kinase protein families are described further below.

Homeobox domain. The 'homeobox' is a protein domain of 60 amino acids (Gehring In: Guidebook to the Homeobox Genes, Duboule D., Ed., pp 1-10, Oxford University Press, Oxford, (1994); Buerglin In: Guidebook to the Homeobox Genes, pp 25-72, Oxford University Press, Oxford, (1994); Gehring Trends Biochem. Sci. (1992) 17:277-280; Gehring et al Annu. Rev. Genet. (1986) 20:147-173; Schofield Trends Neurosci. (1987) 10:3-6; see internet web site at copan.bio-z.unibas.ch/homeo.html) first identified in number of *Drosophila* homeotic and segmentation proteins. It is extremely well conserved in many other animals, including vertebrates. This domain binds DNA through a helix-turn-helix type of structure. Several proteins that contain a homeobox domain play an important role in development. Most of these proteins are sequence-specific DNA-binding transcription factors. The homeobox domain is also very similar to a region of the yeast mating type proteins. These are sequence-specific DNA-binding proteins that act as master switches in yeast differentiation by controlling gene expression in a cell type-specific fashion.

A schematic representation of the homeobox domain is shown below. The helix-turn-helix region is shown by the symbols 'H' (for helix), and 't' (for turn).

```
xxxxxxxxxxxxxxxxxxxxxxxxxxxxxxxxxHHHHHHHHHtttHHHHHHHHHxxxxxxxxx
1                                                              60
```

The pattern detects homeobox sequences 24 residues long and spans positions 34 to 57 of the homeobox domain.

MAP kinase kinase (MAPKK). MAP kinases (MAPK) are involved in signal transduction, and are important in cell cycle and cell growth controls. The MAP kinase kinases (MAPKK) are dual-specificity protein kinases which phosphorylate and activate MAP kinases. MAPKK homologues have been found in yeast, invertebrates, amphibians, and mammals. Moreover, the MAPKK/MAPK phosphorylation switch constitutes a basic module activated in distinct pathways in yeast and in vertebrates. MAPKK regulation studies have led to the discovery of at least four MAPKK convergent pathways in higher organisms. One of these is similar to the yeast pheromone response pathway which includes the ste11 protein kinase. Two other pathways require the activation of either one or both of the serine/threonine kinase-encoded oncogenes c-Raf-1 and c-Mos. Additionally, several studies suggest a possible effect of the cell cycle control regulator cyclin-dependent kinase 1 (cdc2) on MAPKK activity. Finally, MAPKKs are apparently essential transducers through which signals must pass before reaching the nucleus. For review, see, e.g., Biologique *Biol Cell* (1993) 79:193-207; Nishida et al., *Trends Biochem Sci* (1993) 18:128-31; Ruderman *Curr Opin Cell Biol* (1993) 5:207-13; Dhanasekaran et al., *Oncogene* (1998) 17:1447-55; Kiefer et al., *Biochem Soc Trans* (1997) 25:491-8; and Hill, *Cell Signal* (1996) 8:533-44.

Those skilled in the art will recognize, or be able to ascertain, using not more than routine experimentation, many equivalents to the specific embodiments of the invention described herein. Such specific embodiments and equivalents are intended to be encompassed by the following claims.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

Deposit Information:

The following materials were deposited with the American Type Culture Collection: CMCC=(Chiron Master Culture Collection)

Cell Lines Deposited with ATCC

| Cell Line | Deposit Date | ATCC Accession No. | CMCC Accession No. |
|---|---|---|---|
| KM12L4-A | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

CDNA Library Deposits

| Clone Name | Cluster ID | Sequence Name |
|---|---|---|
| \multicolumn{3}{c}{cDNA Library ES1 - ATCC# 207023} | | |
| \multicolumn{3}{c}{Deposit Date - Dec. 22, 1998} | | |
| M00001395A:C03 | 4016 | 79.A1.sp6:130016.Seq |
| M00001395A:C03 | 4016 | RTA00000118A.c.4.1 |
| M00001449A:D12 | 3681 | RTA00000131A.g.15.2 |
| M00001449A:D12 | 3681 | 79.E1.sp6:130064.Seq |
| M00001452A:D08 | 1120 | 79.C2.sp6:130041.Seq |
| M00001452A:D08 | 1120 | RTA00000118A.p.15.3 |
| M00001513A:B06 | 4568 | 79.D4.sp6:130055.Seq |
| M00001513A:B06 | 4568 | RTA00000122A.d.15.3 |
| M00001517A:B07 | 4313 | 79.F4.sp6:130079.Seq |
| M00001517A:B07 | 4313 | RTA00000122A.n.3.1 |
| M00001533A:C11 | 2428 | RTA00000123A.1.21.1 |
| M00001533A:C11 | 2428 | 79.A5.sp6:130020.Seq |
| M00001533A:C11 | 2428 | RTA00000123A.1.21.1.Seq_THC205063 |
| M00001542A:A09 | 22113 | 79.F5.sp6:130080.Seq |
| M00001542A:A09 | 22113 | RTA00000125A.c.7.1 |
| \multicolumn{3}{c}{cDNA Library ES2 - ATCC# 207024} | | |
| \multicolumn{3}{c}{Deposit Date - Dec. 22, 1998} | | |
| M00001343C:F10 | 2790 | 80.E1.sp6:130256.Seq |
| M00001343C:F10 | 2790 | RTA00000177AF.e.2.1.Seq_THC229461 |
| M00001343C:F10 | 2790 | RTA00000177AF.e.2.1 |
| M00001343D:H07 | 23255 | 100.C1.sp6:131446.Seq |
| M00001343D:H07 | 23255 | RTA00000177AF.e.14.3.Seq_THC228776 |
| M00001343D:H07 | 23255 | 80.F1.sp6:130268.Seq |
| M00001343D:H07 | 23255 | RTA00000177AF.e.14.3 |
| M00001345A:E01 | 6420 | 172.E1.sp6:133925.Seq |
| M00001345A:E01 | 6420 | RTA00000177AF.f.10.3 |
| M00001345A:E01 | 6420 | RTA00000177AF.f.10.3.Seq_THC226443 |
| M00001345A:E01 | 6420 | 80.G1.sp6:130280.Seq |
| M00001347A:B10 | 13576 | 80.D2.sp6:130245.Seq |
| M00001347A:B10 | 13576 | 100.E1.sp6:131470.Seq |
| M00001347A:B10 | 13576 | RTA00000177AF.g.16.1 |
| M00001353A:G12 | 8078 | 80.E3.sp6:130258.Seq |
| M00001353A:G12 | 8078 | RTA00000177AR.l.13.1 |
| M00001353A:G12 | 8078 | 172.C3.sp6:133903.Seq |
| M00001353D:D10 | 14929 | RTA00000177AF.m.1.2 |
| M00001353D:D10 | 14929 | 80.F3.sp6:130270.Seq |
| M00001353D:D10 | 14929 | 172.D3.sp6:133915.Seq |
| M00001361A:A05 | 4141 | 80.B4.sp6:130223.Seq |
| M00001361A:A05 | 4141 | RTA00000177AF.p.20.3 |
| M00001362B:D10 | 5622 | 80.D4.sp6:130247.Seq |
| M00001362B:D10 | 5622 | RTA00000178AF.a.11.1 |
| \multicolumn{3}{c}{cDNA Library ES3 - ATCC# 207025} | | |
| \multicolumn{3}{c}{Deposit Date - Dec. 22, 1998} | | |
| M00001362C:H11 | 945 | RTA00000178AR.a.20.1 |
| M00001362C:H11 | 945 | 100.E4.sp6:131473.Seq |
| M00001362C:H11 | 945 | 80.E4.sp6:130259.Seq |
| M00001362C:H11 | 945 | 180.C2.sp6:135940.Seq |
| M00001376B:G06 | 17732 | RTA00000178AR.i.2.2 |
| M00001376B:G06 | 17732 | 80.B5.sp6:130224.Seq |
| M00001387A:C05 | 2464 | 80.D6.sp6:130249.Seq |
| M00001387A:C05 | 2464 | RTA00000178AF.n.18.1 |
| M00001412B:B10 | 8551 | RTA00000179AF.p.21.1 |
| M00001412B:B10 | 8551 | 80.G7.sp6:130286.Seq |
| M00001415A:H06 | 13538 | 80.B8.sp6:130227.Seq |
| M00001415A:H06 | 13538 | RTA00000180AF.a.24.1 |
| M00001416B:H11 | 8847 | 80.C8.sp6:130239.Seq |

-continued

| | | |
|---|---|---|
| M00001416B:H11 | 8847 | RTA00000180AF.b.16.1 |
| M00001429D:D07 | 40392 | RTA00000180AF.j.8.1 |
| M00001429D:D07 | 40392 | 80.H9.sp6:130300.Seq |
| M00001448D:H01 | 36313 | 80.A11.sp6:130218.Seq |
| M00001448D:H01 | 36313 | RTA00000181AF.e.23.1 | cDNA Library ES4 - ATCC# 207026
Deposit Date - Dec. 22, 1998

| | | |
|---|---|---|
| M00001463C:B11 | 19 | RTA00000182AF.b.7.1 |
| M00001463C:B11 | 19 | 89.D1.sp6:130703.Seq |
| M00001470A:B10 | 1037 | 89.F2.sp6:130728.Seq |
| M00001470A:B10 | 1037 | RTA00000121A.f.8.1 |
| M00001497A:G02 | 2623 | 89.F3.sp6:130729.Seq |
| M00001497A:G02 | 2623 | RTA00000183AF.a.6.1 |
| M00001500A:E11 | 2623 | RTA00000183AF.b.14.1 |
| M00001500A:E11 | 2623 | 89.A4.sp6:130670.Seq |
| M00001501D:C02 | 9685 | RTA00000183AF.c.11.1.Seq_THC109544 |
| M00001501D:C02 | 9685 | RTA00000183AF.c.11.1 |
| M00001501D:C02 | 9685 | 89.C4.sp6:130694.Seq |
| M00001504C:H06 | 6974 | 89.F4.sp6:130730.Seq |
| M00001504C:H06 | 6974 | RTA00000183AF.d.9.1 |
| M00001504C:H06 | 6974 | RTA00000183AF.d.9.1.Seq_THC223129 |
| M00001504D:G06 | 6420 | 173.F5.SP6:134133.Seq |
| M00001504D:G06 | 6420 | 89.G4.sp6:130742.Seq |
| M00001504D:G06 | 6420 | RTA00000183AF.d.11.1.Seq_THC226443 |
| M00001504D:G06 | 6420 | RTA00000183AF.d.11.1 |
| M00001528A:C04 | 35555 | 89.B6.sp6:130684.Seq |
| M00001528A:C04 | 7337 | RTA00000123A.b.17.1 |
| M00001528A:C04 | 35555 | 184.A5.sp6:135530.Seq | cDNA Library ES5 - ATCC# 207027
Deposit Date - Dec. 22, 1998

| | | |
|---|---|---|
| M00001537B:G07 | 3389 | RTA00000183AF.m.19.1 |
| M00001537B:G07 | 3389 | 89.A8.sp6:130674.Seq |
| M00001541A:D02 | 3765 | 89.C8.sp6:130698.Seq |
| M00001541A:D02 | 3765 | RTA00000135A.d.1.1 |
| M00001544B:B07 | 6974 | 89.A9.sp6:130675.Seq |
| M00001544B:B07 | 6974 | RTA00000184AF.a.15.1 |
| M00001546A:G11 | 1267 | 89.D9.sp6:130711.Seq |
| M00001546A:G11 | 1267 | RTA00000125A.o.5.1 |
| M00001549B:F06 | 4193 | 89.G9.sp6:130747.Seq |
| M00001549B:F06 | 4193 | RTA00000184AF.e.13.1 |
| M00001556A:F11 | 1577 | 173.C9.SP6:134101.Seq |
| M00001556A:F11 | 1577 | 89.F11.sp6:130737.Seq |
| M00001556A:F11 | 1577 | RTA00000184AF.i.23.1 |
| M00001556B:C08 | 4386 | RTA00000184AF.j.4.1 |
| M00001556B:C08 | 4386 | 89.H11.sp6:130761.Seq | cDNA Library ES6 - ATCC# 207028
Deposit Date - Dec. 22, 1998

| | | |
|---|---|---|
| M00001563B:F06 | 102 | RTA00000184AF.o.5.1 |
| M00001563B:F06 | 102 | 90.B1.sp6:130871.Seq |
| M00001571C:H06 | 5749 | 90.E1.sp6:130907.Seq |
| M00001571C:H06 | 5749 | RTA00000185AF.a.19.1 |
| M00001594B:H04 | 260 | 90.D2.sp6:130896.Seq |
| M00001594B:H04 | 260 | RTA00000185AR.i.12.2 |
| M00001597C:H02 | 4837 | 90.E2.sp6:130908.Seq |
| M00001597C:H02 | 4837 | RTA00000185AR.k.3.2 |
| M00001624C:F01 | 4309 | 90.C4.sp6:130886.Seq |
| M00001624C:F01 | 4309 | RTA00000186AF.e.22.1 |
| M00001679A:A06 | 6660 | 90.F6.sp6:130924.Seq |
| M00001679A:A06 | 6660 | 122.B5.sp6:132089.Seq |
| M00001679A:A06 | 6660 | RTA00000187AF.h.15.1 |
| M00003759B:B09 | 697 | 90.G8.sp6:130938.Seq |
| M00003759B:B09 | 697 | RTA00000188AF.d.6.1 |
| M00003759B:B09 | 697 | RTA00000188AF.d.6.1.Seq_THC178884 |
| M00003844C:B11 | 6539 | 176.D9.sp6:134556.Seq |
| M00003844C:B11 | 6539 | RTA00000189AF.d.22.1 |
| M00003844C:B11 | 6539 | 90.B10.sp6:130880.Seq |
| M00003857A:G10 | 3389 | 90.A11.sp6:130869.Seq |
| M00003857A:G10 | 3389 | RTA00000189AF.g.3.1 | cDNA Library ES7 - ATCC# 207029
Deposit Date - Dec. 22, 1998

| | | |
|---|---|---|
| M00003914C:F05 | 3900 | 99.E1.sp6:131278.Seq |
| M00003914C:F05 | 3900 | RTA00000190AF.g.13.1 |
| M00003922A:E06 | 23255 | RTA00000190AF.j.4.1 |
| M00003922A:E06 | 23255 | 99.F1.sp6:131290.Seq |
| M00003922A:E06 | 23255 | RTA00000190AF.j.4.1.Seq_THC228776 |
| M00003983A:A05 | 9105 | 99.C3.sp6:131256.Seq |

-continued

| | | |
|---|---|---|
| M00003983A:A05 | 9105 | RTA00000191AF.a.21.2 |
| M00004028D:A06 | 6124 | RTA00000191AR.e.2.3 |
| M00004028D:A06 | 6124 | 99.D3.sp6:131268.Seq |
| M00004031A:A12 | 9061 | RTA00000191AR.e.11.2 |
| M00004031A:A12 | 9061 | RTA00000191AR.e.11.3 |
| M00004087D:A01 | 6880 | RTA00000191AF.m.20.1 |
| M00004087D:A01 | 6880 | 99.A5.sp6:131234.Seq |
| M00004108A:E06 | 4937 | 99.E5.sp6:131282.Seq |
| M00004108A:E06 | 4937 | RTA00000191AF.p.21.1 |
| M00004114C:F11 | 13183 | 123.D5.sp6:132305.Seq |
| M00004114C:F11 | 13183 | RTA00000192AF.a.24.1 |
| M00004114C:F11 | 13183 | 99.G5.sp6:131306.Seq |
| cDNA Library ES8 - ATCC# 207030 | | |
| Deposit Date - Dec. 22, 1998 | | |
| | | |
| M00004146C:C11 | 5257 | 99.B6.sp6:131247.Seq |
| M00004146C:C11 | 5257 | 177.F5.sp6:134768.Seq |
| M00004146C:C11 | 5257 | RTA00000192AF.f.3.1 |
| M00004146C:C11 | 5257 | RTA00000192AF.f.3.1.Seq_THC213833 |
| M00004157C:A09 | 6455 | RTA00000192AF.g.23.1 |
| M00004157C:A09 | 6455 | 99.D6.sp6:131271.Seq |
| M00004157C:A09 | 6455 | 123.E7.sp6:132319.Seq |
| M00004172C:D08 | 11494 | RTA00000192AF.j.6.1 |
| M00004172C:D08 | 11494 | 99.G6.sp6:131307.Seq |
| M00004172C:D08 | 11494 | 177.E6.sp6:134757.Seq |
| M00004229B:F08 | 6455 | RTA00000193AF.b.9.1 |
| M00004229B:F08 | 6455 | 99.C8.sp6:131261.Seq |
| cDNA Library ES9 - ATCC# 207031 | | |
| Deposit Date - Dec. 22, 1998 | | |
| | | |
| M00001466A:E07 | 4275 | RTA00000120A.j.14.1 |
| M00001531A:H11 | | 89.F6.sp6:130732.Seq |
| M00001531A:H11 | | RTA00000123A.g.19.1 |
| M00001551A:B10 | 6268 | 79.G9.sp6:130096.Seq |
| M00001551A:B10 | 6268 | 184.C12.sp6:135561.Seq |
| M00001551A:B10 | 6268 | RTA00000126A.o.23.1 |
| M00001552A:B12 | 307 | RTA00000136A.o.4.2 |
| M00001552A:B12 | 307 | 79.C7.sp6:130046.Seq |
| M00001556A:H01 | 15855 | RTA00000184AF.j.1.1 |
| M00001586C:C05 | 4623 | RTA00000185AF.f.4.1 |
| M00001604A:B10 | 1399 | 79.G8.sp6:130095.Seq |
| M00001604A:B10 | 1399 | RTA00000129A.o.10.1 |
| M00003879B:C11 | 5345 | RTA00000189AF.1.19.1 |
| M00003879B:C11 | 5345 | 90.B12.sp6:130882.Seq |
| cDNA Library ES10 - ATCC#207032 | | |
| Deposit Date - Dec. 22, 1998 | | |
| | | |
| M00001358C:C06 | | RTA00000177AF.o.4.3 |
| M00001388D:G05 | 5832 | 80.F6.sp6:130273.Seq |
| M00001388D:G05 | 5832 | RTA00000178AF.o.23.1 |
| M00001394A:F01 | 6583 | RTA00000179AF.d.13.1 |
| M00001394A:F01 | 6583 | 172.B8.sp6:133896.Seq |
| M00001394A:F01 | 6583 | 80.H6.sp6:130297.Seq |
| M00001429A:H04 | 2797 | RTA00000180AF.i.19.1 |
| M00001447A:G03 | 10717 | RTA00000181AF.d.10.1 |
| M00001448D:C09 | 8 | 80.H10.sp6:130301.Seq |
| M00001448D:C09 | 8 | RTA00000181AF.e.17.1 |
| M00001448D:C09 | 8 | 100.B11.sp6:131444.Seq |
| M00001454D:G03 | 689 | RTA00000181AR.1.22.1 |
| cDNA Library ES11 - ATCC#207033 | | |
| Deposit Date - Dec. 22, 1998 | | |
| | | |
| M00003975A:G11 | 12439 | RTA00000190AF.o.24.1 |
| M00003978B:G05 | 5693 | RTA00000190AF.p.17.2.Seq_THC173318 |
| M00003978B:G05 | 5693 | RTA00000190AF.p.17.2 |
| M00004059A:D06 | 5417 | RTA00000191AF.h.19.1 |
| M00004068B:A01 | 3706 | 99.C4.sp6:131257.Seq |
| M00004068B:A01 | 3706 | RTA00000191AF.i.17.2 |
| M00004205D:F06 | | 99.E7.sp6:131284.Seq |
| M00004205D:F06 | | 177.G7.sp6:134782.Seq |
| M00004205D:F06 | | RTA00000192AF.o.11.1 |
| M00004212B:C07 | 2379 | RTA00000192AF.p.8.1 |
| M00004223A:G10 | 16918 | RTA00000193AF.a.16.1 |
| cDNA Library ES12 - ATCC# 207034 | | |
| Deposit Date - Dec. 22, 1998 | | |
| | | |
| M00004223B:D09 | 7899 | RTA00000193AF.a.17.1 |
| M00004249D:G12 | | RTA00000193AF.c.22.1 |
| M00004251C:G07 | | RTA00000193AF.d.2.1 |
| M00004372A:A03 | 2030 | RTA00000193AF.m.20.1 |

| cDNA Library ES13 - ATCC#207035 Deposit Date - Dec. 22, 1998 | | |
|---|---|---|
| M00001340B:A06 | 17062 | 80.A1.sp6:130208.Seq |
| M00001340B:A06 | 17062 | RTA00000177AF.b.8.4 |
| M00001340D:F10 | 11589 | 80.B1.sp6:130220.Seq |
| M00001340D:F10 | 11589 | RTA00000177AF.b.17.4 |
| M00001341A:E12 | 4443 | 80.C1.sp6:130232.Seq |
| M00001341A:E12 | 4443 | RTA00000177AF.b.20.4 |
| M00001342B:E06 | 39805 | 80.D1.sp6:130244.Seq |
| M00001342B:E06 | 39805 | RTA00000177AF.c.21.3 |
| M00001346A:F09 | 5007 | RTA00000177AF.g.2.1 |
| M00001346A:F09 | 5007 | 80.H1.sp6:130292.Seq |
| M00001346D:G06 | 5779 | RTA00000177AF.g.14.3 |
| M00001346D:G06 | 5779 | RTA00000177AF.g.14.1 |
| M00001348B:B04 | 16927 | 80.E2.sp6:130257.Seq |
| M00001348B:B04 | 16927 | RTA00000177AF.h.9.3 |
| M00001348B:G06 | 16985 | RTA00000177AF.h.10.1 |
| M00001348B:G06 | 16985 | 80.F2.sp6:130269.Seq |
| M00001349B:B08 | 3584 | RTA00000177AF.h.20.1 |
| M00001349B:B08 | 3584 | 80.G2.sp6:130281.Seq |
| M00001350A:H01 | 7187 | 100.C2.sp6:131447.Seq |
| M00001350A:H01 | 7187 | 80.A3.sp6:130210.Seq |
| M00001350A:H01 | 7187 | RTA00000177AF.i.8.2 |
| M00001352A:E02 | 16245 | RTA00000177AF.k.9.3 |
| M00001352A:E02 | 16245 | 172.D2.sp6:133914.Seq |
| M00001352A:E02 | 16245 | 80.D3.sp6:130246.Seq |
| M00001355B:G10 | 14391 | RTA00000177AF.m.17.3 |
| M00001355B:G10 | 14391 | 80.G3.sp6:130282.Seq |
| M00001355B:G10 | 14391 | 172.H3.sp6:133963.Seq |
| M00001355B:G10 | 14391 | 100.E3.sp6:131472.Seq |
| M00001361D:F08 | 2379 | 80.C4.sp6:130235.Seq |
| M00001361D:F08 | 2379 | RTA00000178AF.a.6.1 |
| M00001365C:C10 | 40132 | RTA00000178AF.c.7.1 |
| M00001365C:C10 | 40132 | 80.F4.sp6:130271.Seq |
| M00001368D:E03 | | 80.G4.sp6:130283.Seq |
| M00001368D:E03 | | RTA00000178AF.d.20.1 |
| M00001370A:C09 | 6867 | 80.H4.sp6:130295.Seq |
| M00001370A:C09 | 6867 | RTA00000178AF.e.12.1 |
| M00001371C:E09 | 7172 | 100.A5.sp6:131426.Seq |
| M00001371C:E09 | 7172 | RTA00000178AF.f.9.1 |
| M00001371C:E09 | 7172 | 80.A5.sp6:130212.Seq |
| M00001378B:B02 | 39833 | 80.C5.sp6:130236.Seq |
| M00001378B:B02 | 39833 | RTA00000178AF.i.23.1 |
| M00001379A:A05 | 1334 | 80.D5.sp6:130248.Seq |
| M00001379A:A05 | 1334 | RTA00000178AF.j.7.1 |
| M00001380D:B09 | 39886 | RTA00000178AF.j.24.1 |
| M00001380D:B09 | 39886 | 80.E5.sp6:130260.Seq |
| M00001381D:E06 | | 80.F5.sp6:130272.Seq |
| M00001381D:E06 | | RTA00000178AF.k.16.1 |
| M00001382C:A02 | 22979 | 80.G5.sp6:130284.Seq |
| M00001382C:A02 | 22979 | RTA00000178AF.k.22.1 |
| M00001384B:A11 | | 80.B6.sp6:130225.Seq |
| M00001384B:A11 | | RTA00000178AF.m.13.1 |
| M00001386C:B12 | 5178 | 80.C6.sp6:130237.Seq |
| M00001386C:B12 | 5178 | RTA00000178AF.n.10.1 |
| M00001387B:G03 | 7587 | 80.E6.sp6:130261.Seq |
| M00001387B:G03 | 7587 | RTA00000178AF.n.24.1 |
| M00001389A:C08 | 16269 | RTA00000178AF.p.1.1 |
| M00001389A:C08 | 16269 | 80.G6.sp6:130285.Seq |
| M00001396A:C03 | 4009 | 172.D8.sp6:133920.Seq |
| M00001396A:C03 | 4009 | 80.A7.sp6:130214.Seq |
| M00001396A:C03 | 4009 | RTA00000179AF.e.20.1 |
| M00001400B:H06 | | 172.B9.sp6:133897.Seq |
| M00001400B:H06 | | 80.B7.sp6:130226.Seq |
| M00001400B:H06 | | RTA00000179AF.j.13.1 |
| M00001400B:H06 | | RTA00000179AF.j.13.1.Seq_THC105720 |
| M00001402A:E08 | 39563 | 80.C7.sp6:130238.Seq |
| M00001402A:E08 | 39563 | RTA00000179AF.k.20.1 |
| M00001407B:D11 | 5556 | RTA00000179AF.n.10.1 |
| M00001407B:D11 | 5556 | 80.D7.sp6:130250.Seq |
| M00001410A:D07 | 7005 | 180.H5.sp6:136003.Seq |
| M00001410A:D07 | 7005 | RTA00000179AF.o.22.1 |
| M00001410A:D07 | 7005 | 80.F7.sp6:130274.Seq |
| M00001414A:B01 | | RTA00000180AF.a.9.1 |
| M00001414A:B01 | | 80.H7.sp6:130298.Seq |
| M00001414C:A07 | | 80.A8.sp6:130215.Seq |
| M00001414C:A07 | | RTA00000180AF.a.11.1 |
| M00001416A:H01 | 7674 | 79.C1.sp6:130040.Seq |
| M00001416A:H01 | 7674 | RTA00000118A.g.9.1 |

-continued

| | | |
|---|---|---|
| M00001417A:E02 | 36393 | RTA00000180AF.c.2.1 |
| M00001417A:E02 | 36393 | 80.D8.sp6:130251.Seq |
| M00001423B:E07 | 15066 | RTA00000180AF.e.24.1 |
| M00001423B:E07 | 15066 | 80.H8.sp6:130299.Seq |
| M00001424B:G09 | 10470 | 80.A9.sp6:130216.Seq |
| M00001424B:G09 | 10470 | RTA00000180AF.f.18.1 |
| M00001425B:H08 | 22195 | RTA00000180AF.g.7.1 |
| M00001425B:H08 | 22195 | 80.B9.sp6:130228.Seq |
| M00001426B:D12 | | RTA00000180AF.g.22.1 |
| M00001426B:D12 | | 80.C9.sp6:130240.Seq |
| M00001426D:C08 | 4261 | 80.D9.sp6:130252.Seq |
| M00001426D:C08 | 4261 | RTA00000180AF.h.5.1 |
| M00001428A:H10 | 84182 | 100.G9.sp6:131502.Seq |
| M00001428A:H10 | 84182 | RTA00000180AF.h.19.1 |
| M00001428A:H10 | 84182 | 80.E9.sp6:130264.Seq |
| M00001449A:A12 | 5857 | 80.B11.sp6:130230.Seq |
| M00001449A:A12 | 5857 | RTA00000118A.g.14.1 |
| M00001449A:B12 | 41633 | 80.C11.sp6:130242.Seq |
| M00001449A:B12 | 41633 | RTA00000118A.g.16.1 |
| M00001449A:G10 | 36535 | RTA00000181AF.f.5.1 |
| M00001449A:G10 | 36535 | 80.D11.sp6:130254.Seq |
| M00001449A:G10 | 36535 | 100.D11.sp6:131468.Seq |
| M00001449C:D06 | 86110 | RTA00000181AF.f.12.1 |
| M00001449C:D06 | 86110 | 80.E11.sp6:130266.Seq |
| M00001450A:A02 | 39304 | RTA00000118A.j.21.1.Seq_THC151859 |
| M00001450A:A02 | 39304 | RTA00000118A.j.21.1 |
| M00001450A:A02 | 39304 | 79.F1.sp6:130076.Seq |
| M00001450A:A02 | 39304 | 180.G9.sp6:135995.Seq |
| M00001450A:A11 | 32663 | 80.F11.sp6:130278.Seq |
| M00001450A:A11 | 32663 | RTA00000118A.1.8.1 |
| M00001450A:B12 | 82498 | 100.F11.sp6:131492.Seq |
| M00001450A:B12 | 82498 | RTA00000118A.m.10.1 |
| M00001450A:B12 | 82498 | 79.G1.sp6:130088.Seq |
| M00001450A:D08 | 27250 | 80.G11.sp6:130290.Seq |
| M00001450A:D08 | 27250 | 180.B10.sp6:135936.Seq |
| M00001450A:D08 | 27250 | RTA00000181AF.g.10.1 |
| M00001452A:B04 | 84328 | RTA00000118A.p.10.1 |
| M00001452A:B04 | 84328 | 79.A2.sp6:130017.Seq |
| M00001452A:B12 | 86859 | RTA00000118A.p.8.1 |
| M00001452A:B12 | 86859 | 79.B2.sp6:130029.Seq |
| M00001452A:F05 | 85064 | RTA00000131A.m.23.1 |
| M00001452A:F05 | 85064 | 79.D2.sp6:130053.Seq |
| M00001452C:B06 | 16970 | 80.H11.sp6:130302.Seq |
| M00001452C:B06 | 16970 | 100.C12.sp6:131457.Seq |
| M00001452C:B06 | 16970 | RTA00000181AR.i.18.2 |
| M00001453A:E11 | 16130 | 80.A12.sp6:130219.Seq |
| M00001453A:E11 | 16130 | 100.D12.sp6:131469.Seq |
| M00001453A:E11 | 16130 | RTA00000119A.c.13.1 |
| M00001453C:F06 | 16653 | 80.B12.sp6:130231.Seq |
| M00001453C:F06 | 16653 | RTA00000181AF.k.5.3 |
| M00001454A:A09 | 83103 | RTA00000119A.e.24.2 |
| M00001454A:A09 | 83103 | 79.G2.sp6:130089.Seq |
| M00001454B:C12 | 7005 | 121.D1.sp6:131917.Seq |
| M00001454B:C12 | 7005 | RTA00000181AF.k.24.1 |
| M00001454B:C12 | 7005 | 80.C12.sp6:130243.Seq |
| M00001455B:E12 | 13072 | 80.F12.sp6:130279.Seq |
| M00001455B:E12 | 13072 | RTA00000181AR.m.5.2 |
| M00001460A:F06 | 2448 | 89.A1.sp6:130667.Seq |
| M00001460A:F06 | 2448 | RTA00000119A.j.21.1 |
| M00001461A:D06 | 1531 | 89.C1.sp6:130691.Seq |
| M00001461A:D06 | 1531 | RTA00000119A.o.3.1 |
| M00001465A:B11 | 10145 | 79.F3.sp6:130078.Seq |
| M00001465A:B11 | 10145 | RTA00000120A.g.12.1 |
| M00001467A:B07 | 38759 | 89.F1.sp6:130727.Seq |
| M00001467A:B07 | 38759 | RTA00000120A.m.12.3 |
| M00001467A:D04 | 39508 | RTA00000120A.o.2.1 |
| M00001467A:D04 | 39508 | 89.G1.sp6:130739.Seq |
| M00001467A:E10 | 39442 | 89.A2.sp6:130668.Seq |
| M00001467A:E10 | 39442 | RTA00000120A.o.21.1 |
| M00001468A:F05 | 7589 | RTA00000120A.p.23.1 |
| M00001468A:F05 | 7589 | 89.B2.sp6:130680.Seq |
| M00001469A:A01 | | RTA00000121A.c.10.1 |
| M00001469A:A01 | | 89.C2.sp6:130692.Seq |
| M00001469A:C10 | 12081 | 89.D2.sp6:130704.Seq |
| M00001469A:C10 | 12081 | RTA00000133A.d.14.2 |
| M00001469A:H12 | 19105 | 89.E2.sp6:130716.Seq |
| M00001469A:H12 | 19105 | RTA00000133A.e.15.1 |
| M00001470A:C04 | 39425 | 89.G2.sp6:130740.Seq |
| M00001470A:C04 | 39425 | RTA00000133A.f.1.1 |
| M00001471A:B01 | 39478 | 89.H2.sp6:130752.Seq |

| | | |
|---|---|---|
| M00001471A:B01 | 39478 | RTA00000133A.i.5.1 |
| M00001487B:H06 | | RTA00000182AF.1.15.1 |
| M00001487B:H06 | | 89.B3.sp6:130681.Seq |
| M00001488B:F12 | | RTA00000182AF.l.20.1 |
| M00001488B:F12 | | 89.C3.sp6:130693.Seq |
| M00001494D:F06 | 7206 | RTA00000182AF.o.15.1 |
| M00001494D:F06 | 7206 | 89.E3.sp6:130717.Seq |
| M00001499B:A11 | 10539 | RTA00000183AF.a.24.1 |
| M00001499B:A11 | 10539 | 89.G3.sp6:130741.Seq |
| M00001499B:A11 | 10539 | 173.B5.SP6:134085.Seq |
| M00001500A:C05 | 5336 | RTA00000183AF.b.13.1 |
| M00001500A:C05 | 5336 | 89.H3.sp6:130753.Seq |
| M00001504A:E01 | | RTA00000183AF.c.24.1 |
| M00001504A:E01 | | 89.D4.sp6:130706.Seq |
| M00001504A:E01 | | RTA00000183AF.c.24.1.Seq_THC125912 |
| M00001504C:A07 | 10185 | RTA00000183AF.d.5.1 |
| M00001504C:A07 | 10185 | 89.E4.sp6:130718.Seq |
| M00001505C:C05 | | 89.H4.sp6:130754.Seq |
| M00001505C:C05 | | RTA00000183AF.e.1.1 |
| M00001506D:A09 | | 89.A5.sp6:130671.Seq |
| M00001506D:A09 | | RTA00000183AF.e.23.1 |
| M00001506D:A09 | | 121.G6.sp6:131958.Seq |
| M00001507A:H05 | 39168 | RTA00000121A.l.10.1 |
| M00001507A:H05 | 39168 | 89.B5.sp6:130683.Seq |
| M00001535A:F10 | 39423 | 79.C5.sp6:130044.Seq |
| M00001535A:F10 | 39423 | RTA00000134A.k.22.1 |
| M00001541A:H03 | 39174 | 79.E5.sp6:130068.Seq |
| M00001541A:H03 | 39174 | RTA00000124A.n.13.1 |
| M00001544A:G02 | 19829 | 79.H5.sp6:130104.Seq |
| M00001544A:G02 | 19829 | RTA00000125A.h.24.4 |
| M00001545A:D08 | 13864 | RTA00000125A.m.9.1 |
| M00001545A:D08 | 13864 | 79.B6.sp6:130033.Seq |
| M00001551A:F05 | 39180 | RTA00000126A.n.8.2 |
| M00001551A:F05 | 39180 | 79.A7.sp6:130022.Seq |
| M00001552A:D11 | 39458 | RTA00000126A.p.15.2 |
| M00001552A:D11 | 39458 | 79.D7.sp6:130058.Seq |
| M00001557A:F03 | 39490 | RTA00000128A.b.4.1 | cDNA Library ES14 - ATCC# 207036
Deposit Date - Dec. 22, 1998

| | | |
|---|---|---|
| M00001511A:H06 | 39412 | RTA00000133A.k.17.1 |
| M00001511A:H06 | 39412 | 89.C5.sp6:130695.Seq |
| M00001512A:A09 | 39186 | 89.D5.sp6:130707.Seq |
| M00001512A:A09 | 39186 | RTA00000121A.p.15.1 |
| M00001512D:G09 | 3956 | 89.E5.sp6:130719.Seq |
| M00001512D:G09 | 3956 | 173.H5.SP6:134157.Seq |
| M00001512D:G09 | 3956 | RTA00000183AF.g.3.1 |
| M00001513B:G03 | | RTA00000183AF.g.9.1 |
| M00001513B:G03 | | 89.F5.sp6:130731.Seq |
| M00001513B:G03 | | RTA00000183AF.g.9.1.Seq_THC198280 |
| M00001513C:E08 | 14364 | RTA00000183AF.g.12.1 |
| M00001513C:E08 | 14364 | 89.G5.sp6:130743.Seq |
| M00001514C:D11 | 40044 | RTA00000183AF.g.22.1 |
| M00001514C:D11 | 40044 | RTA00000183AF.g.22.1.Seq_THC232899 |
| M00001514C:D11 | 40044 | 89.H5.sp6:130755.Seq |
| M00001518C:B11 | 8952 | 89.A6.sp6:130672.Seq |
| M00001518C:B11 | 8952 | RTA00000183AF.h.15.1 |
| M00001528B:H04 | 8358 | 89.D6.sp6:130708.Seq |
| M00001528B:H04 | 8358 | RTA00000183AF.i.5.1 |
| M00001531A:D01 | 38085 | RTA00000123A.e.15.1 |
| M00001531A:D01 | 38085 | 89.E6.sp6:130720.Seq |
| M00001534A:C04 | 16921 | RTA00000183AF.k.6.1 |
| M00001534A:C04 | 16921 | 89.H6.sp6:130756.Seq |
| M00001534A:D09 | 5097 | RTA00000134A.k.1.1 |
| M00001534A:D09 | 5097 | RTA00000134A.k.1.1.Seq_THC215869 |
| M00001534C:A01 | 4119 | RTA00000183AF.k.16.1 |
| M00001534C:A01 | 4119 | 89.C7.sp6:130697.Seq |
| M00001535A:C06 | 20212 | 89.E7.sp6:130721.Seq |
| M00001535A:C06 | 20212 | RTA00000134A.1.22.1.Seq_THC128232 |
| M00001535A:C06 | 20212 | RTA00000134A.1.22.1 |
| M00001536A:B07 | 2696 | RTA00000134A.m.13.1 |
| M00001536A:B07 | 2696 | 89.F7.sp6:130733.Seq |
| M00001537A:F12 | 39420 | 89.H7.sp6:130757.Seq |
| M00001537A:F12 | 39420 | RTA00000134A.o.23.1 |
| M00001540A:D06 | 8286 | 89.B8.sp6:130686.Seq |
| M00001540A:D06 | 8286 | RTA00000183AF.o.1.1 |
| M00001542A:E06 | 39453 | 89.E8.sp6:130722.Seq |
| M00001542A:E06 | 39453 | RTA00000135A.g.11.1 |
| M00001544A:E06 | | RTA00000184AF.a.8.1 |
| M00001544A:E06 | | 173.G7.SP6:134147.Seq |

-continued

| | | |
|---|---|---|
| M00001544A:E06 | | 89.H8.sp6:130758.Seq |
| M00001545A:B02 | | 89.B9.sp6:130687.Seq |
| M00001545A:B02 | | RTA00000135A.1.2.2 |
| M00001548A:E10 | 5892 | 89.E9.sp6:130723.Seq |
| M00001548A:E10 | 5892 | RTA00000184AF.d.11.1 |
| M00001548A:E10 | 5892 | RTA00000184AF.d.11.1.Seq_THC161896 |
| M00001549C:E06 | 16347 | 89.H9.sp6:130759.Seq |
| M00001549C:E06 | 16347 | RTA00000184AF.e.15.1 |
| M00001550A:A03 | 7239 | 89.A10.sp6:130676.Seq |
| M00001550A:A03 | 7239 | RTA00000126A.m.4.2 |
| M00001550A:G01 | 5175 | RTA00000184AF.f.3.1 |
| M00001550A:G01 | 5175 | 89.B10.sp6:130688.Seq |
| M00001551A:G06 | 22390 | RTA00000136A.j.13.1 |
| M00001551A:G06 | 22390 | 89.C10.sp6:130700.Seq |
| M00001551C:G09 | 3266 | RTA00000184AR.g.1.1 |
| M00001551C:G09 | 3266 | 89.D10.sp6:130712.Seq |
| M00001553A:H06 | 8298 | RTA00000127A.d.19.1 |
| M00001553A:H06 | 8298 | 89.G10.sp6:130748.Seq |
| M00001553B:F12 | 4573 | 89.H10.sp6:130760.Seq |
| M00001553B:F12 | 4573 | RTA00000184AF.h.9.1 |
| M00001555A:B02 | 39539 | RTA00000127A.i.21.1 |
| M00001555A:B02 | 39539 | 89.B11.sp6:130689.Seq |
| M00001555A:C01 | 39195 | 89.C11.sp6:130701.Seq |
| M00001555A:C01 | 39195 | RTA00000137A.c.16.1 |
| M00001555D:G10 | 4561 | RTA00000184AF.i.21.1 |
| M00001555D:G10 | 4561 | 89.D11.sp6:130713.Seq |
| M00001556A:C09 | 9244 | 89.E11.sp6:130725.Seq |
| M00001556A:C09 | 9244 | RTA00000127A.l.3.1 |
| M00001556B:G02 | 11294 | RTA00000184AF.j.6.1 |
| M00001556B:G02 | 11294 | 89.A12.sp6:130678.Seq |
| M00001557B:H10 | 5192 | 173.E9.SP6:134125.Seq |
| M00001557B:H10 | 5192 | RTA00000184AF.k.2.1 |
| M00001557B:H10 | 5192 | 89.D12.sp6:130714.Seq |
| M00001557D:D09 | 8761 | RTA00000184AF.k.12.1 |
| M00001557D:D09 | 8761 | 89.E12.sp6:130726.Seq |
| M00001558B:H11 | 7514 | RTA00000184AF.k.21.1 |
| M00001558B:H11 | 7514 | 89.G12.sp6:130750.Seq |
| M00001559B:F01 | | 89.H12.sp6:130762.Seq |
| M00001559B:F01 | | RTA00000184AF.l.11.1 |
| M00001560D:F10 | 6558 | 90.A1.sp6:130859.Seq |
| M00001560D:F10 | 6558 | RTA00000184AF.m.21.1 |
| M00001566B:D11 | | RTA00000184AF.p.3.1 |
| M00001566B:D11 | | 90.D1.sp6:130895.Seq |
| M00001583D:A10 | 6293 | RTA00000185AF.e.11.1 |
| M00001583D:A10 | 6293 | 90.A2.sp6:130860.Seq |
| M00001590B:F03 | | RTA00000185AF.g.11.1 |
| M00001590B:F03 | | 90.C2.sp6:130884.Seq |
| M00001597D:C05 | 10470 | RTA00000185AF.k.6.1 |
| M00001597D:C05 | 10470 | 90.F2.sp6:130920.Seq |
| M00001598A:G03 | 16999 | 90.G2.sp6:130932.Seq |
| M00001598A:G03 | 16999 | RTA00000185AF.k.9.1 |
| M00001601A:D08 | 22794 | RTA00000138A.b.5.1 |
| M00001601A:D08 | 22794 | 90.H2.sp6:130944.Seq |
| M00001607A:E11 | 11465 | RTA00000185AF.m.19.1 |
| M00001607A:E11 | 11465 | 90.A3.sp6:130861.Seq |
| M00001608A:B03 | 7802 | RTA00000185AF.n.5.1 |
| M00001608A:B03 | 7802 | 90.B3.sp6:130873.Seq |
| M00001608B:E03 | 22155 | RTA00000185AF.n.9.1 |
| M00001608B:E03 | 22155 | 90.C3.sp6:130885.Seq |
| M00001608D:A11 | | RTA00000185AF.n.12.1 |
| M00001608D:A11 | | 90.D3.sp6:130897.Seq |
| M00001614C:F10 | 13157 | RTA00000186AF.a.6.1 |
| M00001614C:F10 | 13157 | 90.E3.sp6:130909.Seq |
| M00001617C:E02 | 17004 | RTA00000186AF.b.21.1 |
| M00001617C:E02 | 17004 | 90.F3.sp6:130921.Seq |
| M00001619C:F12 | 40314 | 90.G3.sp6:130933.Seq |
| M00001619C:F12 | 40314 | RTA00000186AF.c.15.1 |
| M00001621C:C08 | 40044 | RTA00000186AF.d.1.1 |
| M00001621C:C08 | 40044 | RTA00000186AF.d.1.1.Seq_THC232899 |
| M00001621C:C08 | 40044 | 90.H3.sp6:130945.Seq |
| M00001621C:C08 | 40044 | 122.E1.sp6:132121.Seq |
| M00001623D:F10 | 13913 | RTA00000186AF.e.6.1 |
| M00001623D:F10 | 13913 | 90.A4.sp6:130862.Seq |
| M00001632D:H07 | | RTA00000186AF.h.14.1.Seq_THC112525 |
| M00001632D:H07 | | RTA00000186AF.h.14.1 |
| M00001632D:H07 | | 90.E4.sp6:130910.Seq |
| M00001632D:H07 | | 176.A3.sp6:134514.Seq |
| M00001644C:B07 | 39171 | RTA00000186AF.l.7.1 |
| M00001644C:B07 | 39171 | 90.F4.sp6:130922.Seq |
| M00001644C:B07 | 39171 | 217.A12.sp6:139369.Seq |

-continued

| | | |
|---|---|---|
| M00001645A:C12 | 19267 | RTA00000186AF.l.12.1.Seq_THC178183 |
| M00001645A:C12 | 19267 | 176.G3.sp6:134586.Seq |
| M00001645A:C12 | 19267 | RTA00000186AF.l.12.1 |
| M00001645A:C12 | 19267 | 90.G4.sp6:130934.Seq |
| M00001648C:A01 | 4665 | 90.H4.sp6:130946.Seq |
| M00001648C:A01 | 4665 | RTA00000186AF.m.3.1 |
| M00001657D:C03 | 23201 | RTA00000187AF.a.14.1 |
| M00001657D:C03 | 23201 | 90.B5.sp6:130875.Seq |
| M00001657D:F08 | 76760 | 90.C5.sp6:130887.Seq |
| M00001657D:F08 | 76760 | RTA00000187AF.a.15.1 |
| M00001662C:A09 | 23218 | RTA00000187AR.c.5.2 |
| M00001662C:A09 | 23218 | 90.D5.sp6:130899.Seq |
| M00001663A:E04 | 35702 | 90.E5.sp6:130911.Seq |
| M00001663A:E04 | 35702 | RTA00000187AR.c.15.2 |
| M00001669B:F02 | 6468 | 90.F5.sp6:130923.Seq |
| M00001669B:F02 | 6468 | RTA00000187AF.d.15.1 |
| M00001670C:H02 | 14367 | 90.G5.sp6:130935.Seq |
| M00001670C:H02 | 14367 | RTA00000187AF.e.8.1 |
| M00001673C:H02 | 7015 | 90.H5.sp6:130947.Seq |
| M00001673C:H02 | 7015 | RTA00000187AF.f.18.1 |
| M00001675A:C09 | 8773 | RTA00000187AF.f.24.1 |
| M00001675A:C09 | 8773 | 90.A6.sp6:130864.Seq |
| M00001675A:C09 | 8773 | RTA00000187AF.f.24.1.Seq_THC220002 |
| M00001676B:F05 | 11460 | RTA00000187AF.g.12.1 |
| M00001676B:F05 | 11460 | 90.B6.sp6:130876.Seq |
| M00001676B:F05 | 11460 | 219.F2.sp6:139035.Seq |
| M00001677D:A07 | 7570 | 90.D6.sp6:130900.Seq |
| M00001677D:A07 | 7570 | RTA00000187AF.g.24.1 |
| M00001677D:A07 | 7570 | RTA00000187AF.g.24.1.Seq_THC168636 |
| M00001678D:F12 | 4416 | 90.E6.sp6:130912.Seq |
| M00001678D:F12 | 4416 | RTA00000187AF.h.13.1 |
| M00001679A:F10 | 26875 | RTA00000187AF.i.1.1 |
| M00001679A:F10 | 26875 | 90.A7.sp6:130865.Seq |
| M00001679B:F01 | 6298 | 90.B7.sp6:130877.Seq |
| M00001679B:F01 | 6298 | RTA00000187AR.i.10.2 |
| M00001680D:F08 | 10539 | 90.F7.sp6:130925.Seq |
| M00001680D:F08 | 10539 | 219.F6.sp6:139039.Seq |
| M00001680D:F08 | 10539 | RTA00000187AF.l.7.1 |
| M00001682C:B12 | 17055 | 90.G7.sp6:130937.Seq |
| M00001682C:B12 | 17055 | RTA00000187AF.m.3.1 |
| M00001682C:B12 | 17055 | 176.D6.sp6:134553.Seq |
| M00001688C:F09 | 5382 | 90.A8.sp6:130866.Seq |
| M00001688C:F09 | 5382 | RTA00000187AF.m.23.2 |
| M00001693C:G01 | 4393 | RTA00000187AF.n.17.1 |
| M00001693C:G01 | 4393 | 90.B8.sp6:130878.Seq |
| M00001716D:H05 | 67252 | RTA00000187AF.o.6.1 |
| M00001716D:H05 | 67252 | 90.C8.sp6:130890.Seq |
| M00003741D:C09 | 40108 | 90.D8.sp6:130902.Seq |
| M00003741D:C09 | 40108 | RTA00000187AF.o.24.1 |
| M00003747D:C05 | 11476 | RTA00000187AF.p.19.1 |
| M00003747D:C05 | 11476 | 90.E8.sp6:130914.Seq |
| M00003747D:C05 | 11476 | RTA00000187AF.p.19.1.Seq_THC108482 |
| M00003747D:C05 | 11476 | 219.H8.sp6:139065.Seq |
| M00003754C:E09 | | 90.F8.sp6:130926.Seq |
| M00003754C:E09 | | RTA00000188AF.b.12.1 |
| M00003761D:A09 | | RTA00000188AF.d.11.1 |
| M00003761D:A09 | | 90.H8.sp6:130950.Seq |
| M00003761D:A09 | | RTA00000188AF.d.11.1.Seq_THC212094 |
| M00003762C:B08 | 17076 | RTA00000188AF.d.21.1.Seq_THC208760 |
| M00003762C:B08 | 17076 | 90.A9.sp6:130867.Seq |
| M00003762C:B08 | 17076 | RTA00000188AF.d.21.1 |
| M00003763A:F06 | 3108 | RTA00000188AF.d.24.1 |
| M00003763A:F06 | 3108 | 90.B9.sp6:130879.Seq |
| M00003774C:A03 | 67907 | RTA00000188AF.g.11.1.Seq_THC123222 |
| M00003774C:A03 | 67907 | RTA00000188AF.g.11.1 |
| M00003774C:A03 | 67907 | 90.C9.sp6:130891.Seq |
| M00003784D:D12 | | RTA00000188AF.i.8.1 |
| M00003784D:D12 | | 90.D9.sp6:130903.Seq |
| M00003839A:D08 | 7798 | RTA00000189AF.c.18.1 |
| M00003839A:D08 | 7798 | 90.A10.sp6:130868.Seq |
| M00003851B:D08 | | 90.D10.sp6:130904.Seq |
| M00003851B:D08 | | RTA00000189AF.f.7.1 |
| M00003851B:D10 | 13595 | 90.E10.sp6:130916.Seq |
| M00003851B:D10 | 13595 | RTA00000189AF.f.8.1 |
| M00003853A:D04 | 5619 | 90.F10.sp6:130928.Seq |
| M00003853A:D04 | 5619 | RTA00000189AF.f.17.1 |
| M00003853A:F12 | 10515 | 90.G10.sp6:130940.Seq |
| M00003853A:F12 | 10515 | RTA00000189AF.f.18.1 |
| M00003856B:C02 | 4622 | 90.H10.sp6:130952.Seq |
| M00003856B:C02 | 4622 | RTA00000189AF.g.1.1 |

-continued

| | | |
|---|---|---|
| M00003857A:H03 | 4718 | 90.B11.sp6:130881.Seq |
| M00003857A:H03 | 4718 | RTA00000189AF.g.5.1.Seq_THC196102 |
| M00003857A:H03 | 4718 | RTA00000189AF.g.5.1 |
| | cDNA Library ES15 - ATCC# 207037 | |
| | Deposit Date - Dec. 22, 1998 | |

| | | |
|---|---|---|
| M00003867A:D10 | | 90.C11.sp6:130893.Seq |
| M00003867A:D10 | | RTA00000189AF.h.17.1 |
| M00003871C:E02 | 4573 | RTA00000189AF.j.12.1 |
| M00003875C:G07 | 8479 | 90.G11.sp6:130941.Seq |
| M00003875C:G07 | 8479 | RTA00000189AF.j.22.1 |
| M00003875D:D11 | | 90.H11.sp6:130953.Seq |
| M00003875D:D11 | | RTA00000189AF.j.23.1 |
| M00003876D:E12 | 7798 | 90.A12.sp6:130870.Seq |
| M00003876D:E12 | 7798 | RTA00000189AF.k.12.1 |
| M00003906C:E10 | 9285 | 90.H12.sp6:130954.Seq |
| M00003906C:E10 | 9285 | RTA00000190AF.d.7.1 |
| M00003907D:A09 | 39809 | 99.A1.sp6:131230.Seq |
| M00003907D:A09 | 39809 | RTA00000190AF.e.3.1.Seq_THC150217 |
| M00003907D:A09 | 39809 | RTA00000190AF.e.3.1 |
| M00003907D:H04 | 16317 | 99.B1.sp6:131242.Seq |
| M00003907D:H04 | 16317 | RTA00000190AF.e.6.1 |
| M00003909D:C03 | 8672 | RTA00000190AF.f.11.1 |
| M00003909D:C03 | 8672 | 99.C1.sp6:131254.Seq |
| M00003968B:F06 | 24488 | RTA00000190AF.n.16.1 |
| M00003968B:F06 | 24488 | 99.C2.sp6:131255.Seq |
| M00003970C:B09 | 40122 | RTA00000190AF.n.23.1 |
| M00003970C:B09 | 40122 | RTA00000190AF.n.23.1.Seq_THC109227 |
| M00003970C:B09 | 40122 | 99.D2.sp6:131267.Seq |
| M00003974D:E07 | 23210 | RTA00000190AF.o.20.1 |
| M00003974D:E07 | 23210 | RTA00000190AF.o.20.1.Seq_THC207240 |
| M00003974D:E07 | 23210 | 99.E2.sp6:131279.Seq |
| M00003974D:H02 | 23358 | RTA00000190AF.o.21.1.Seq_THC207240 |
| M00003974D:H02 | 23358 | RTA00000190AF.o.21.1 |
| M00003974D:H02 | 23358 | 99.F2.sp6:131291.Seq |
| M00003981A:E10 | 3430 | 99.A3.sp6:131232.Seq |
| M00003981A:E10 | 3430 | RTA00000191AF.a.9.1 |
| M00003982C:C02 | 2433 | RTA00000191AF.a.15.2 |
| M00003982C:C02 | 2433 | 99.B3.sp6:131244.Seq |
| M00003982C:C02 | 2433 | RTA00000191AF.a.15.2.Seq_THC79498 |
| M00004028D:C05 | 40073 | RTA00000191AF.e.3.1 |
| M00004028D:C05 | 40073 | 99.E3.sp6:131280.Seq |
| M00004035C:A07 | 37285 | 99.H3.sp6:131316.Seq |
| M00004035C:A07 | 37285 | RTA00000191AF.f.11.1 |
| M00004035D:B06 | 17036 | RTA00000191AF.f.13.1 |
| M00004035D:B06 | 17036 | 99.A4.sp6:131233.Seq |
| M00004072A:C03 | | RTA00000191AF.j.9.1 |
| M00004072A:C03 | | 99.D4.sp6:131269.Seq |
| M00004081C:D10 | 15069 | 99.F4.sp6:131293.Seq |
| M00004081C:D10 | 15069 | RTA00000191AF.l.6.1 |
| M00004086D:G06 | 9285 | 99.H4.sp6:131317.Seq |
| M00004086D:G06 | 9285 | RTA00000191AF.m.18.1 |
| M00004105C:A04 | 7221 | 99.D5.sp6:131270.Seq |
| M00004105C:A04 | 7221 | RTA00000191AF.p.9.1 |
| M00004171D:B03 | 4908 | RTA00000192AF.j.2.1 |
| M00004171D:B03 | 4908 | 99.F6.sp6:131295.Seq |
| M00004185C:C03 | 11443 | RTA00000192AF.l.13.2 |
| M00004185C:C03 | 11443 | 123.A8.sp6:132272.Seq |
| M00004185C:C03 | 11443 | 99.A7.sp6:131236.Seq |
| M00004191D:B11 | | RTA00000192AF.m.12.1 |
| M00004191D:B11 | | 99.B7.sp6:131248.Seq |
| M00004191D:B11 | | 123.C8.sp6:132296.Seq |
| M00004197D:H01 | 8210 | 99.C7.sp6:131260.Seq |
| M00004197D:H01 | 8210 | 123.E8.sp6:132320.Seq |
| M00004197D:H01 | 8210 | RTA00000192AF.n.13.1 |
| M00004203B:C12 | 14311 | 99.D7.sp6:131272.Seq |
| M00004203B:C12 | 14311 | RTA00000192AF.o.2.1 |
| M00004214C:H05 | 11451 | 177.D8.sp6:134747.Seq |
| M00004214C:H05 | 11451 | RTA00000192AF.p.17.1 |
| M00004223D:E04 | 12971 | RTA00000193AF.a.20.1 |
| M00004223D:E04 | 12971 | 99.B8.sp6:131249.Seq |
| M00004269D:D06 | 4905 | 99.H8.sp6:131321.Seq |
| M00004269D:D06 | 4905 | RTA00000193AF.e.14.1 |
| M00004295D:F12 | 16921 | 99.D9.sp6:131274.Seq |
| M00004295D:F12 | 16921 | RTA00000193AF.h.15.1 |
| M00004296C:H07 | 13046 | 99.E9.sp6:131286.Seq |
| M00004296C:H07 | 13046 | RTA00000193AF.h.19.1 |
| M00004307C:A06 | 9457 | RTA00000193AF.i.14.2 |
| M00004307C:A06 | 9457 | 99.F9.sp6:131298.Seq |
| M00004307C:A06 | 9457 | 123.D11.sp6:132311.Seq |

-continued

| | | |
|---|---|---|
| M00004312A:G03 | 26295 | RTA00000193AF.i.24.2 |
| M00004312A:G03 | 26295 | 99.G9.sp6:131310.Seq |
| M00004312A:G03 | 26295 | RTA00000193AF.i.24.2.Seq_THC197345 |
| M00004318C:D10 | 21847 | RTA00000193AF.j.9.1 |
| M00004318C:D10 | 21847 | 99.H9.sp6:131322.Seq |
| M00004359B:G02 | | RTA00000193AF.m.5.1.Seq_THC173318 |
| M00004359B:G02 | | RTA00000193AF.m.5.1 |
| M00004505D:F08 | | RTA00000194AF.b.19.1 |
| M00004505D:F08 | | 99.H10.sp6:131323.Seq |
| M00004692A:H08 | | 99.B11.sp6:131252.Seq |
| M00004692A:H08 | | RTA00000194AF.c.24.1 |
| M00004692A:H08 | | 377.F4.sp6:141957.Seq |
| M00005180C:G03 | | RTA00000194AF.f.4.1 | cDNA Library ES16 - ATCC#207038
Deposit Date - Dec. 22, 1998

| | | |
|---|---|---|
| M00001346D:E03 | 6806 | RTA00000177AF.g.13.3 |
| M00001350A:B08 | | 80.H2.sp6:130293.Seq |
| M00001350A:B08 | | RTA00000177AF.i.6.2 |
| M00001357D:D11 | 4059 | RTA00000177AF.n.18.3.Seq_THC123051 |
| M00001357D:D11 | 4059 | RTA00000177AF.n.18.3 |
| M00001409C:D12 | 9577 | RTA00000179AF.o.17.1 |
| M00001409C:D12 | 9577 | 80.E7.sp6:130262.Seq |
| M00001418B:F03 | 9952 | RTA00000180AF.c.20.1 |
| M00001418B:F03 | 9952 | RTA00000180AF.c.20.1.Seq_THC162284 |
| M00001418B:F03 | 9952 | 80.E8.sp6:130263.Seq |
| M00001418D:B06 | 8526 | RTA00000180AF.d.1.1 |
| M00001421C:F01 | 9577 | RTA00000180AF.d.23.1 |
| M00001421C:F01 | 9577 | 80.G8.sp6:130287.Seq |
| M00001429B:A11 | 4635 | RTA00000180AF.i.20.1 |
| M00001432C:F06 | | RTA00000180AF.k.24.1 |
| M00001439C:F08 | 40054 | RTA00000180AF.p.10.1 |
| M00001442C:D07 | 16731 | RTA00000181AF.a.20.1 |
| M00001442C:D07 | 16731 | 80.C10.sp6:130241.Seq |
| M00001443B:F01 | | 80.D10.sp6:130253.Seq |
| M00001443B:F01 | | RTA00000181AF.b.7.1 |
| M00001445A:F05 | 13532 | 80.E10.sp6:130265.Seq |
| M00001445A:F05 | 13532 | RTA00000181AF.c.4.1 |
| M00001446A:F05 | 7801 | RTA00000181AF.c.21.1 |
| M00001455A:E09 | 13238 | RTA00000181AF.m.4.1 |
| M00001455A:E09 | 13238 | RTA00000181AF.m.4.1.Seq_THC140691 |
| M00001460A:F12 | 39498 | RTA00000119A.j.20.1 |
| M00001481D:A05 | 7985 | RTA00000182AR.j.2.1 |
| M00001490B:C04 | 18699 | RTA00000182AF.m.16.1 |
| M00001490B:C04 | 18699 | 89.D3.sp6:130705.Seq |
| M00001500C:E04 | 9443 | 89.B4.sp6:130682.Seq |
| M00001500C:E04 | 9443 | RTA00000183AF.c.1.1 |
| M00001532B:A06 | 3990 | 89.G6.sp6:130744.Seq |
| M00001532B:A06 | 3990 | RTA00000183AF.j.11.1 |
| M00001534A:F09 | 5321 | 89.B7.sp6:130685.Seq |
| M00001534A:F09 | 5321 | RTA00000183AF.k.8.1 |
| M00001535A:B01 | 7665 | RTA00000134A.l.19.1 |
| M00001536A:C08 | 39392 | 89.G7.sp6:130745.Seq |
| M00001536A:C08 | 39392 | RTA00000134A.m.16.1 |
| M00001541A:F07 | 22085 | RTA00000135A.e.5.2 |
| M00001542B:B01 | | RTA00000183AF.p.4.1 |
| M00001542B:B01 | | 89.F8.sp6:130734.Seq |
| M00001544A:E03 | 12170 | RTA00000125A.h.18.4 |
| M00001545A:C03 | 19255 | RTA00000135A.m.18.1 |
| M00001545A:C03 | 19255 | 184.B10.sp6:135547.Seq |
| M00001545A:C03 | 19255 | 89.C9.sp6:130699.Seq |
| M00001548A:H09 | 1058 | RTA00000126A.e.20.3.Seq_THC217534 |
| M00001548A:H09 | 1058 | RTA00000126A.e.20.3 |
| M00001548A:H09 | 1058 | 79.F6.sp6:130081.Seq |
| M00001549A:B02 | 4015 | RTA00000136A.e.12.1 |
| M00001549A:B02 | 4015 | 79.G6.sp6:130093.Seq |
| M00001549A:D08 | 10944 | RTA00000126A.h.17.2 |
| M00001552B:D04 | 5708 | RTA00000184AF.g.12.1 |
| M00001552B:D04 | 5708 | 89.E10.sp6:130724.Seq |
| M00001552D:A01 | | 89.F10.sp6:130736.Seq |
| M00001552D:A01 | | RTA00000184AF.g.22.1 |
| M00001553D:D10 | 22814 | RTA00000184AF.h.14.1 |
| M00001553D:D10 | 22814 | 89.A11.sp6:130677.Seq |
| M00001558A:H05 | | RTA00000128A.c.20.1 |
| M00001558A:H05 | | 89.F12.sp6:130738.Seq |
| M00001561A:C05 | 39486 | RTA00000128A.m.22.2 |
| M00001561A:C05 | 39486 | 79.B8.sp6:130035.Seq |
| M00001564A:B12 | 5053 | RTA00000184AF.o.12.1 |
| M00001578B:E04 | 23001 | RTA00000185AF.c.24.1 |
| M00001579D:C03 | 6539 | 90.G1.sp6:130931.Seq |

| | | -continued |
|---|---|---|
| M00001579D:C03 | 6539 | 173.A12.SP6:134080.Seq |
| M00001579D:C03 | 6539 | RTA00000185AF.d.11.1 |
| M00001582D:F05 | | RTA00000185AF.d.24.1 |
| M00001587A:B11 | 39380 | RTA00000129A.e.24.1 |
| M00001587A:B11 | 39380 | 79.E8.sp6:130071.Seq |
| M00001604A:F05 | 39391 | RTA00000138A.c.3.1 |
| M00001604A:F05 | 39391 | 79.A9.sp6:130024.Seq |
| M00001624A:B06 | 3277 | RTA00000138A.l.5.1 |
| M00001624A:B06 | 3277 | 217.E1.sp6:139406.Seq |
| M00001624A:B06 | 3277 | 90.B4.sp6:130874.Seq |
| M00001630B:H09 | 5214 | 90.D4.sp6:130898.Seq |
| M00001630B:H09 | 5214 | 122.C2.sp6:132098.Seq |
| M00001630B:H09 | 5214 | RTA00000186AF.g.11.1 |
| M00001651A:H01 | | RTA00000186AF.n.7.1 |
| M00001651A:H01 | | 90.A5.sp6:130863.Seq |
| M00001677C:E10 | 14627 | RTA00000187AF.g.23.1 |
| M00001679C:F01 | 78091 | 90.C7.sp6:130889.Seq |
| M00001679C:F01 | 78091 | RTA00000187AF.j.6.1 |
| M00001679C:F01 | 78091 | 176.G5.sp6:134588.Seq |
| M00001686A:E06 | 4622 | RTA00000187AF.m.15.2 |
| M00003796C:D05 | 5619 | RTA00000188AF.1.9.1.Seq_THC167845 |
| M00003796C:D05 | 5619 | RTA00000188AF.1.9.1 |
| M00003826B:A06 | 11350 | RTA00000189AF.a.24.2 |
| M00003826B:A06 | 11350 | 90.F9.sp6:130927.Seq |
| M00003833A:E05 | 21877 | RTA00000189AF.b.21.1 |
| M00003837D:A01 | 7899 | 90.H9.sp6:130951.Seq |
| M00003837D:A01 | 7899 | RTA00000189AF.c.10.1 |
| M00003846B:D06 | 6874 | RTA00000189AF.e.9.1 |
| M00003846B:D06 | 6874 | 90.C10.sp6:130892.Seq |
| M00003879B:D10 | 31587 | RTA00000189AF.l.20.1 |
| M00003879B:D10 | 31587 | 90.C12.sp6:130894.Seq |
| M00003879D:A02 | 14507 | 90.D12.sp6:130906.Seq |
| M00003879D:A02 | 14507 | RTA00000189AR.1.23.2 |
| M00003891C:H09 | | 90.G12.sp6:130942.Seq |
| M00003891C:H09 | | RTA00000189AF.p.8.1 |
| M00003912B:D01 | 12532 | 99.D1.sp6:131266.Seq |
| M00003912B:D01 | 12532 | RTA00000190AF.g.2.1 |
| M00004072B:B05 | 17036 | RTA00000191AF.j.10.1 |
| M00004081C:D12 | 14391 | RTA00000191AF.1.7.1 |
| M00004111D:A08 | 6874 | RTA00000192AF.a.14.1 |
| M00004111D:A08 | 6874 | 99.F5.sp6:131294.Seq |
| M00004121B:G01 | | 177.H4.sp6:134791.Seq |
| M00004121B:G01 | | 99.H5.sp6:131318.Seq |
| M00004121B:G01 | | RTA00000192AF.c.2.1 |
| M00004138B:H02 | 13272 | 99.A6.sp6:131235.Seq |
| M00004138B:H02 | 13272 | RTA00000192AF.e.3.1 |
| M00004151D:B08 | 16977 | RTA00000192AF.g.3.1 |
| M00004169C:C12 | 5319 | 99.E6.sp6:131283.Seq |
| M00004169C:C12 | 5319 | RTA00000192AF.i.12.1 |
| M00004169C:C12 | 5319 | 123.F7.sp6:132331.Seq |
| M00004183C:D07 | 16392 | RTA00000192AF.l.1.1 |
| M00004183C:D07 | 16392 | RTA00000192AF.l.1.1.Seq_THC202071 |
| M00004230B:C07 | 7212 | RTA00000193AF.b.14.1 |
| M00004230B:C07 | 7212 | 99.D8.sp6:131273.Seq |
| M00004249D:F10 | | RTA00000193AF.c.21.1.Seq_THC222602 |
| M00004249D:F10 | | RTA00000193AF.c.21.1 |
| M00004275C:C11 | 16914 | 99.A9.sp6:131238.Seq |
| M00004275C:C11 | 16914 | RTA00000193AF.f.5.1 |
| M00004283B:A04 | 14286 | RTA00000193AF.f.22.1 |
| M00004285B:E08 | 56020 | RTA00000193AF.g.2.1 |
| M00004327B:H04 | | RTA00000193AF.j.20.1 |
| M00004377C:F05 | 2102 | RTA00000193AF.n.7.1 |
| M00004384C:D02 | | RTA00000193AF.n.15.1 |
| M00004384C:D02 | | RTA00000193AF.n.15.1.Seq_THC215687 |
| M00004461A:B08 | | RTA00000194AR.a.10.2 |
| M00004461A:B09 | | RTA00000194AF.a.11.1 |
| M00004691D:A05 | | RTA00000194AF.c.23.1 |
| M00004896A:C07 | | RTA00000194AF.d.13.1 |

The above material has been deposited with the American Type Culture Collection, Rockville, Md., under the accession number indicated. This deposit will be maintained under the terms of the Budapest Treaty on the International Recognition of the Deposit of Microorganisms for purposes of Patent Procedure. The deposit will be maintained for a period of 30 years following issuance of this patent, or for the enforceable life of the patent, whichever is greater. Upon issuance of the patent, the deposit will be available to the public from the ATCC without restriction.

This deposit is provided merely as convenience to those of skill in the art, and is not an admission that a deposit is required under 35 U.S.C. §112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby.

Retrieval of Individual Clones from Deposit of Pooled Clones

Where the ATCC deposit is composed of a pool of cDNA clones, the deposit was prepared by first transfecting each of the clones into separate bacterial cells. The clones were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

Example 14

Source of Biological Materials and Overview of Novel Polynucleotides Expressed by the Biological Materials Human colon cancer cell line Km12L4-A (Morika, W. A. K. et al., *Cancer Research* (1988) 48:6863) was used to construct a cDNA library from mRNA isolated from the cells. As described in the above overview, a total of 4,693 sequences expressed by the Km12L4-A cell line were isolated and analyzed; most sequences were about 275-300 nucleotides in length. The KM12L4-A cell line is derived from the KM12C cell line. The KM12C cell line, which is poorly metastatic (low metastatic) was established in culture from a Dukes' stage $B_2$ surgical specimen (Morikawa et al. *Cancer Res.* (1988) 48:6863). The KML4-A is a highly metastatic subline derived from KM12C (Yeatman et al. *Nucl. Acids. Res.* (1995) 23:4007; Bao-Ling et al. *Proc. Ann. Meet. Am. Assoc. Cancer. Res.* (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res.* (1995) 1:19; Yeatman et al., (1995) supra; Yeatman et al. *Clin. Exp. Metastasis* (1996) 14:246).

The sequences were first masked to eliminate low complexity sequences using the XBLAST masking program (Claverie "Effective Large-Scale Sequence Similarity Searches," In: *Computer Methods for Macromolecular Sequence Analysis*, Doolittle, ed., *Meth. Enzymol.* 266:212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem.* (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. Masking resulted in the elimination of 43 sequences. The remaining sequences were then used in a BLASTN vs. Genbank search with search parameters of greater than 70% overlap, 99% identity, and a p value of less than $1 \times 10^{-40}$, which search resulted in the discarding of 1,432 sequences. Sequences from this search also were discarded if the inclusive parameters were met, but the sequence was ribosomal or vector-derived.

The resulting sequences from the previous search were classified into three groups (1, 2 and 3 below) and searched in a BLASTX vs. NRP (non-redundant proteins) database search: (1) unknown (no hits in the Genbank search), (2) weak similarity (greater than 45% identity and p value of less than $1 \times 10^{-5}$), and (3) high similarity (greater than 60% overlap, greater than 80% identity, and p value less than $1 \times 10^{-5}$). This search resulted in discard of 98 sequences as having greater than 70% overlap, greater than 99% identity, and p value of less than $1 \times 10^{-40}$.

The remaining sequences were classified as unknown (no hits), weak similarity, and high similarity (parameters as above). Two searches were performed on these sequences. First, a BLAST vs. EST database search resulted in discard of 1771 sequences (sequences with greater than 99% overlap, greater than 99% similarity and a p value of less than $1 \times 10^{-40}$; sequences with a p value of less than $1 \times 10^{-65}$ when compared to a database sequence of human origin were also excluded). Second, a BLASTN vs. Patent GeneSeq database resulted in discard of 15 sequences (greater than 99% identity; p value less than $1 \times 10^{-40}$; greater than 99% overlap).

The remaining sequences were subjected to screening using other rules and redundancies in the dataset. Sequences with a p value of less than $1 \times 10^{-111}$ in relation to a database sequence of human origin were specifically excluded. The final result provided the 2502 sequences listed in the accompanying Sequence Listing. The Sequence Listing is arranged beginning with sequences with no similarity to any sequence in a database searched, and ending with sequences with the greatest similarity. Each identified polynucleotide represents sequence from at least a partial mRNA transcript. Polynucleotides that were determined to be novel were assigned a sequence identification number.

The novel polynucleotides were assigned sequence identification numbers SEQ ID NOS:845-3346. The DNA sequences corresponding to the novel polynucleotides are provided in the Sequence Listing. The majority of the sequences are presented in the Sequence Listing in the 5' to 3' direction. A small number of sequences are listed in the Sequence Listing in the 5' to 3' direction but the sequence as written is actually 3' to 5'. These sequences are readily identified with the designation "AR" in the Sequence Name in Table 17 (inserted before the claims). The sequences correctly listed in the 5' to 3' direction in the Sequence Listing are designated "AF." Table 17 provides: 1) the SEQ ID NO assigned to each sequence for use in the present specification; 2) the filing date of the U.S. priority application in which the sequence was first filed; 3) the SEQ ID NO assigned to the sequence in the priority application; 4) the sequence name used as an internal identifier of the sequence; 5) the name assigned to the clone from which the sequence was isolated; and 6) the number of the cluster to which the sequence is assigned (Cluster ID; where the cluster ID is 0, the sequence was not assigned to any cluster Because the provided polynucleotides represent partial mRNA transcripts, two or more polynucleotides of the invention may represent different regions of the same mRNA transcript and the same gene. Thus, if two or more SEQ ID NOS:

are identified as belonging to the same clone, then either sequence can be used to obtain the full-length mRNA or gene. In addition, some sequences are identified with multiple SEQ ID NOS, since these sequences were present in more than one filing. For example, SEQ ID NO:931 and SEQ ID NO:1844 represent the same sequence.

In order to confirm the sequences of SEQ ID NOS:845-3346, inserts of the clones corresponding to these polynucleotides were re-sequenced. These "validation" sequences are provided in SEQ ID NOS:3347-5106. Of these validation sequences, SEQ ID NOS:3384, 4389, 4407, 5355, 5570, and 5593 are not true validation sequences. Instead, SEQ ID NOS: 4389, 5355, 5570, and 5593 represent "placeholder" sequences, i.e., sequences that were inserted into the Sequence Listing only to prevent renumbering of the subsequent sequences during generation of the Sequence Listing. Thus, reference to "SEQ ID NOS:845-6096," "SEQ ID NOS: 845-5950," or other ranges of SEQ ID NOS that include these placeholder sequences should be read to exclude SEQ ID NOS: 4389, 5355, 5570, and 5593.

The validation sequences were often longer than the original polynucleotide sequences they validate, and thus often provide additional sequence information. Validation sequences can be correlated with the original sequences they validate by referring to Table 17. For example, validation sequences of many SEQ ID NOS share the clone name of the sequence that they validate.

Example 15

Results of Public Database Search to Identify Function of Gene Products

SEQ ID NOS:845-3346, as well as the validation sequences were translated in all three reading frames to determine the best alignment with the individual sequences. These amino acid sequences and nucleotide sequences are referred, generally, as query sequences, which are aligned with the individual sequences. Query and individual sequences were aligned using the BLAST programs, available over the world wide web site of the NCBI. Again the sequences were masked to various extents to prevent searching of repetitive sequences or poly-A sequences, using the XBLAST program for masking low complexity as described above in Example 1.

Table 18 (inserted before the claims) shows the results of the alignments. Table 18 refers to each sequence by its SEQ ID NO:, the accession numbers and descriptions of nearest neighbors from the Genbank and Non-Redundant Protein searches, and the p values of the search results.

For each of "SEQ ID NOS:845-5950," the best alignment to a protein or DNA sequence is included in Table 18. The activity of the polypeptide encoded by "SEQ ID NOS: 845-5950" is the same or similar to the nearest neighbor reported in Table 18. The accession number of the nearest neighbor is reported, providing a reference to the activities exhibited by the nearest neighbor. The search program and database used for the alignment also are indicated as well as a calculation of the p value.

Full length sequences or fragments of the polynucleotide sequences of the nearest neighbors can be used as probes and primers to identify and isolate the full length sequence of "SEQ ID NOS: 845-5950." The nearest neighbors can indicate a tissue or cell type to be used to construct a library for the full-length sequences of "SEQ ID NOS: 845-5950."

"SEQ ID NOS: 845-5950" and the translations thereof may be human homologs of known genes of other species or novel allelic variants of known human genes. In such cases, these new human sequences are suitable as diagnostics or therapeutics. As diagnostics, the human sequences "SEQ ID NOS: 845-5950" exhibit greater specificity in detecting and differentiating human cell lines and types than homologs of other species. The human polypeptides encoded by "SEQ ID NOS: 845-5950" are likely to be less immunogenic when administered to humans than homologs from other species. Further, on administration to humans, the polypeptides encoded by "SEQ ID NOS: 845-5950" can show greater specificity or can be better regulated by other human proteins than are homologs from other species.

Example 16

Members of Protein Families

The validation sequences ("SEQ ID NOS:3347-5950") were used to conduct a profile search as described in the specification above. Several of the polynucleotides of the invention were found to encode polypeptides having characteristics of a polypeptide belonging to a known protein families (and thus represent new members of these protein families) and/or comprising a known functional domain (Table 19, inserted prior to claims). Thus the invention encompasses fragments, fusions, and variants of such polynucleotides that retain biological activity associated with the protein family and/or functional domain identified herein.

Start and stop indicate the position within the individual sequences that align with the query sequence having the indicated SEQ ID NO. The direction (Dir) indicates the orientation of the query sequence with respect to the individual sequence, where forward (for) indicates that the alignment is in the same direction (left to right) as the sequence provided in the Sequence Listing and reverse (rev) indicates that the alignment is with a sequence complementary to the sequence provided in the Sequence Listing.

Some polynucleotides exhibited multiple profile hits because, for example, the particular sequence contains overlapping profile regions, and/or the sequence contains two different functional domains. These profile hits are described in more detail below. The acronyms used in Table 19 are provided in parentheses following the full name of the protein family or functional domain to which they refer.

TABLE 19

Polynucleotides encoding gene products of a protein family or having a known functional domain(s).

| SEQ ID NO: | Validation Sequence | Biological Activity (Profile) | Start | Stop | Score | Direction |
|---|---|---|---|---|---|---|
| 4764 | 393.E10.sp6:148957 | 7tm_1 | 531 | 710 | 9520 | for |
| 3511 | 172.F10.sp6:133946 | 7tm_2 | 45 | 724 | 8708 | rev |
| 3602 | 177.C6.sp6:134733 | 7tm_2 | 41 | 697 | 9828 | rev |
| 3777 | 184.C7.sp6:135556 | 7tm_2 | 3 | 834 | 8987 | for |

TABLE 19-continued

Polynucleotides encoding gene products of a protein family or having a known functional domain(s).

| SEQ ID NO: | Validation Sequence | Biological Activity (Profile) | Start | Stop | Score | Direction |
|---|---|---|---|---|---|---|
| 3973 | 121.E12.sp6:131940 | 7tm_2 | 245 | 1324 | 9550 | rev |
| 4209 | 172.A7.sp6:133883 | 7tm_2 | 94 | 761 | 8743 | rev |
| 4262 | 123.F9.sp6:132333 | 7tm_2 | 203 | 585 | 8785 | rev |
| 4263 | 123.F9.sp6:132333 | 7tm_2 | 203 | 585 | 8785 | rev |
| 4441 | 394.G2.sp6:149165 | 7tm_2 | 73 | 793 | 9209 | for |
| 4492 | 370.C5.sp6:141726 | 7tm_2 | 76 | 770 | 9269 | for |
| 4530 | 370.B1.sp6:141710 | 7tm_2 | 89 | 662 | 8791 | for |
| 4539 | 368.A12.sp6:141322 | 7tm_2 | 121 | 719 | 9015 | rev |
| 4540 | 368.A12.sp6:141322 | 7tm_2 | 121 | 719 | 9015 | rev |
| 5016 | 219.C10.sp6:139007 | 7tm_2 | 46 | 774 | 11394 | rev |
| 5060 | 368.D11.sp6:141357 | 7tm_2 | 66 | 775 | 9384 | rev |
| 5072 | 368.A11.sp6:141321 | 7tm_2 | 7 | 1079 | 9097 | for |
| 5285 | 99.F7.sp6:131296 | 7tm_2 | 534 | 1265 | 10956 | rev |
| 5286 | 99.F7.sp6:131296 | 7tm_2 | 534 | 1265 | 10956 | rev |
| 5326 | 100.D2.sp6:131459 | 7tm_2 | 122 | 1404 | 9296 | rev |
| 5339 | 395.B12.sp6:149307 | 7tm_2 | 79 | 1432 | 10427 | rev |
| 5369 | 90.B4.sp6:130874 | 7tm_2 | 4 | 691 | 9435 | for |
| 5460 | 100.D5.sp6:131462 | 7tm_2 | 655 | 1349 | 9255 | for |
| 5497 | 100.D7.sp6:131464 | 7tm_2 | 357 | 1346 | 11461 | rev |
| 5498 | 100.D7.sp6:131464 | 7tm_2 | 357 | 1346 | 11461 | rev |
| 5502 | 100.H6.sp6:131511 | 7tm_2 | 119 | 1035 | 10001 | rev |
| 5503 | 100.G6.sp6:131499 | 7tm_2 | 363 | 1188 | 9901 | rev |
| 5504 | 100.F6.sp6:131487 | 7tm_2 | 50 | 1127 | 8799 | for |
| 5505 | 100.F6.sp6:131487 | 7tm_2 | 50 | 1127 | 8799 | for |
| 5554 | 367.H9.sp6:141210 | 7tm_2 | 143 | 1266 | 11883 | rev |
| 5599 | 370.F4.sp6:141761 | 7tm_2 | 78 | 704 | 8942 | for |
| 5700 | 367.H11.sp6:141212 | 7tm_2 | 176 | 1227 | 9975 | rev |
| 5729 | 123.E10.sp6:132322 | 7tm_2 | 210 | 691 | 9071 | rev |
| 5744 | 123.E10.sp6:132322 | 7tm_2 | 210 | 691 | 9071 | rev |
| 5745 | 123.E10.sp6:132322 | 7tm_2 | 210 | 691 | 9071 | rev |
| 3500 | 176.H11.sp6:134606 | ANK | 207 | 290 | 4450 | for |
| 3399 | 180.C9.sp6:135947 | asp | 156 | 670 | 6710 | for |
| 4476 | 368.H11.sp6:141405 | asp | 136 | 1226 | 6880 | rev |
| 5049 | 368.B5.sp6:141327 | asp | 309 | 806 | 6073 | for |
| 5095 | 369.D6.sp6:141546 | asp | 434 | 1332 | 6263 | rev |
| 5097 | 396.F9.sp6:149544 | asp | 97 | 1106 | 5999 | rev |
| 5105 | 216.G10.sp6:139247 | asp | 74 | 703 | 6188 | rev |
| 5209 | 122.H12.sp6:132168 | asp | 152 | 1040 | 6183 | rev |
| 5342 | 80.H6.sp6:130297 | asp | 61 | 418 | 5944 | rev |
| 5508 | 172.E5.sp6:133929 | asp | 219 | 976 | 6434 | for |
| 5562 | 185.D9.sp6:135762 | asp | 31 | 872 | 5944 | rev |
| 5577 | 185.D9.sp6:135762 | asp | 31 | 872 | 5944 | rev |
| 5590 | 176.B10.sp6:134533 | asp | 253 | 1446 | 6079 | rev |
| 5666 | 177.F3.sp6:134766 | asp | 0 | 894 | 6336 | rev |
| 5698 | 184.F11.sp6:135596 | asp | 61 | 737 | 6416 | rev |
| 5700 | 367.H11.sp6:141212 | asp | 81 | 1187 | 6182 | rev |
| 5773 | 180.E6.sp6:135968 | asp | 81 | 706 | 6150 | for |
| 5775 | 180.E6.sp6:135968 | asp | 81 | 706 | 6150 | for |
| 3567 | 180.F2.sp6:135976 | ATPases | 135 | 627 | 11664 | for |
| 3686 | 217.H11.sp6:139452 | ATPases | 2 | 701 | 5972 | for |
| 3863 | 216.B1.sp6:139178 | ATPases | 170 | 616 | 6150 | for |
| 3890 | 121.B8.sp6:131900 | ATPases | 13 | 635 | 5867 | rev |
| 4034 | 80.D2.sp6:130245 | ATPases | 13 | 386 | 6068 | for |
| 4134 | 176.C6.sp6:134541 | ATPases | 85 | 579 | 5883 | for |
| 4514 | 369.C10.sp6:141538 | ATPases | 329 | 730 | 6206 | for |
| 4842 | 394.H8.sp6:149183 | ATPases | 21 | 571 | 5954 | rev |
| 4963 | 218.F11.sp6:138852 | ATPases | 313 | 816 | 6057 | for |
| 5003 | 219.A7.sp6:138980 | ATPases | 88 | 662 | 6145 | for |
| 5067 | 368.F9.sp6:141379 | ATPases | 178 | 648 | 5937 | for |
| 5228 | 181.G11.sp6:135354 | ATPases | 362 | 769 | 5900 | rev |
| 5317 | 369.B4.sp6:141520 | ATPases | 4 | 412 | 14130 | for |
| 5384 | 218.C8.sp6:138813 | ATPases | 12 | 576 | 5782 | rev |
| 5404 | 404.G6.sp6:162933 | ATPases | 86 | 605 | 6001 | rev |
| 5533 | 367.H8.sp6:141209 | ATPases | 17 | 476 | 5905 | rev |
| 5629 | 184.E5.sp6:135578 | ATPases | 184 | 632 | 5943 | for |
| 5636 | 184.C6.sp6:135555 | ATPases | 333 | 813 | 5773 | for |
| 5691 | 184.B11.sp6:135548 | ATPases | 14 | 498 | 6140 | for |
| 5885 | 377.C1.sp6:141918 | ATPases | 4 | 655 | 5933 | for |
| 4248 | 176.F10.sp6:134581 | Bcl-2 | 69 | 356 | 16419 | for |
| 4880 | 367.F5.sp6:141182 | bromodomain | 40 | 210 | 8810 | for |
| 5333 | 369.D3.sp6:141543 | bromodomain | 63 | 230 | 10270 | for |
| 4252 | 172.E1.sp6:133925 | BZIP | 146 | 298 | 4066 | for |
| 4795 | 393.G5.sp6:148976 | BZIP | 116 | 304 | 5931 | for |
| 5694 | 172.E9.sp6:133933 | BZIP | 91 | 260 | 4366 | for |

TABLE 19-continued

Polynucleotides encoding gene products of a protein family or having a known functional domain(s).

| SEQ ID NO: | Validation Sequence | Biological Activity (Profile) | Start | Stop | Score | Direction |
|---|---|---|---|---|---|---|
| 4462 | 370.B12.sp6:141721 | cyclin | 118 | 324 | 8980 | for |
| 4739 | 395.G6.sp6:149361 | cyclin | 11 | 281 | 6930 | for |
| 5380 | 395.G8.sp6:149363 | cyclin | 12 | 279 | 5950 | for |
| 5299 | 99.F5.sp6:131294 | Cys-protease | 72 | 348 | 18479 | for |
| 5528 | 180.D1.sp6:135951 | Cys-protease | 38 | 992 | 10103 | rev |
| 5532 | 180.D1.sp6:135951 | Cys-protease | 38 | 992 | 10103 | rev |
| 5645 | 177.E4.sp6:134755 | Cys-protease | 48 | 326 | 19999 | for |
| 5503 | 100.G6.sp6:131499 | DAG__PE__bind | 605 | 702 | 6290 | rev |
| 5665 | 377.C8.sp6:141925 | Dead_box_helic | 172 | 828 | 7867 | rev |
| 5927 | 216.A1.sp6:139166 | Dead_box_helic | 44 | 589 | 26532 | for |
| 3578 | 177.G4.sp6:134779 | EFhand | 79 | 153 | 3780 | for |
| 3737 | 185.A1.sp6:135718 | EFhand | 287 | 358 | 2580 | rev |
| 4619 | 377.A5.sp6:141898 | EFhand | 477 | 563 | 3010 | for |
| 4900 | 367.B7.sp6:141136 | EFhand | 225 | 272 | 2500 | rev |
| 4996 | 218.B10.sp6:138803 | EFhand | 40 | 114 | 2640 | rev |
| 4997 | 218.B10.sp6:138803 | EFhand | 40 | 114 | 2640 | rev |
| 4998 | 218.C10.sp6:138815 | EFhand | 39 | 113 | 2640 | rev |
| 5749 | 393.H12.sp6:148995 | EFhand | 145 | 231 | 4640 | for |
| 5787 | 219.A9.sp6:138982 | EFhand | 685 | 750 | 2550 | rev |
| 3693 | 218.B5.sp6:138798 | Ets__Nterm | 340 | 531 | 10400 | for |
| 3572 | 180.A2.sp6:135916 | FNtypeII | 291 | 423 | 6400 | rev |
| 3862 | 216.C1.sp6:139190 | FNtypeII | 501 | 634 | 6460 | for |
| 5340 | 218.G1.sp6:138854 | FNtypeII | 20 | 141 | 6180 | rev |
| 5758 | 393.H8.sp6:148991 | FNtypeII | 448 | 576 | 6110 | for |
| 3348 | 181.C3.sp6:135298 | G-alpha | 66 | 715 | 8084 | rev |
| 4134 | 176.C6.sp6:134541 | G-alpha | 62 | 690 | 9062 | for |
| 5132 | 121.B4.sp6:131896 | G-alpha | 46 | 447 | 21415 | for |
| 5288 | 217.D12.sp6:139405 | G-alpha | 15 | 702 | 40404 | for |
| 5406 | 404.B7.sp6:162874 | G-alpha | 120 | 682 | 8424 | for |
| 3347 | 180.A11.sp6:135925 | helicase__C | 165 | 479 | 4494 | for |
| 5313 | 369.C4.sp6:141532 | helicase__C | 559 | 756 | 3732 | rev |
| 5864 | 185.D12.sp6:135765 | helicase__C | 381 | 534 | 5000 | for |
| 5085 | 396.H8.sp6:149567 | homeobox | 80 | 230 | 5170 | for |
| 3394 | 180.E5.sp6:135967 | mkk | 342 | 612 | 5791 | for |
| 4251 | 172.F1.sp6:133937 | mkk | 94 | 669 | 5688 | rev |
| 4295 | 123.A2.sp6:132266 | mkk | 26 | 378 | 7889 | for |
| 4444 | 394.B3.sp6:149106 | mkk | 32 | 782 | 9544 | for |
| 4490 | 370.H4.sp6:141785 | mkk | 18 | 307 | 9394 | for |
| 4524 | 369.G11.sp6:141587 | mkk | 182 | 725 | 5375 | for |
| 5019 | 219.H10.sp6:139067 | mkk | 280 | 723 | 15454 | for |
| 5049 | 368.B5.sp6:141327 | mkk | 249 | 725 | 5502 | for |
| 5122 | 181.C9.sp6:135304 | mkk | 168 | 880 | 5551 | rev |
| 5166 | 121.F6.sp6:131946 | mkk | 111 | 730 | 5399 | for |
| 5621 | 177.E2.sp6:134753 | mkk | 288 | 636 | 5720 | rev |
| 5326 | 100.D2.sp6:131459 | PDEase | 849 | 1195 | 5945 | for |
| 3422 | 181.H11.sp6:135366 | protkinase | 116 | 710 | 5531 | for |
| 3556 | 177.G7.sp6:134782 | protkinase | 6 | 511 | 5445 | for |
| 3679 | 218.C1.sp6:138806 | protkinase | 127 | 747 | 5492 | for |
| 3687 | 218.E1.sp6:138830 | protkinase | 64 | 726 | 5592 | rev |
| 3815 | 217.F4.sp6:139421 | protkinase | 83 | 702 | 5818 | rev |
| 3853 | 217.A4.sp6:139361 | protkinase | 57 | 682 | 5395 | rev |
| 3928 | 121.E2.sp6:131930 | protkinase | 69 | 658 | 5593 | rev |
| 4070 | 100.D8.sp6:131465 | protkinase | 174 | 620 | 5453 | for |
| 4118 | 100.C3.sp6:131448 | protkinase | 228 | 736 | 5616 | for |
| 4200 | 172.B5.sp6:133893 | protkinase | 148 | 715 | 5381 | for |
| 4221 | 172.B6.sp6:133894 | protkinase | 119 | 775 | 5616 | for |
| 4295 | 123.A2.sp6:132266 | protkinase | 24 | 384 | 9797 | for |
| 4444 | 394.B3.sp6:149106 | protkinase | 357 | 780 | 11395 | for |
| 4479 | 377.G11.sp6:141976 | protkinase | 117 | 739 | 5992 | for |
| 4490 | 370.H4.sp6:141785 | protkinase | 24 | 275 | 8338 | for |
| 4509 | 370.F2.sp6:141759 | protkinase | 33 | 800 | 5658 | for |
| 4513 | 369.B10.sp6:141526 | protkinase | 1 | 482 | 5504 | rev |
| 4544 | 369.D2.sp6:141542 | protkinase | 28 | 661 | 5428 | for |
| 4554 | 369.G6.sp6:141582 | protkinase | 71 | 631 | 5751 | for |
| 4635 | 396.C11.sp6:149510 | protkinase | 27 | 709 | 5793 | rev |
| 4749 | 393.H7.sp6:148990 | protkinase | 88 | 680 | 5470 | rev |
| 4763 | 393.D10.sp6:148945 | protkinase | 72 | 594 | 5617 | for |
| 4888 | 367.G4.sp6:141193 | protkinase | 30 | 699 | 5439 | for |
| 4916 | 368.B2.sp6:141324 | protkinase | 44 | 800 | 5556 | for |
| 4961 | 218.D11.sp6:138828 | protkinase | 38 | 781 | 6423 | for |
| 5019 | 219.H10.sp6:139067 | protkinase | 277 | 717 | 15720 | for |
| 5217 | 216.E5.sp6:139218 | protkinase | 115 | 710 | 5537 | for |
| 5413 | 100.C10.sp6:131455 | protkinase | 56 | 783 | 5556 | rev |
| 5599 | 370.F4.sp6:141761 | protkinase | 39 | 803 | 5635 | for |

TABLE 19-continued

Polynucleotides encoding gene products of a protein family or having a known functional domain(s).

| SEQ ID NO: | Validation Sequence | Biological Activity (Profile) | Start | Stop | Score | Direction |
|---|---|---|---|---|---|---|
| 5604 | 370.F3.sp6:141760 | protkinase | 188 | 775 | 5771 | for |
| 5651 | 184.H3.sp6:135612 | protkinase | 23 | 699 | 5515 | for |
| 5903 | 180.B5.sp6:135931 | protkinase | 182 | 671 | 5718 | rev |
| 5946 | 393.F4.sp6:148963 | protkinase | 28 | 650 | 5345 | for |
| 4515 | 369.D10.sp6:141550 | ras | 12 | 332 | 9802 | for |
| 4780 | 393.A3.sp6:148902 | Thioredox | 0 | 263 | 5887 | rev |
| 4771 | 393.F11.sp6:148970 | TNFR_c6 | 151 | 261 | 6445 | for |
| 3800 | 184.E10.sp6:135583 | transmembrane4 | 19 | 483 | 8339 | rev |
| 3825 | 217.E6.sp6:139411 | transmembrane4 | 83 | 728 | 8417 | for |
| 4680 | 396.C9.sp6:149508 | transmembrane4 | 300 | 924 | 9444 | rev |
| 4882 | 367.A6.sp6:141123 | transmembrane4 | 32 | 495 | 8407 | for |
| 5208 | 123.A1.sp6:132265 | transmembrane4 | 1289 | 1548 | 8114 | rev |
| 5250 | 122.C1.sp6:132097 | transmembrane4 | 6 | 535 | 8122 | for |
| 5275 | 122.E4.sp6:132124 | transmembrane4 | 10 | 530 | 8829 | for |
| 5285 | 99.F7.sp6:131296 | transmembrane4 | 613 | 1253 | 9443 | rev |
| 5286 | 99.F7.sp6:131296 | transmembrane4 | 613 | 1253 | 9443 | rev |
| 5497 | 100.D7.sp6:131464 | transmembrane4 | 335 | 1207 | 8255 | rev |
| 5498 | 100.D7.sp6:131464 | transmembrane4 | 335 | 1207 | 8255 | rev |
| 5554 | 367.H9.sp6:141210 | transmembrane4 | 398 | 1130 | 8352 | rev |
| 5788 | 180.H7.sp6:136005 | transmembrane4 | 356 | 983 | 8356 | rev |
| 4225 | 176.D9.sp6:134556 | trypsin | 164 | 764 | 9670 | rev |
| 5528 | 180.D1.sp6:135951 | trypsin | 371 | 1229 | 10479 | rev |
| 5532 | 180.D1.sp6:135951 | trypsin | 371 | 1229 | 10479 | rev |
| 3598 | 177.H6.sp6:134793 | WD_domain | 345 | 437 | 6510 | for |
| 3890 | 121.B8.sp6:131900 | WD_domain | 98 | 193 | 6400 | for |
| 4071 | 100.B10.sp6:131443 | WD_domain | 544 | 642 | 6590 | for |
| 5087 | 121.A8.sp6:131888 | WD_domain | 93 | 188 | 6400 | for |
| 5890 | 185.F10.sp6:135787 | WD_domain | 382 | 480 | 5880 | for |
| 3973 | 121.E12.sp6:131940 | Wnt_dev_sign | 101 | 821 | 12160 | rev |
| 4017 | 99.G6.sp6:131307 | Wnt_dev_sign | 49 | 880 | 12334 | rev |
| 4234 | 176.C9.sp6:134544 | Wnt_dev_sign | 249 | 854 | 11038 | rev |
| 4235 | 176.C9.sp6:134544 | Wnt_dev_sign | 249 | 854 | 11038 | rev |
| 4500 | 370.G6.sp6:141775 | Wnt_dev_sign | 211 | 785 | 11490 | rev |
| 4680 | 396.C9.sp6:149508 | Wnt_dev_sign | 282 | 1017 | 12318 | rev |
| 5097 | 396.F9.sp6:149544 | Wnt_dev_sign | 482 | 1298 | 11217 | rev |
| 5174 | 122.A2.sp6:132074 | Wnt_dev_sign | 94 | 933 | 12383 | rev |
| 5203 | 123.B2.sp6:132278 | Wnt_dev_sign | 538 | 1435 | 11785 | for |
| 5208 | 123.A1.sp6:132265 | Wnt_dev_sign | 760 | 1544 | 12660 | rev |
| 5219 | 122.G10.sp6:132154 | Wnt_dev_sign | 29 | 884 | 11603 | rev |
| 5229 | 122.A2.sp6:132074 | Wnt_dev_sign | 94 | 933 | 12383 | rev |
| 5253 | 121.F12.sp6:131952 | Wnt_dev_sign | 9 | 734 | 11167 | rev |
| 5285 | 99.F7.sp6:131296 | Wnt_dev_sign | 560 | 1399 | 13749 | rev |
| 5286 | 99.F7.sp6:131296 | Wnt_dev_sign | 560 | 1399 | 13749 | rev |
| 5379 | 395.F10.sp6:149353 | Wnt_dev_sign | 100 | 907 | 11535 | rev |
| 5430 | 123.A4.sp6:132268 | Wnt_dev_sign | 80 | 1122 | 11249 | rev |
| 5449 | 404.D5.sp6:162896 | Wnt_dev_sign | 31 | 816 | 11304 | rev |
| 5497 | 100.D7.sp6:131464 | Wnt_dev_sign | 467 | 1314 | 11882 | rev |
| 5498 | 100.D7.sp6:131464 | Wnt_dev_sign | 467 | 1314 | 11882 | rev |
| 5509 | 177.B11.sp6:134726 | Wnt_dev_sign | 137 | 1266 | 12708 | rev |
| 5512 | 177.B11.sp6:134726 | Wnt_dev_sign | 137 | 1266 | 12708 | rev |
| 5526 | 177.B11.sp6:134726 | Wnt_dev_sign | 137 | 1266 | 12708 | rev |
| 5554 | 367.H9.sp6:141210 | Wnt_dev_sign | 692 | 1481 | 12886 | rev |
| 5562 | 185.D9.sp6:135762 | Wnt_dev_sign | 129 | 890 | 11145 | rev |
| 5568 | 377.D2.sp6:141931 | Wnt_dev_sign | 400 | 1227 | 11044 | rev |
| 5577 | 185.D9.sp6:135762 | Wnt_dev_sign | 129 | 890 | 11145 | rev |
| 5700 | 367.H11.sp6:141212 | Wnt_dev_sign | 295 | 1669 | 13366 | rev |
| 5710 | 377.D4.sp6:141933 | Wnt_dev_sign | 549 | 1380 | 14522 | rev |
| 5769 | 219.B12.sp6:138997 | Wnt_dev_sign | 312 | 1214 | 13188 | rev |
| 5803 | 219.B12.sp6:138997 | Wnt_dev_sign | 312 | 1214 | 13188 | rev |
| 4253 | 172.D1.sp6:133913 | Y_phosphatase | 476 | 804 | 6932 | for |
| 4262 | 123.F9.sp6:132333 | Y_phosphatase | 28 | 439 | 6096 | rev |
| 4263 | 123.F9.sp6:132333 | Y_phosphatase | 28 | 439 | 6096 | rev |
| 4501 | 370.H6.sp6:141787 | Y_phosphatase | 148 | 554 | 6481 | for |
| 4648 | 404.B10.sp6:162877 | Y_phosphatase | 104 | 466 | 6446 | rev |
| 4650 | 404.D10.sp6:162901 | Y_phosphatase | 9 | 614 | 6516 | for |
| 4818 | 395.F2.sp6:149345 | Y_phosphatase | 164 | 645 | 6093 | rev |
| 5082 | 121.E9.sp6:131937 | Y_phosphatase | 240 | 777 | 6147 | rev |
| 5107 | 216.F10.sp6:139235 | Y_phosphatase | 21 | 504 | 6342 | for |
| 5187 | 122.E9.sp6:132129 | Y_phosphatase | 381 | 807 | 6036 | rev |
| 5207 | 123.B1.sp6:132277 | Y_phosphatase | 61 | 510 | 6229 | rev |
| 5278 | 219.F4.sp6:139037 | Y_phosphatase | 2 | 261 | 10353 | for |
| 5317 | 369.B4.sp6:141520 | Y_phosphatase | 231 | 768 | 6110 | rev |
| 5473 | 404.E11.sp6:162914 | Y_phosphatase | 580 | 920 | 6005 | rev |
| 5938 | 217.A3.sp6:139360 | Y_phosphatase | 263 | 622 | 6222 | rev |

TABLE 19-continued

Polynucleotides encoding gene products of a protein family or having a known functional domain(s).

| SEQ ID NO: | Validation Sequence | Biological Activity (Profile) | Start | Stop | Score | Direction |
|---|---|---|---|---|---|---|
| 3582 | 177.A6.sp6:134709 | Zincfing_C2H2 | 65 | 127 | 4380 | for |
| 3604 | 177.A6.sp6:134709 | Zincfing_C2H2 | 65 | 127 | 4380 | for |
| 3676 | 218.B2.sp6:138795 | Zincfing_C2H2 | 94 | 156 | 4940 | for |
| 4580 | 377.H8.sp6:141985 | Zincfing_C2H2 | 495 | 557 | 4850 | for |
| 4606 | 377.G2.sp6:141967 | Zincfing_C2H2 | 52 | 114 | 4380 | for |
| 4607 | 377.G2.sp6:141967 | Zincfing_C2H2 | 52 | 114 | 4380 | for |
| 5638 | 377.G4.sp6:141969 | Zincfing_C2H2 | 247 | 308 | 3930 | for |
| 5934 | 185.C4.sp6:135745 | Zincfing_C2H2 | 238 | 300 | 4540 | for |
| 4618 | 377.E4.sp6:141945 | Zincfing_C3HC4 | 128 | 244 | 9335 | for |
| 5321 | 181.E3.sp6:135322 | Zincfing_C3HC4 | 321 | 445 | 8221 | for | a) Seven Transmembrane Integral Membrane Proteins—Rhodopsin Family (7tm_1). Several of the validation sequences, and thus their corresponding sequence within SEQ ID NOS:845-3346, correspond to a sequence encoding a polypeptide that is a member of the seven transmembrane receptor rhodopsin family. G-protein coupled receptors of the seven transmembrane rhodopsin family (also called R7G) are an extensive group of hormones, neurotransmitters, and light receptors which transduce extracellular signals by interaction with guanine nucleotide-binding (G) proteins (Strosberg A. D. Eur. J. Biochem. (1991) 196:1, Kerlavage A. R. Curr. Opin. Struct. Biol. (1991) 1:394, Probst, et al., DNA Cell Biol. (1992) 11:1, Savarese, et al., Biochem. J. (1992) 283:1. The receptors that are currently known to belong to this family are: 1) 5-hydroxytryptamine (serotonin) 1A to 1F, 2A to 2C, 4, 5A, 5B, 6 and 7 (Branchek T., Curr. Biol. (1993) 3:315); 2) acetylcholine, muscarinic-type, M1 to M5; 3) adenosine A1, A2A, A2B and A3 (Stiles G. L. J. Biol. Chem. (1992) 267: 6451; 4) adrenergic alpha-1A to -1C; alpha-2A to -2D; beta-1 to -3 (Friell T. et al., Trends Neurosci. (1988) 11:321); 5) angiotensin II types I and II; 6) bombesin subtypes 3 and 4; 7) bradykinin B1 and B2; 8) c3a and C5a anaphylatoxin; 9) cannabinoid CB1 and CB2; 10) chemokines C-C CC-CKR-1 to CC-CKR-8; 11) Chemokines C-X-C CXC-CKR-1 to CXC-CKR-4; 12) Cholecystokinin-A and cholecystokinin-B/gastrin Dopamine D1 to D5 (Stevens C. F., Curr. Biol. (1991) 1:20); 13) Endothelin ET-a and ET-b (Sakurai T. et al., Trends Pharmacol. Sci. (1992) 13:103-107); 14) fMet-Leu-Phe (fMLP) (Nformyl peptide); 15) Follicle stimulating hormone (FSH-R); 16) Galanin; 17) Gastrin-releasing peptide (GRP-R); 18) Gonadotropin-releasing hormone (GNRH-R); 19) Histamine H1 and H2 (gastric receptor I); 20) Lutropin-choriogonadotropic hormone (LSH-R) (Salesse R., et al., Biochimie (1991) 73:109); 21) Melanocortin MC1R to MC5R; 22) Melatonin; 23) Neuromedin B (NMB-R); 24) Neuromedin K (NK-3R); 25) Neuropeptide Y types 1 to 6; 26) Neurotensin (NT-R); 27) Octopamine (tyramine), from insects; 28) Odorants (Lancet D., et al., Curr. Biol. (1993)3: 668; 29) Opioids delta-, kappa- and mu-types (Uhl G. R., et al., Trends Neurosci. (1994) 17:89; 30) Oxytocin (OT-R); 31) Platelet activating factor (PAF-R); 32) Prostacyclin; 33) Prostaglandin D2; 34) Prostaglandin E2, EP1 to EP4 subtypes; 35) Prostaglandin F2; 36) Purinoreceptors (ATP) (Barnard E. A., et al., Trends Pharmacol. Sci. (1994)15:67; 37); Somatostatin types 1 to 5; 38) Substance-K (NK-2R); Substance-P (NK-1R); 39) Thrombin; 40) Thromboxane A2; 41) Thyrotropin (TSH-R) (Salesse R., et al., Biochimie (1991) 73:109); 42) Thyrotropin releasing factor (TRH-R); 42) Vasopressin V1a, V1b and V2; 43) Visual pigments (opsins and rhodopsin) (Applebury M. L., et al., Vision Res. (1986) 26:1881; 44) Proto-oncogene mas; 45) A number of orphan receptors (whose ligand is not known) from mammals and birds; 46) Caenorhabditis elegans putative receptors C06G4.5, C38C10.1, C43C3.2; 47) T27D1.3 and ZC84.4; 48) Three putative receptors encoded in the genome of cytomegalovirus: US27, US28, and UL33; and 49) ECRF3, a putative receptor encoded in the genome of herpesvirus saimiri.

The structure of these receptors is thought to be identical. They have seven hydrophobic regions, each of which most probably spans the membrane. The N-terminus is located on the extracellular side of the membrane and is often glycosylated, while the C-terminus is cytoplasmic and generally phosphorylated. Three extracellular loops alternate with three intracellular loops to link the seven transmembrane regions. Most, but not all of these receptors, lack a signal peptide. The most conserved parts of these proteins are the transmembrane regions and the first two cytoplasmic loops. A conserved acidic-Arg-aromatic triplet is present in the N-terminal extremity of the second cytoplasmic loop (Attwood T. K., Eliopoulos E. E., Findlay J. B. C. Gene (1991) 98:153-159) and could be implicated in the interaction with G proteins.

b) Seven Transmembrane Integral Membrane Proteins—Secretin Family (7tm_2). Several of the validation sequences, and thus their corresponding sequence in the sequence listing, correspond to a sequence encoding a polypeptide that is a member of the seven transmembrane receptor secretin family. A number of peptide hormones bind to G-protein coupled receptors that, while structurally similar to the majority of G-protein coupled receptors (R7G) (see profile for 7 transmembrane receptors (rhodopsin family), do not show any similarity at the level of their sequence, thus new family whose current known members (Jueppner et al. Science (1991) 254:1024; Hamann et al. Genomnics (1996) 32:144) are: 1) calcitonin receptor, 2) calcitonin gene-related peptide receptor; 3) corticotropin releasing factor receptor types 1 and 2; 4) gastric inhibitory polypeptide receptor; 5) glucagon receptor; 6) glucagon-like peptide 1 receptor; 7) growth hormone-releasing hormone receptor; 7) parathyroid hormone/parathyroid hormone-related peptide types 1 and 2; 8) pituitary adenylate cyclase activating polypeptide receptor; 9) secretin receptor; 10) vasoactive intestinal peptide receptor types 1 and 2; 10) insects diuretic hormone receptor; 11) Caenorhabditis elegans putative receptor C13B9.4; 12) Caenorhabditis elegans putative receptor ZK643.3; 13) human leucocyte CD97 (which contains 3 EGF-like domains in its N-terminal section); 14) human cell surface glycoprotein EMR1 (which contains 6 EGF-like domains in it N-terminal section); and 15) mouse cell surface glycoprotein F4/80 (which contains 7 EGF-like domains in its N-terminal section). All of 1) through 10) are coupled to G-proteins which activate both adenylyl cyclase and the phosphatidylinositol-calcium pathway.

Like classical R7G the secretin family of 7 transmembrane proteins contain seven transmembrane regions. Their N-terminus is located on the extracellular side of the membrane and potentially glycosylated, while their C-terminus is cytoplasmic. But apart from these topological similarities they do not share any region of sequence similarity and are therefore probably not evolutionary related.

Every receptor in the 7 transmember secretin family is encoded on multiple exons, and several of these functionally distinct products. The N-terminal extracellular domain of these receptors contains five conserved cysteines residues that may be involved in disulfide bonds, with a consensus pattern in the region that spans the first three cysteines. One of the most highly conserved regions spans the C-terminal part of the last transmembrane region and the beginning of the adjacent intracellular region. This second region is used as a second signature pattern.

c) Ank Repeats (ANK). The ankyrin motif is a 33 amino acid sequence named after the protein ankyrin which has 24 tandem 33-amino-acid motifs. Ank repeats were originally identified in the cell-cycle-control protein cdc10 (Breeden et al., *Nature* (1987) 329:651). Proteins containing ankyrin repeats include ankyrin, myotropin, I-kappaB proteins, cell cycle protein cdc10, the Notch receptor (Matsuno et al., *Development* (1997) 124(21):4265); G9a (or BAT8) of the class III region of the major histocompatibility complex (Biochem J. 290:811-818, 1993), FABP, GABP, 53BP2, Lin12, glp-1, SW14, and SW16. The functions of the ankyrin repeats are compatible with a role in protein-protein interactions (Bork, *Proteins* (1993) 17(4):363; Lambert and Bennet, *Eur. J. Biochem.* (1993) 211:1; Kerr et al., *Current Op. Cell Biol.* (1992) 4:496; Bennet et al., *J. Biol. Chem.* (1980) 255:6424).

The 90 kD N-terminal domain of ankyrin contains a series of 24 33-amino-acid ank repeats. (Lux et al., *Nature* (1990) 344:36-42, Lambert et al., *PNAS USA* (1990) 87:1730.) The 24 ank repeats form four folded subdomains of 6 repeats each. These four repeat subdomains mediate interactions with at least 7 different families of membrane proteins. Ankyrin contains two separate binding sites for anion exchanger dimers. One site utilizes repeat subdomain two (repeats 7-12) and the other requires both repeat subdomains 3 and 4 (repeats 13-24). Since the anion exchangers exist in dimers, ankyrin binds 4 anion exchangers at the same time (Michaely and Bennett, *J. Biol. Chem.* (1995) 270(37):22050). The repeat motifs are involved in ankyrin interaction with tubulin, spectrin, and other membrane proteins. (Lux et al., *Nature* (1990) 344:36.)

The Rel/NF-kappaB/Dorsal family of transcription factors have activity that is controlled by sequestration in the cytoplasm in association with inhibitory proteins referred to as I-kappaB. (Gilmore, *Cell* (1990) 62:841; Nolan and Baltimore, *Curr Opin Genet Dev.* (1992) 2:211; Baeuerle, *Biochim Biophys Acta* (1991) 1072:63; Schmitz et al., *Trends Cell Biol.* (1991) 1:130.) I-kappaB proteins contain 5 to 8 copies of 33 amino acid ankyrin repeats and certain NF-kappaB/rel proteins are also regulated by cis-acting ankyrin repeat containing domains including p105NF-kappaB which contains a series of ankyrin repeats (Diehl and Hannink, *J. Virol.* (1993) 67(12):7161). The I-kappaBs and Cactus (also containing ankyrin repeats) inhibit activators through differential interactions with the Rel-homology domain. The gene family includes proto-oncogenes, thus broadly implicating I-kappaB in the control of both normal gene expression and the aberrant gene expression that makes cells cancerous. (Nolan and Baltimore, *Curr Opin Genet Dev.* (1992) 2(2):211-220). In the case of rel/NF-kappaB and pp40/I-kappaB (both the ankyrin repeats and the carboxy-terminal domain are required for inhibiting DNA-binding activity and direct association of pp40/I-kappaB (with rel/NF-kappaB protein. The ankyrin repeats and the carboxy-terminal of pp40/I-kappaB (form a structure that associates with the rel homology domain to inhibit DNA binding activity (Inoue et al., *PNAS USA* (1992) 89:4333).

The 4 ankyrin repeats in the amino terminus of the transcription factor subunit GABP☐ are required for its interaction with the GABP☐ subunit to form a functional high affinity DNA-binding protein. These repeats can be crosslinked to DNA when GABP is bound to its target sequence. (Thompson et al., *Science* (1991) 253:762; LaMarco et al., *Science* (1991) 253:789). Myotrophin, a 12.5 kDa protein having a key role in the initiation of cardiac hypertrophy, comprises ankyrin repeats. The ankyrin repeats are characteristic of a hairpin-like protruding tip followed by a helix-turn-helix motif. The V-shaped helix-turn-helix of the repeats stack sequentially in bundles and are stabilized by compact hydrophobic cores, whereas the protruding tips are less ordered.

d) Eukaryotic Aspartyl Proteases (asp). Several of the validation sequences correspond to a sequence encoding a novel eukaryotic aspartyl protease. Aspartyl proteases, known as acid proteases, (EC 3.4.23.-) are a widely distributed family of proteolytic enzymes (Foltmann B., *Essays Biochem.* (1981) 17:52; Davies D. R., *Annu. Rev. Biophys. Chem.* (1990) 19:189; Rao J. K. M., et al., *Biochemistry* (1991) 30:4663) known to exist in vertebrates, fungi, plants, retroviruses and some plant viruses. Aspartate proteases of eukaryotes are monomeric enzymes which consist of two domains. Each domain contains an active site centered on a catalytic aspartyl residue. The two domains most probably evolved from the duplication of an ancestral gene encoding a primordial domain. Currently known eukaryotic aspartyl proteases include: 1) Vertebrate gastric pepsins A and C (also known as gastricsin); 2) Vertebrate chymosin (rennin), involved in digestion and used for making cheese; 3) Vertebrate lysosomal cathepsins D (EC 3.4.23.5) and E (EC 3.4.23.34); 4) Mammalian renin (EC 3.4.23.15) whose function is to generate angiotensin I from angiotensinogen in the plasma; 5) Fungal proteases such as aspergillopepsin A (EC 3.4.23.18), candidapepsin (EC 3.4.23.24), mucoropepsin (EC 3.4.23.23) (mucor rennin), endothiapepsin (EC 3.4.23.22), polyporopepsin (EC 3.4.23.29), and rhizopuspepsin (EC 3.4.23.21); and 6) Yeast saccharopepsin (EC 3.4.23.25) (proteinase A) (gene PEP4). PEP4 is implicated in posttranslational regulation of vacuolar hydrolases; 7) Yeast barrierpepsin (EC 3.4.23.35) (gene BAR1); a protease that cleaves alpha-factor and thus acts as an antagonist of the mating pheromone; and 8) Fission yeast sxa1 which is involved in degrading or processing the mating pheromones.

Most retroviruses and some plant viruses, such as badnaviruses, encode for an aspartyl protease which is an homodimer of a chain of about 95 to 125 amino acids. In most retroviruses, the protease is encoded as a segment of a polyprotein which is cleaved during the maturation process of the virus. It is generally part of the pol polyprotein and, more rarely, of the gag polyprotein. Because the sequence around the two aspartates of eukaryotic aspartyl proteases and around the single active site of the viral proteases is conserved, a single signature pattern can be used to identify members of both groups of proteases.

e) ATPases Associated with Various Cellular Activities (ATPases). Several of the validation sequences, correspond to a sequence that encodes a novel member of the "ATPases Associated with diverse cellular Activities" (AAA) protein family. The AAA protein family is composed of a large number of ATPases that share a conserved region of about 220 amino acids that contains an ATP-binding site (Froehlich et al., J. Cell Biol. (1991) 114:443; Erdmann et al. Cell (1991) 64:499; Peters et al., EMBO J. (1990) 9:1757; Kunau et al., Biochimie (1993) 75:209-224; Confalonieri et al., BioEssays (1995) 17:639; see internet site at yeamob.pci.chemie.uni-tuebingen.de/A-AA/Description.html). The proteins that belong to this family either contain one or two AAA domains.

Proteins containing two AAA domains include: 1) Mammalian and drosophila NSF (N-ethylmaleimide-sensitive fusion protein) and the fungal homolog, SEC18, which are involved in intracellular transport between the endoplasmic reticulum and Golgi, as well as between different Golgi cisternae; 2) Mammalian transitional endoplasmic reticulum ATPase (previously known as p97 or VCP), which is involved in the transfer of membranes from the endoplasmic reticulum to the golgi apparatus. This ATPase forms a ring-shaped homooligomer composed of six subunits. The yeast homolog, CDC48, plays a role in spindle pole proliferation; 3) Yeast protein PAS1 essential for peroxisome assembly and the related protein PAS1 from *Pichia pastoris;* 4) Yeast protein AFG2; 5) *Sulfolobus acidocaldarius* protein SAV and *Halobacterium salinarium* cdcH, which may be part of a transduction pathway connecting light to cell division.

Proteins containing a single AAA domain include: 1) *Escherichia coli* and other bacteria ftsH (or hflB) protein. FtsH is an ATP-dependent zinc metallopeptidase that degrades the heat-shock sigma-32 factor, and is an integral membrane protein with a large cytoplasmic C-terminal domain that contain both the AAA and the protease domains; 2) Yeast protein YME1, a protein important for maintaining the integrity of the mitochondrial compartment. YME1 is also a zinc-dependent protease; 3) Yeast protein AFG3 (or YTA10). This protein also contains an AAA domain followed by a zinc-dependent protease domain; 4) Subunits from regulatory complex of the 26S proteasome (Hilt et al., Trends Biochem. Sci. (1996) 21:96), which is involved in the ATP-dependent degradation of ubiquitinated proteins, which subunits include: a) Mammalian 4 and homologs in other higher eukaryotes, in yeast (gene YTA5) and fission yeast (gene mts2); b) Mammalian 6 (TBP7) and homologs in other higher eukaryotes and in yeast (gene YTA2); c) Mammalian subunit 7 (MSS1) and homologs in other higher eukaryotes and in yeast (gene CIM5 or YTA3); d) Mammalian subunit 8 (P45) and homologs in other higher eukaryotes and in yeast (SUG1 or CIM3 or TBY1) and fission yeast (gene let1); e) Other probable subunits include human TBP1, which influences HIV gene expression by interacting with the virus tat trans-activator protein, and yeast YTA1 and YTA6; 5) Yeast protein BCS1, a mitochondrial protein essential for the expression of the Rieske iron-sulfur protein; 6) Yeast protein MSP1, a protein involved in intramitochondrial sorting of proteins; 7) Yeast protein PAS8, and the corresponding proteins PAS5 from *Pichia pastoris* and PAY4 from *Yarrowia lipolytica;* 8) Mouse protein SKD1 and its fission yeast homolog (SpAC2G11.06); 9) *Caenorhabditis elegans* meiotic spindle formation protein mei-1; 10) Yeast protein SAP1' 11) Yeast protein YTA7; and 12) *Mycobacterium leprae* hypothetical protein A2126A.

In general, the AAA domains in these proteins act as ATP-dependent protein clamps (Confalonieri et al. (1995) *BioEssays* 17:639). In addition to the ATP-binding 'A' and 'B' motifs, which are located in the N-terminal half of this domain, there is a highly conserved region located in the central part of the domain which was used in the development of the signature pattern.

f) Bcl-2 family (Bcl-2). SEQ ID NO:4248, and thus the corresponding sequence it validates, represents a polynucleotide encoding an apoptosis regulator protein of the Bcl-2, family. Active cell suicide (apoptosis) is induced by events such as growth factor withdrawal and toxins. It is controlled by regulators, which have either an inhibitory effect on programmed cell death (anti-apoptotic) or block the protective effect of inhibitors (pro-apoptotic) (Vaux, 1993, Curr. Biol. 3:877-878, and White, 1996, Genes Dev. 10:2859-2869). Many viruses have found a way of countering defensive apoptosis by encoding their own anti-apoptosis genes, preventing their target cells from dying prematurely.

All proteins belonging to the Bcl-2 family (Reed et al., 1996, Adv. Exp. Med. Biol. 406:99-112) contain either a BH1, BH2, BH3, or BH4 domain. All anti-apoptotic proteins contain BH1 and BH2 domains; some of them contain an additional N-terminal BH4 domain (Bcl-2, Bcl-x(L), Bcl-w), which is never seen in pro-apoptotic proteins, except for Bcl-x(S). On the other hand, all pro-apoptotic proteins contain a BH3 domain (except for Bad) necessary for dimerization with other proteins of Bcl-2 family and crucial for their killing activity; some of them also contain BH1 and BH2 domains (Bax, Bak). The BH3 domain is also present in some anti-apoptotic protein, such as Bcl-2 or Bcl-x(L). Proteins that are known to contain these domains are listed below.

1. Vertebrate protein Bcl-2. Bcl-2 blocks apoptosis; it prolongs the survival of hematopoietic cells in the absence of required growth factors and also in the presence of various stimuli inducing cellular death. Two isoforms of bcl-2 (alpha and beta) are generated by alternative splicing. Bcl-2 is expressed in a wide range of tissues at various times during development. It forms heterodimers with the Bax proteins.

2. Vertebrate protein Bcl-x. Two isoforms of Bcl-x (Bcl-x(L) and Bcl-x(S)) are generated by alternative splicing. While the longer product (Bcl-x(L)) can protect a growth-factor-dependent cell line from apoptosis, the shorter form blocks the protective effect of Bcl-2 and Bcl-x(L) and acts as an anti-anti-apoptosis protein.

3. Mammalian protein Bax. Bax blocks the anti-apoptosis ability of Bcl-2 with which it forms heterodimers. There is no evidence that Bax has any activity in the absence of Bcl-2. Three isoforms of bax (alpha, beta and gamma) are generated by alternative splicing.

4. Mammalian protein Bak, which promotes cell death and counteracts the protection from apoptosis provided by Bcl-2.

5. Mammalian protein Bcl-w, which promotes cell survival.

6. Mammalian protein bad, which promotes cell death, and counteracts the protection from apoptosis provided by Bcl-x (L), but not that of Bcl-2.

7. Human protein Bik, which promotes cell death, but cannot counteract the protection from apoptosis provided by Bcl-2.

8. Mouse protein Bid, which induces caspases and apoptosis, and counteracts the protection from apoptosis provided by Bcl-2.

9. Human induced myeloid leukemia cell differentiation protein MCL1. MCL1 is probably involved in programming of differentiation and concomitant maintenance of viability but not proliferation. Its expression increases early during phorbol ester induced differentiation in myeloid leukemia cell line ML-1.

10. Mouse hemopoietic-specific early response protein A1.

11. Mammalian activator of apoptosis Harakiri (Inohara et al., 1997, EMBO J. 16:1686-1694) (also known as neuronal death protein Dp5). This is a small protein of 92-residues that activates apoptosis. It contains a BH3 domain, but no BH1, BH2 or BH4 domains.

The following consensus patterns have been developed for the four BH domains:

g) Bromodomain (bromodomain). Some SEQ ID NOS represent polynucleotides encoding a polypeptide having a bromodomain region (Haynes et al., 1992, Nucleic Acids Res. 20:2693-2603, Tamkun et al., 1992, Cell 68:561-572, and Tamkun, 1995, Curr. Opin. Genet. Dev. 5:473-477), which is a conserved region of about 70 amino acids found in the following proteins: 1) Higher eukaryotes transcription initiation factor TFIID 250 Kd subunit (TBP-associated factor p250) (gene CCG1); P250 is associated with the TFIID TATA-box binding protein and seems essential for progression of the G1 phase of the cell cycle. 2) Human RING3, a protein of unknown function encoded in the MHC class II locus; 3) Mammalian CREB-binding protein (CBP), which mediates cAMP-gene regulation by binding specifically to phosphorylated CREB protein; 4) Mammalian homologs of brahma, including three brahma-like human: SNF2a (hBRM), SNF2b, and BRG1; 5) Human BS69, a protein that binds to adenovirus E1A and inhibits E1A transactivation; 6) Human peregrin (or Br140).

The bromodomain is thought to be involved in protein-protein interactions and may be important for the assembly or activity of multicomponent complexes involved in transcriptional activation.

h) Basic Region Plus Leucine Zipper Transcription Factors (BZIP). Some SEQ ID NOS, and thus the corresponding sequences these sequences validate, represent polynucleotides encoding a novel member of the family of basic region plus leucine zipper transcription factors. The bZIP superfamily (Hurst, Protein Prof. (11995) 2:105; and Ellenberger, Curr. Opin. Struct. Biol. (1994) 4:12) of eukaryotic DNA-binding transcription factors encompasses proteins that contain a basic region mediating sequence-specific DNA-binding followed by a leucine zipper required for dimerization. Members of the family include transcription factor AP-1, which binds selectively to enhancer elements in the cis control regions of SV40 and metallothionein IIA. AP-1, also known as c-jun, is the cellular homolog of the avian sarcoma virus 17 (ASV17) oncogene v-jun.

Other members of this protein family include jun-B and jun-D, probable transcription factors that are highly similar to jun/AP-1; the fos protein, a proto-oncogene that forms a non-covalent dimer with c-jun; the fos-related proteins fra-1, and fos B; and mammalian cAMP response element (CRE) binding proteins CREB, CREM, ATF-1, ATF-3, ATF-4, ATF-5, ATF-6 and LRF-1.

i) Cyclins (cyclin). Some SEQ ID NOS represent polynucleotides encoding cyclins, and SEQ ID NO:899 and 900, respectively, show the corresponding full-length polynucleotides. SEQ ID NO:901 and 902 show, respectively, the translations of SEQ ID NO:899 and 900. Cyclins (Nurse, 1990, Nature 344:503-508; Norbury et al., 1991, Curr. Biol. 1:23-24; and Lew et al., 1992, Trends Cell Biol. 2:77-81) are eukaryotic proteins that play an active role in controlling nuclear cell division cycles. There are two main groups of cyclins. G2/M cyclins are essential for the control of the cell cycle at the G2/M (mitosis) transition. G2/M cyclins accumulate steadily during G2 and are abruptly destroyed as cells exit from mitosis (at the end of the M-phase). G1/S cyclins are essential for the control of the cell cycle at the G1/S (start) transition.

j) Eukaryotic thiol (cysteine) proteases active sites (Cys-protease). Some SEQ ID NOS, and thus also the sequences they validate, represent polynucleotides encoding proteins having a eukaryotic thiol (cysteine) protease active site. Eukaryotic thiol proteases (Dufour E., Biochimie (1988) 70:1335); are a family of proteolytic enzymes which contain an active site cysteine. Catalysis proceeds through a thioester intermediate and is facilitated by a nearby histidine side chain; an asparagine completes the essential catalytic triad. The proteases that belong to this family are: 1) vertebrate lysosomal cathepsins B (Kirschke H., et al., Protein Prof. (1995) 2:1587-1643); 2) vertebrate lysosomal dipeptidyl peptidase I (also known as cathepsin C) (Kirschke H., et al., supra); 3) vertebrate calpains (Calpains are intracellular calcium-activated thiol protease that contain both an N-terminal catalytic domain and a C-terminal calcium-binding domain); 4) mammalian cathepsin K, which seems involved in osteoclastic bone resorption (Shi G.-P., et al., FEBS Lett. (1995) 357:129); 5) human cathepsin O ([4] Velasco G., Ferrando A. A., Puente X. S., Sanchez L. M., Lopez-Otin C. J. Biol. Chem. (1994) 269:27136); 6) bleomycin hydrolase (which catalyzes the inactivation of the antitumor drug BLM (a glycopeptide)); 7) Plant enzymes such as: barley aleurain, EP-B1/B4; kidney bean EP-C1, rice bean SH-EP; kiwi fruit actinidin; papaya latex papin, chymopapain, caricain, and proteinase IV; pea turgor-responsive protein 15A; pineapple stem bromelain; rape COT44; rice oryzain alpha, beta, and gamma; tomato low-temperature induced, Arabidopsis thaliana A494, RD19A and RD21A; 8) House-dust mites allergens DerP1 and EurM1; 9) cathepsin B-like proteinases from the worms Caenorhabditis elegans (genes gcp-1, cpr-3, cpr-4, cpr-5 and cpr-6), Schistosoma mansoni (antigen SM31) and Japonica (antigen SJ31), Haemonchus contortus (genes AC-1 and AC-2), and Ostertagia ostertagi (CP-1 and CP-3); 10) slime mold cysteine proteinases CP1 and CP2; 11) cruzipain from Trypanosoma cruzi and brucei; 12) throphozoite cysteine proteinase (TCP) from various Plasmodium species; 13) proteases from Leishmania mexicana, Theileria annulata and Theileria parva; 14) Baculoviruses cathepsin-like enzyme (v-cath); 15) Drosophila small optic lobes protein (gene sol), a neuronal protein that contains a calpain-like domain; 16) yeast thiol protease BLH1/YCP1/LAP3; 17) Caenorhabditis elegans hypothetical protein C06G4.2, a calpain-like protein.

In addition, two bacterial peptidases are also part of this family: 1) aminopeptidase C from Lactococcus lactis (gene pepC) (Chapot-Chartier M. P., et al., Appl. Environ. Microbiol. (1993) 59:330); and 2) thiol protease tpr from Porphyromonas gingivalis. Three other proteins are structurally related to this family, but may have lost their proteolytic activity. These include: 1) soybean oil body protein P34 (which has its active site cysteine replaced by a glycine); 2) rat testin (which is a sertoli cell secretory protein highly similar to cathepsin L but with the active site cysteine is replaced by a serine); and 3) Plasmodium falciparum serine-repeat protein (SERA) (which is the major blood stage antigen and possesses a C-terminal thiol-protease-like domain (Higgins D. G., et al., Nature (1989) 340:604), with the active site cysteine is replaced by a serine).

k) Phorbol Esters/Diacylglycerol Binding (DAG_PE_bind). One SEQ represents a polynucleotide encoding a protein belonging to the family including phorbol esters/diacylglycerol binding proteins. Diacylglycerol (DAG) is an important second messenger. Phorbol esters (PE) are analogues of DAG and potent tumor promoters that cause a variety of physiological changes when administered to both cells and tissues. DAG activates a family of serine/threonine protein kinases, collectively known as protein kinase C (PKC) (Azzi et al., Eur. J. Biochem. (1992) 208:547). Phorbol esters can directly stimulate PKC. The N-terminal region of PKC, known as C1, has been shown (Ono et al., *Proc. Natl. Acad. Sci. USA* (1989) 86:4868) to bind PE and DAG in a phospholipid and zinc-dependent fashion. The C1 region contains one or two copies (depending on the isozyme of PKC) of a cysteine-rich domain about 50 amino-acid residues long and essential for DAG/PE-binding. Such a domain has also been found in, for example, the following proteins.

(1) Diacylglycerol kinase (EC 2.7.1.107) (DGK) (Sakane et al., *Nature* (1990) 344:345), the enzyme that converts DAG into phosphatidate. It contains two copies of the DAG/PE-binding domain in its N-terminal section. At least five different forms of DGK are known in mammals; and (2) N-chimaerin, a brain specific protein which shows sequence similarities with the BCR protein at its C-terminal part and contains a single copy of the DAG/PE-binding domain at its N-terminal part. It has been shown (Ahmed et al., *Biochem. J.* (1990) 272:767, and Ahmed et al., *Biochem. J.* (1991) 280:233) to be able to bind phorbol esters.

The DAG/PE-binding domain binds two zinc ions; the ligands of these metal ions are probably the six cysteines and two histidines that are conserved in this domain. The signature pattern completely spans the DAG/PE domain.

l) DEAD and DEAH box families ATP-dependent helicases signatures (Dead_box_helic). Some SEQ ID NOS represent polynucleotides encoding a novel member of the DEAD box family. A number of eukaryotic and prokaryotic proteins have been characterized (Schmid S. R., et al., *Mol. Microbiol.* (1992) 6:283; Linder P., et al., *Nature* (1989) 337: 121; Wassarman D. A., et al., *Nature* (1991) 349:463) on the basis of their structural similarity. All are involved in ATP-dependent, nucleic-acid unwinding. Proteins currently known to belong to this family are:

1) Initiation factor eIF-4A. Found in eukaryotes, this protein is a subunit of a high molecular weight complex involved in 5'cap recognition and the binding of mRNA to ribosomes. It is an ATP-dependent RNA-helicase.

2) PRP5 and PRP28. These yeast proteins are involved in various ATP-requiring steps of the pre-mRNA splicing process.

3) P110, a mouse protein expressed specifically during spermatogenesis.

4) An3, a *Xenopus* putative RNA helicase, closely related to P110.

5) SPP81/DED1 and DBP1, two yeast proteins involved in pre-mRNA splicing and related to P110.

6) *Caenorhabditis elegans* helicase glh-1.

7) MSS116, a yeast protein required for mitochondrial splicing.

8) SPB4, a yeast protein involved in the maturation of 25S ribosomal RNA.

9) p68, a human nuclear antigen. p68 has ATPase and DNA-helicase activities in vitro. It is involved in cell growth and division.

10) Rm62 (p62), a *Drosophila* putative RNA helicase related to p68.

11) DBP2, a yeast protein related to p68.

12) DHH1, a yeast protein.

13) DRS1, a yeast protein involved in ribosome assembly.

14) MAK5, a yeast protein involved in maintenance of dsRNA killer plasmid.

15) ROK1, a yeast protein.

16) ste13, a fission yeast protein.

17) Vasa, a *Drosophila* protein important for oocyte formation and specification of embryonic posterior structures.

18) Me31B, a *Drosophila* maternally expressed protein of unknown function.

19) dbpA, an *Escherichia coli* putative RNA helicase.

20) deaD, an *Escherichia coli* putative RNA helicase which can suppress a mutation in the rpsB gene for ribosomal protein S2.

21) rhlB, an *Escherichia coli* putative RNA helicase.

22) rhlE, an *Escherichia coli* putative RNA helicase.

23) rmB, an *Escherichia coli* protein that shows RNA-dependent ATPase activity, which interacts with 23S ribosomal RNA.

24) *Caenorhabditis elegans* hypothetical proteins T26G10.1, ZK512.2 and ZK686.2.

25) Yeast hypothetical protein YHR065c.

26) Yeast hypothetical protein YHR169w.

27) Fission yeast hypothetical protein SpAC31A2.07c.

28) *Bacillus subtilis* hypothetical protein yxiN.

All of the above proteins share a number of conserved sequence motifs. Some of them are specific to this family while others are shared by other ATP-binding proteins or by proteins belonging to the helicases 'superfamily' (Hodgman T. C., Nature (1988) 333:22 and Nature (1988) 333:578 (Errata); see worldwide web site at expasy.ch/www/linder/HELICASES_TEXT.html). One of these motifs, called the 'D-E-A-D-box', represents a special version of the B motif of ATP-binding proteins. Some other proteins belong to a sub-family which have His instead of the second Asp and are thus said to be 'D-E-A-H-box' proteins (Wassarman D. A., et al., Nature (1991) 349:463; Haroshi I., et al., Nucleic Acids Res. (1991) 19:6331; Koonin E. V., et al., J. Gen. Virol. (1992) 73:989). Proteins currently known to belong to this DEAH subfamily are:

1) PRP2, PRP16, PRP22 and PRP43. These yeast proteins are all involved in various ATP-requiring steps of the pre-mRNA splicing process. 2) Fission yeast prh1, which my be involved in pre-mRNA splicing. 3) Male-less (mle), a *Drosophila* protein required in males, for dosage compensation of X chromosome linked genes. 4) RAD3 from yeast. RAD3 is a DNA helicase involved in excision repair of DNA damaged by UV light, bulky adducts or cross-linking agents. Fission yeast rad15 (rhp3) and mammalian DNA excision repair protein XPD (ERCC-2) are the homologs of RAD3. 5) Yeast CHL1 (or CTF1), which is important for chromosome transmission and normal cell cycle progression in G(2)/M. 6) Yeast TPS1. 7) Yeast hypothetical protein YKL078w. 8) *Caenorhabditis elegans* hypothetical proteins C06E1.10 and K03H1.2. 9) Poxviruses' early transcription factor 70 Kd subunit which acts with RNA polymerase to initiate transcription from early gene promoters. 10) I8, a putative vaccinia virus helicase. 11) hrpA, an *Escherichia coli* putative RNA helicase.

m) EF Hand (EFhand). Several of the validation sequences, and thus the sequences they validate, correspond to polynucleotides encoding a novel protein in the family of EF-hand proteins. Many calcium-binding proteins belong to the same evolutionary family and share a type of calcium-binding domain known as the EF-hand (Kawasaki et al., *Protein. Prof.* (1995) 2:305-490). This type of domain consists of a twelve residue loop flanked on both sides by a twelve residue alpha-helical domain. In an EF-hand loop the calcium ion is coordinated in a pentagonal bipyramidal configuration. The six residues involved in the binding are in positions 1, 3, 5, 7, 9 and 12; these residues are denoted by X, Y, Z, -Y, -X and -Z. The invariant Glu or Asp at position 12 provides two oxygens for liganding Ca (bidentate ligand).

Proteins known to contain EF-hand regions include: Calmodulin (Ca=4, except in yeast where Ca=3) ("Ca=" indicates approximate number of EF-hand regions); diacylglycerol kinase (EC 2.7.1.107) (DGK) (Ca=2); 2) FAD-dependent glycerol-3-phosphate dehydrogenase (EC 1.1.99.5) from mammals (Ca=1); guanylate cyclase activating protein (GCAP) (Ca=3); MIF related proteins 8 (MRP-8 or CFAG) and 14 (MRP-14) (Ca=2); myosin regulatory light chains (Ca=1); oncomodulin (Ca=2); osteonectin (basement membrane protein BM-40) (SPARC); and proteins that contain an "osteonectin" domain (QR1, matrix glycoprotein SC1).

n) Ets Domain (Ets_Nterm). One SEQ ID NO, and thus the sequence it validates, represents a polynucleotide encoding a polypeptide with N-terminal homology in ETS domain. Proteins of this family contain a conserved domain, the "ETS-domain," that is involved in DNA binding. The domain appears to recognize purine-rich sequences; it is about 85 to 90 amino acids in length, and is rich in aromatic and positively charged residues (Wasylyk, et al., *Eur. J. Biochem.* (1993) 211:718).

The ets gene family encodes a novel class of DNA-binding proteins, each of which binds a specific DNA sequence. These proteins comprise an ets domain that specifically interacts with sequences containing the common core tri-nucleotide sequence GGA. In addition to an ets domain, native ets proteins comprise other sequences which can modulate the biological specificity of the protein. Ets genes and proteins are involved in a variety of essential biological processes including cell growth, differentiation and development, and three members are implicated in oncogenic process.

o) Type II fibronectin collagen-binding domain (FntypeII). A few of the validation sequences, and thus the sequences they validate, represent polynucleotides encoding a polypeptide having a type II fibronectin collagen binding domain. Fibronectin is a plasma protein that binds cell surfaces and various compounds including collagen, fibrin, heparin, DNA, and actin. The major part of the sequence of fibronectin consists of the repetition of three types of domains, which are called type I, II, and III (Skorstengaard K., et al., *Eur. J. Biochem.* (1986) 161:441). Type II domain is approximately forty residues long, contains four conserved cysteines involved in disulfide bonds and is part of the collagen-binding region of fibronectin. In fibronectin the type II domain is duplicated. Type II domains have also been found in the following proteins: 1) blood coagulation factor XII (Hageman factor) (1 copy); 2) bovine seminal plasma proteins PDC-109 (BSP-A1/A2) and BSP-A3 (Seidah N. G., et al., *Biochem. J.* (1987) 243:195. (twice); 3) cation-independent mannose-6-phosphate receptor (which is also the insulin-like growth factor II receptor) Kornfeld S., *Annu. Rev. Biochem.* (1992) 61:307) (1 copy); 4) Mannose receptor of macrophages (Taylor M. E., et al., *J. Biol. Chem.* (1990) 265:12156) (1 copy); 5) 180 Kd secretory phospholipase A2 receptor (1 copy) Lambeau G., et al., *J. Biol. Chem.* (1994) 269:1575; 6) DEC-205 receptor (1 copy); 6) Jiang W., et al., *Nature* (1995) 375:151); 7) 72 Kd type IV collagenase (EC 3.4.24.24) (MMP-2) (Collier I. E., et al., *J. Biol. Chem.* (1988) 263: 6579) (3 copies); 7) 92 Kd type IV collagenase (EC 3.4.24.24) (MMP-9) (3 copies); 8) Hepatocyte growth factor activator (Miyazawa K., et al., *J. Biol. Chem.* (1993) 268: 10024) (1 copy).

p) G-Protein Alpha Subunit (G-alpha). Several of the validation sequences, and thus the sequences they validate, correspond to a gene encoding a novel polypeptide of the G-protein alpha subunit family. Guanine nucleotide binding proteins (G-proteins) are a family of membrane-associated proteins that couple extracellularly-activated integral-membrane receptors to intracellular effectors, such as ion channels and enzymes that vary the concentration of second messenger molecules. G-proteins are composed of 3 subunits (alpha, beta and gamma) which, in the resting state, associate as a trimer at the inner face of the plasma membrane. The alpha subunit has a molecule of guanosine diphosphate (GDP) bound to it. Stimulation of the G-protein by an activated receptor leads to its exchange for GTP (guanosine triphosphate). This results in the separation of the alpha from the beta and gamma subunits, which always remain tightly associated as a dimer. Both the alpha and beta-gamma subunits are then able to interact with effectors, either individually or in a cooperative manner. The intrinsic GTPase activity of the alpha subunit hydrolyses the bound GTP to GDP. This returns the alpha subunit to its inactive conformation and allows it to reassociate with the beta-gamma subunit, thus restoring the system to its resting state.

G-protein alpha subunits are 350-400 amino acids in length and have molecular weights in the range 40-45 kDa. Seventeen distinct types of alpha subunit have been identified in mammals. These fall into 4 main groups on the basis of both sequence similarity and function: alpha-s, alpha-q, alpha-i and alpha-12 (Simon et al., *Science* (1993) 252:802). Many alpha subunits are substrates for ADP-ribosylation by cholera or pertussis toxins. They are often N-terminally acylated, usually with myristate and/or palmitoylate, and these fatty acid modifications are probably important for membrane association and high-affinity interactions with other proteins. The atomic structure of the alpha subunit of the G-protein involved in mammalian vision, transducin, has been elucidated in both GTP- and GDB-bound forms, and shows considerable similarity in both primary and tertiary structure in the nucleotide-binding regions to other guanine nucleotide binding proteins, such as p21-ras and EF-Tu.

q) Helicases conserved C-terminal domain (helicase C). Some SEQ ID NOS, and thus the sequences they validate, represent polynucleotides encoding novel members of the DEAD/H helicase family. The DEAD and DEAH families are described above.

r) Homeobox domain (homeobox). One SEQ ID NO, and thus the sequence it validates, represents a polynucleotide encoding a protein having a homeobox domain. The 'homeobox' is a protein domain of 60 amino acids (Gehring In: Guidebook to the Homebox Genes, Duboule D., Ed., pp 1-10, Oxford University Press, Oxford, (1994); Buerglin In: Guidebook to the Homebox Genes, pp 25-72, Oxford University Press, Oxford, (1994); Gehring Trends Biochem. Sci. (1992) 17:277-280; Gehring et al Annu. Rev. Genet. (1986) 20:147-173; Schofield Trends Neurosci. (1987) 10:3 6; see internet web site at copan.bioz.unibas.ch/homeo.html) first identified in number of *Drosophila* homeotic and segmentation proteins. It is extremely well conserved in many other animals, including vertebrates. This domain binds DNA through a helix-turn-helix type of structure. Several proteins that contain a homeobox domain play an important role in development. Most of these proteins are sequence-specific DNA-binding transcription factors. The homeobox domain is also very similar to a region of the yeast mating type proteins. These are sequence-specific DNA-binding proteins that act as master switches in yeast differentiation by controlling gene expression in a cell type-specific fashion.

A schematic representation of the homeobox domain is shown below. The helix-turn-helix region is shown by the symbols 'H' (for helix), and 't' (for turn).

```
xxxxxxxxxxxxxxxxxxxxxxxxxxxxxxxxxHHHHHHHHHtttHHHHHHHHHxxxxxxxxx
1                                                              60
```

The pattern detects homeobox sequences 24 residues long and spans positions 34 to 57 of the homeobox domain.

x) MAP kinase kinase (mkk). Several validation sequences, and thus the sequences they validate, represent novel members of the MAP kinase kinase family. MAP kinases (MAPK) are involved in signal transduction, and are important in cell cycle and cell growth controls. The MAP kinase kinases (MAPKK) are dual-specificity protein kinases which phosphorylate and activate MAP kinases. MAPKK homologues have been found in yeast, invertebrates, amphibians, and mammals. Moreover, the MAPKK/MAPK phosphorylation switch constitutes a basic module activated in distinct pathways in yeast and in vertebrates. MAPKK regulation studies have led to the discovery of at least four MAPKK convergent pathways in higher organisms. One of these is similar to the yeast pheromone response pathway which includes the ste11 protein kinase. Two other pathways require the activation of either one or both of the serine/threonine kinase-encoded oncogenes c-Raf-1 and c-Mos. Additionally, several studies suggest a possible effect of the cell cycle control regulator cyclin-dependent kinase 1 (cdc2) on MAPKK activity. Finally, MAPKKs are apparently essential transducers through which signals must pass before reaching the nucleus. For review, see, e.g., Biologique *Biol Cell* (1993) 79:193-207; Nishida et al., *Trends Biochem Sci* (1993) 18:128-31; Ruderman *Curr Opin Cell Biol* (1993) 5:207-13; Dhanasekaran et al., *Oncogene* (1998) 17:1447-55; Kiefer et al., *Biochem Soc Trans* (1997) 25:491-8; and Hill, *Cell Signal* (1996) 8:533-44.

y) 3'5'-cyclic nucleotide phosphodiesterases signature (PDEase). One SEQ ID NO, and thus the sequence it validates, represents a polynucleotide encoding a novel 3'5'-cyclic nucleotide phosphodiesterases (PDEases). PDEases catalyze the hydrolysis of cAMP or cGMP to the corresponding nucleoside 5' monophosphates (Charbonneau H., et al, Proc. Natl. Acad. Sci. U.S.A. (1986) 83:9308). There are at least seven different subfamilies of PDEases (Beavo J. A., et al., Trends Pharmacol. Sci. (1990) 11:150; see internet web site at weber.u.washington.edu/.about.pde/: 1) Type 1, calmodulin/calcium-dependent PDEases; 2) Type 2, cGMP-stimulated PDEases; 3) Type 3, cGMP-inhibited PDEases; 4) Type 4, cAMP-specific PDEases; 5) Type 5, cGMP-specific PDEases; 6) Type 6, rhodopsin-sensitive cGMP-specific PDEases; and 7) Type 7, High affinity cAMP-specific PDEases.

All PDEase forms share a conserved domain of about 270 residues.

z) Protein Kinase (protkinase). Several validation sequences, and thus the sequences they validate, represent polynucleotides encoding protein kinases. Protein kinases catalyze phosphorylation of proteins in a variety of pathways, and are implicated in cancer. Eukaryotic protein kinases (Hanks S. K., et al., *FASEB J.* (1995) 9:576; Hunter T., *Meth. Enzymol.* (1991) 200:3; Hanks S. K., et al., *Meth. Enzymol.* (1991) 200:38; Hanks S. K., *Curr. Opin. Struct. Biol.* (1991) 1:369; Hanks S. K., et al., *Science* (1988) 241:42) are enzymes that belong to a very extensive family of proteins which share a conserved catalytic core common to both serine/threonine and tyrosine protein kinases. There are a number of conserved regions in the catalytic domain of protein kinases. Two of the conserved regions are the basis for the signature pattern in the protein kinase profile. The first region, which is located in the N-terminal extremity of the catalytic domain, is a glycine-rich stretch of residues in the vicinity of a lysine residue, which has been shown to be involved in ATP binding. The second region, which is located in the central part of the catalytic domain, contains a conserved aspartic acid residue which is important for the catalytic activity of the enzyme (Knighton D. R., et al., *Science* (1991) 253:407). The protein kinase profile includes two signature patterns for this second region: one specific for serine/threonine kinases and the other for tyrosine kinases. A third profile is based on the alignment in (Hanks S. K., et al., *FASEB J.* (1995) 9:576) and covers the entire catalytic domain.

The protein kinase profile also detects receptor guanylate cyclases and 2-5A-dependent ribonucleases. Sequence similarities between these two families and the eukaryotic protein kinase family have been noticed previously. The profile also detects *Arabidopsis thaliana* kinase-like protein TMKL1 which seems to have lost its catalytic activity.

If a protein analyzed includes the two of the above protein kinase signatures, the probability of it being a protein kinase is close to 100%. Eukaryotic-type protein kinases have also been found in prokaryotes such as *Myxococcus xanthus* (Munoz-Dorado J., et al., *Cell* (1991) 67:995) and *Yersinia pseudotuberculosis*. The patterns shown above has been updated since their publication in (Bairoch A., et al., *Nature* (1988) 331:22).

aa) Ras family proteins (ras). One SEQ ID NO, and thus the sequence it validates, represent polynucleotides encoding the ras family of small GTP/GDP-binding proteins (Valencia et al., 1991, Biochemistry 30:4637-4648). Ras family members generally require a specific guanine nucleotide exchange factor (GEF) and a specific GTPase activating protein (GAP) as stimulators of overall GTPase activity. Among ras-related proteins, the highest degree of sequence conservation is found in four regions that are directly involved in guanine nucleotide binding. The first two constitute most of the phosphate and Mg2+ binding site (PM site) and are located in the first half of the G-domain. The other two regions are involved in guanosine binding and are located in the C-terminal half of the molecule. Motifs and conserved structural features of the ras-related proteins are described in Valencia et al., 1991, Biochemistry 30:4637-4648.

bb) Thioredoxin family active site (Thioredox). One SEQ ID NO, and thus the sequence it validates, represent a polynucleotide encoding a protein having a thioredoxin family active site. Thioredoxins (Holmgren A., *Annu. Rev. Biochem.* (1985) 54:237; Gleason F. K., et al., *FEMS Microbiol. Rev.* (1988) 54:271; Holmgren A. *J. Biol. Chem.* (1989) 264:13963; Eklund H., et al. *Proteins* (1991) 11:13) are small proteins of approximately one hundred amino-acid residues which participate in various redox reactions via the reversible oxidation of an active center disulfide bond. They exist in either a reduced form or an oxidized form where the two cysteine residues are linked in an intramolecular disulfide bond. Thioredoxin is present in prokaryotes and eukaryotes and the sequence around the redox-active disulfide bond is well conserved.

A number of eukaryotic proteins contain domains evolutionary related to thioredoxin, and all of them are protein disulphide isomerases (PDI). PDI (Freedman R. B., et al., *Biochem. Soc. Trans.* (1988) 16:96; Kivirikko K. I., et al., *FASEB J.* (1989) 3:1609; Freedman R. B., et al. *Trends Biochem. Sci.* (1994) 19:331) is an endoplasmic reticulum enzyme that catalyzes the rearrangement of disulfide bonds in various proteins. The various forms of PDI which are currently known are: 1) PDI major isozyme; a multifunctional protein that also function as the beta subunit of prolyl 4-hydroxylase (EC 1.14.11.2), as a component of oligosaccharyl transferase (EC 2.4.1.119), as thyroxine deiodinase, as glutathione-insulin transhydrogenase, and as a thyroid hormone-binding protein; 2) ERp60 (ER-60; 58 Kd microsomal protein), which is a protease; 3) ERp72; and 4) P5.

cc) TNFR/NGFR family cysteine-rich region (TNFR_c6). One SEQ ID NO, and thus the sequence it validates, represent a polynucleotide encoding a protein having a TNFR/NGFR family cysteine-rich region. A number of proteins, some of which are known to be receptors for growth factors, have been found to contain a cysteine-rich domain of about 110 to 160 amino acids in their N-terminal part, that can be subdivided into four (or in some cases, three) modules of about 40 residues containing 6 conserved cysteines. Proteins known to belong to this family (Mallet S., et al., *Immunol. Today* (1991) 12:220; Sprang S. R., *Trends Biochem. Sci.* (1990) 15:366; Krammer P. H., et al., *Curr. Biol.* (1992) 2:383; Bazan J. F., *Curr. Biol.* (1993) 3:603) are: 1) Tumor Necrosis Factor type I and type II receptors (TNFR) (Both receptors bind TNF-alpha and TNF-beta, but are only similar in the cysteine-rich region.); 2) Shope fibroma virus soluble TNF receptor (protein T2); 3) Lymphotoxin alpha/beta receptor; 4) Low-affinity nerve growth factor receptor (LA-NGFR); 5) CD40 (Bp50), the receptor for the CD40L (or TRAP) cytokine; 6) CD27, the receptor for the CD27L cytokine; 8) CD30, the receptor for the CD30L cytokine; 9) T-cell protein 4-1BB, the receptor for the 4-1BBL putative cytokine; 10) FAS antigen (or APO-1), the receptor for FASL, a protein involved in apoptosis (programmed cell death); 11) T-cell antigen OX40, the receptor for the OX40L cytokine; 12) Wsl-1, a receptor (for a yet undefined ligand) that mediates apoptosis; 13) Vaccinia virus protein A53 (SalF19R).

The six cysteines all involved in intrachain disulfide bonds (Banner D. W., et al, *Cell* (1993) 73:431). A schematic representation of the structure of the 40 residue module of these receptors is shown below:

xCxxxxxxxxxxxxxCxCxxCxxxxxxxxxCxxxxCxx where 'C' represents the conserved cysteine involved in a disulfide bond. The signature pattern for the cysteine-rich region is based mainly on the position of the six conserved cysteines in each of the repeats: Consensus pattern: C-x(4,6)-[FYH]-x(5,10)-C-x(0,2)-C-x(2,3)-C-x(7,11)-C-x(4,6)-[DNEQSKP]-x(2)-C (where the six C's are involved in disulfide bonds).

dd) Four Transmembrane Integral Membrane Proteins (transmembrane4). Several of the validation sequences, and thus the sequences they validate, correspond to a sequence encoding a polypeptide that is a member of the 4 transmembrane segments integral membrane protein family (transmembrane 4 family). The transmembrane 4 family of proteins includes a number of evolutionarily-related eukaryotic cell surface antigens (Levy et al., *J. Biol. Chem.*, (1991) 266: 14597; Tomlinson et al., *Eur. J. Immunol.* (1993) 23:136; Barclay et al. The leucocyte antigen factbooks. (1993) Academic Press, London/San Diego). The proteins belonging to this family include: 1) Mammalian antigen CD9 (MIC3), which is involved in platelet activation and aggregation; 2) Mammalian leukocyte antigen CD37, expressed on B lymphocytes; 3) Mammalian leukocyte antigen CD53 (OX-44), which is implicated in growth regulation in hematopoietic cells; 4) Mammalian lysosomal membrane protein CD63 (melanoma-associated antigen ME491; antigen AD1); 5) Mammalian antigen CD81 (cell surface protein TAPA-1), which is implicated in regulation of lymphoma cell growth; 6) Mammalian antigen CD82 (protein R2; antigen C33; Kangai 1 (KAI1)), which associates with CD4 or CD8 and delivers costimulatory signals for the TCR/CD3 pathway; 7) Mammalian antigen CD151 (SFA-1; platelet-endothelial tetraspan antigen 3 (PETA-3)); 8) Mammalian cell surface glycoprotein A15 (TALLA-1; MXS1); 9) Mammalian novel antigen 2 (NAG-2); 10) Human tumor-associated antigen CO-029; 11) *Schistosoma mansoni* and japonicum 23 Kd surface antigen (SM23/SJ23).

The members of the 4 transmembrane family share several characteristics. First, they all are apparently type III membrane proteins, which are integral membrane proteins containing an N-terminal membrane-anchoring domain which is not cleaved during biosynthesis and which functions both as a translocation signal and as a membrane anchor. The family members also contain three additional transmembrane regions, at least seven conserved cysteines residues, and are of approximately the same size (218 to 284 residues). These proteins are collectively know as the "transmembrane 4 superfamily" (TM4) because they span plasma membrane four times.

A schematic diagram of the domain structure of these proteins is as follows:

```
+-+-----+--------+----+-----+-----+----------------------------+-----+----+

||TMa|Extra | TM2| Cyt| TM3| Extracellular    |TM4|Cyt|

+-+-----+--------+----C-----C-----+--------CC----------C-----C---+-----C----+
         *********
``` where Cyt is the cytoplasmic domain, TMa is the transmembrane anchor; TM2 to TM4 represents transmembrane regions 2 to 4, 'C' are conserved cysteines, and '*' indicates the position of the consensus pattern. The consensus pattern spans a conserved region including two cysteines located in a short cytoplasmic loop between two transmembrane domains:

ee) Trypsin (trypsin). Some SEQ ID NOS, and thus the sequences they validate, correspond to novel serine proteases of the trypsin family. The catalytic activity of the serine proteases from the trypsin family is provided by a charge relay system involving an aspartic acid residue hydrogen-bonded to a histidine, which itself is hydrogen-bonded to a serine. The sequences in the vicinity of the active site serine and histidine residues are well conserved in this family of proteases (Brenner S., *Nature* (1988) 334:528). Proteases known to belong to the trypsin family include: 1) Acrosin; 2) Blood coagulation factors VII, IX, X, XI and XII, thrombin, plasminogen, and protein C; 3) Cathepsin G; 4) Chymotrypsins; 5) Complement components C1r, C1s, C2, and complement factors B, D and I; 6) Complement-activating component of RA-reactive factor; 7) Cytotoxic cell proteases (granzymes A to H); 8) Duodenase I; 9) Elastases 1, 2, 3A, 3B (protease E), leukocyte (medullasin); 10) Enterokinase (EC 3.4.21.9) (enteropeptidase); 11) Hepatocyte growth factor activator; 12) Hepsin; 13) Glandular (tissue) kallikreins (including EGF-binding protein types A, B, and C, NGF-gamma chain, gamma-renin, prostate specific antigen (PSA) and tonin); 14) Plasma kallikrein; 15) Mast cell proteases (MCP) 1 (chymase) to 8; 16) Myeloblastin (proteinase 3) (Wegener's autoantigen); 17) Plasminogen activators (urokinase-type, and tissue-type); 18) Trypsins I, II, III, and IV; 19) Tryptases; 20) Snake venom proteases such as ancrod, batroxobin, cerastobin, flavoxobin, and protein C activator; 21) Collagenase from common cattle grub and collagenolytic protease from Atlantic sand fiddler crab; 22) Apolipoprotein(a); 23) Blood fluke cercarial protease; 24) *Drosophila* trypsin like proteases: alpha, easter, snake-locus; 25) *Drosophila* protease stubble (gene sb); and 26) Major mite fecal allergen Der p III. All the above proteins belong to family S1 in the classification of peptidases (Rawlings N. D., et al., *Meth. Enzymol.* (1994)

ff) WD Domain, G-Beta Repeats (WD_domain). A few of the validation sequences, and the sequences they validate, represent novel members of the WD domain/G-beta repeat family. Beta-transducin (G-beta) is one of the three subunits (alpha, beta, and gamma) of the guanine nucleotide-binding proteins (G proteins) which act as intermediaries in the transduction of signals generated by transmembrane receptors (Gilman, *Annu. Rev. Biochem.* (1987) 56:615). The alpha subunit binds to and hydrolyzes GTP; the functions of the beta and gamma subunits are less clear but they seem to be required for the replacement of GDP by GTP as well as for membrane anchoring and receptor recognition.

In higher eukaryotes, G-beta exists as a small multigene family of highly conserved proteins of about 340 amino acid residues. Structurally, G-beta consists of eight tandem repeats of about 40 residues, each containing a central Trp-Asp motif (this type of repeat is sometimes called a WD-40 repeat). Such a repetitive segment has been shown to exist in a number of other proteins including: human LIS1, a neuronal protein involved in type-1 lissencephaly; and mammalian coatomer beta' subunit (beta'-COP), a component of a cytosolic protein complex that reversibly associates with Golgi membranes to form vesicles that mediate biosynthetic protein transport.

gg) wnt Family of Developmental Signaling Proteins (Wnt_dev_sign). Several of the validation sequences, and thus the sequences they validate, correspond to novel members of the wnt family of developmental signaling proteins. Wnt-1 (previously known as int-1), the seminal member of this family, (Nusse R., *Trends Genet.* (1988) 4:291) is a proto-oncogene induced by the integration of the mouse mammary tumor virus. It is thought to play a role in intercellular communication and seems to be a signalling molecule important in the development of the central nervous system (CNS). The sequence of wnt-1 is highly conserved in mammals, fish, and amphibians. Wnt-1 was found to be a member of a large family of related proteins (Nusse R., et al., *Cell* (1992) 69:1073; McMahon A. P., *Trends Genet.* (1992) 8:1; Moon R. T., *BioEssays* (1993) 15:91) that are all thought to be developmental regulators. These proteins are known as wnt-2 (also known as irp), wnt-3, -3A, -4, -5A, -5B, -6, -7A, -7B, -8, -8B, -9 and -10. At least four members of this family are present in *Drosophila*; one of them, wingless (wg), is implicated in segmentation polarity.

All these proteins share the following features characteristics of secretory proteins: a signal peptide, several potential N-glycosylation sites and 22 conserved cysteines that are probably involved in disulfide bonds. The Wnt proteins seem to adhere to the plasma membrane of the secreting cells and are therefore likely to signal over only few cell diameters. All sequences known to belong to this family are detected by the provided consensus pattern.

hh) Protein Tyrosine Phosphatase (Y_phosphatase). Several of the validation sequences, and thus the sequences they validate, represent a polynucleotide encoding a protein tyrosine kinase. Tyrosine specific protein phosphatases (EC 3.1.3.48) (PTPase) (Fischer et al., *Science* (1991) 253:401; Charbonneau et al., *Annu. Rev. Cell Biol.* (1992) 8:463; Trowbridge, *J. Biol. Chem.* (1991) 266:23517; Tonks et al., *Trends Biochem. Sci.* (1989) 14:497; and Hunter, *Cell* (1989) 58:1013) catalyze the removal of a phosphate group attached to a tyrosine residue. These enzymes are very important in the control of cell growth, proliferation, differentiation and transformation. Multiple forms of PTPase have been characterized and can be classified into two categories: soluble PTPases and transmembrane receptor proteins that contain PTPase domain(s).

Soluble PTPases include PTPN3 (H1) and PTPN4 (MEG), enzymes that contain an N-terminal band 4.1-like domain and could act at junctions between the membrane and cytoskeleton; PTPN6 (PTP-1C; HCP; SHP) and PTPN11 (PTP-2C; SH-PTP3; Syp), enzymes that contain two copies of the SH2 domain at its N-terminal extremity.

Dual specificity PTPases include DUSP1 (PTPN10; MAP kinase phosphatase-1; MKP-1) which dephosphorylates MAP kinase on both Thr-183 and Tyr-185; and DUSP2 (PAC-1), a nuclear enzyme that dephosphorylates MAP kinases ERK1 and ERK2 on both Thr and Tyr residues.

Structurally, all known receptor PTPases are made up of a variable length extracellular domain, followed by a transmembrane region and a C-terminal catalytic cytoplasmic domain. Some of the receptor PTPases contain fibronectin type III (FN-III) repeats, immunoglobulin-like domains, MAM domains or carbonic anhydrase-like domains in their extracellular region. The cytoplasmic region generally contains two copies of the PTPAse domain. The first seems to have enzymatic activity, while the second is inactive but seems to affect substrate specificity of the first. In these domains, the catalytic cysteine is generally conserved but some other, presumably important, residues are not.

PTPase domains consist of about 300 amino acids. There are two conserved cysteines and the second one has been shown to be absolutely required for activity. Furthermore, a number of conserved residues in its immediate vicinity have also been shown to be important.

ii) Zinc Finger, C2H2 Type (Zincfing_C2H2). Several of the validation sequences, and thus the sequences they validate, correspond to polynucleotides encoding novel members of the of the C2H2 type zinc finger protein family. Zinc finger domains (Klug et al., *Trends Biochem. Sci.* (1987) 12:464; Evans et al., *Cell* (1988) 52:1; Payre et al., *FEBS Lett.* (1988) 234:245; Miller et al., *EMBO J.* (1985) 4:1609; and Berg, *Proc. Natl. Acad. Sci. USA* (1988) 85:99) are nucleic acid-binding protein structures first identified in the *Xenopus* transcription factor TFIIIA. These domains have since been found in numerous nucleic acid-binding proteins. A zinc finger domain is composed of 25 to 30 amino acid residues. Two cysteine or histidine residues are positioned at both extremities of the domain, which are involved in the tetrahedral coordination of a zinc atom. It has been proposed that such a domain interacts with about five nucleotides.

Many classes of zinc fingers are characterized according to the number and positions of the histidine and cysteine residues involved in the zinc atom coordination. In the first class to be characterized, called C2H2, the first pair of zinc coordinating residues are cysteines, while the second pair are histidines. A number of experimental reports have demonstrated the zinc-dependent DNA or RNA binding property of some members of this class.

Mammalian proteins having a C2H2 zipper include (number in parenthesis indicates number of zinc finger regions in the protein): basonuclin (6), BCL-6/LAZ-3 (6), erythroid krueppel-like transcription factor (3), transcription factors Sp1 (3), Sp2 (3), Sp3 (3) and Sp(4) 3, transcriptional repressor YY1 (4), Wilms' tumor protein (4), EGR1/Krox24 (3), EGR2/Krox20 (3), EGR3/Pilot (3), EGR4/AT133 (4), Evi-1 (10), GLI1 (5), GLI2 (4+), GLI3 (3+), HIV-EP1/ZNF40 (4), HIV-EP2 (2), KR1 (9+), KR2 (9), KR3 (15+), KR4 (14+), KR5 (11+), HF.12 (6+), REX-1 (4), ZfX (13), ZfY (13), Zfp-35 (18), ZNF7 (15), ZNF8 (7), ZNF35 (10), ZNF42/ MZF-1 (13), ZNF43 (22), ZNF46/Kup (2), ZNF76 (7), ZNF91 (36), ZNF133 (3).

In addition to the conserved zinc ligand residues, it has been shown that a number of other positions are also important for the structural integrity of the C2H2 zinc fingers. (Rosenfeld et al., *J. Biomol. Struct. Dyn.* (1993) 11:557) The best conserved position is found four residues after the second cysteine; it is generally an aromatic or aliphatic residue. The consensus pattern for C2H2 zinc fingers is: C-x(2,4)-C-x(3)-[LIVMFYWC]-x(8)-H-x(3,5)-H. The two C's and two H's are zinc ligands.

jj) Zinc finger C3HC4 type (RING finger), signature (Zincfing_C3H4). Some SEQ ID NOS, and thus the sequences they validate, represent polynucleotides encoding a polypeptide having a C3HC4 type zinc finger signature. A number of eukaryotic and viral proteins contain this signature, which is primarily a conserved cysteine-rich domain of 40 to 60 residues (Borden K. L. B., et al., *Curr. Opin. Struct. Biol.* (1996) 6:395) that binds two atoms of zinc, and is probably involved in mediating protein-protein interactions. The 3D structure of the zinc ligation system is unique to the RING domain and is referred to as the "cross-brace" motif.

1) Mammalian V(D)J recombination activating protein (RAG1). RAG1 activates the rearrangement of immunoglobulin and T-cell receptor genes.

2) Mouse rpt-1. Rpt-1 is a trans-acting factor that regulates gene expression directed by the promoter region of the interleukin-2 receptor alpha chain or the LTR promoter region of HIV-1.

3) Human rip. Rfp is a developmentally regulated protein that may function in male germ cell development. Recombination of the N-terminal section of rfp with a protein tyrosine kinase produces the ret transforming protein.

4) Human 52 Kd Ro/SS-A protein. A protein of unknown function from the Ro/SS-A ribonucleoprotein complex. Sera from patients with systemic lupus erythematosus or primary Sjogren's syndrome often contain antibodies that react with the Ro proteins.

5) Human histocompatibility locus protein RING1.

6) Human PML, a probable transcription factor. Chromosomal translocation of PML with retinoic receptor alpha creates a fusion protein which is the cause of acute promyelocytic leukemia (APL).

7) Mammalian breast cancer type 1 susceptibility protein (BRCA1) ([E1] see Internet website at bioinformatics.weizmann.ac.il/hotmolecbase/entries/brca1.htm-).

8) Mammalian cbl proto-oncogene.

9) Mammalian bmi-1 proto-oncogene.

10) Vertebrate CDK-activating kinase (CAK) assembly factor MAT1, a protein that stabilizes the complex between the CDK7 kinase and cyclin H (MAT1 stands for 'Menage A Trois').

11) Mammalian mel-18 protein. Mel-18 which is expressed in a variety of tumor cells is a transcriptional repressor that recognizes and bind a specific DNA sequence.

12) Mammalian peroxisome assembly factor-1 (PAF-1) (PMP35), which is somewhat involved in the biogenesis of peroxisomes. In humans, defects in PAF-1 are responsible for a form of Zellweger syndrome, an autosomal recessive disorder associated with peroxisomal deficiencies.

13) Human MAT1 protein, which interacts with the CDK7-cyclin H complex.

14) Human RING1 protein.

15) *Xenopus* XNF7 protein, a probable transcription factor.

16) *Trypanosoma* protein ESAG-8 (T-LR), which may be involved in the postranscriptional regulation of genes in VSG expression sites or may interact with adenylate cyclase to regulate its activity.

17) *Drosophila* proteins Posterior Sex Combs (Psc) and Suppressor two of zeste (Su(z)2). The two proteins belong to the Polycomb group of genes needed to maintain the segment-specific repression of homeotic selector genes.

18) *Drosophila* protein male-specific msl-2, a DNA-binding protein which is involved in X chromosome dosage compensation (the elevation of transcription of the male single X chromosome).

19) *Arabidopsis thaliana* protein COP1 which is involved in the regulation of photomorphogenesis.

20) Fungal DNA repair proteins RAD5, RAD16, RAD 18 and rad8.

21) Herpesviruses trans-acting transcriptional protein ICP0/IE110. This protein which has been characterized in many different herpesviruses is a trans-activator and/or -repressor of the expression of many viral and cellular promoters.

22) Baculoviruses protein CG30.

23) Baculoviruses major immediate early protein (PE-38).

24) Baculoviruses immediate-early regulatory protein IE-N/IE-2.

25) *Caenorhabditis elegans* hypothetical proteins F54G8.4, R05D3.4 and T02C1.1.

26) Yeast hypothetical proteins YER116c and YKR017c.

The signature pattern for the C3HC4 finger is based on the central region of the domain:

Example 17

Differential Expression of Polynucleotides of the Invention: Description of Libraries and Detection of Differential Expression The relative expression levels of the polynucleotides of the invention was assessed in several libraries prepared from various sources, including cell lines and patient tissue samples. Table 20 provides a summary of these libraries, including the shortened library name (used hereafter), the mRNA source used to prepared the cDNA library, the "nickname" of the library that is used in the tables below (in quotes), and the approximate number of clones in the library.

TABLE 20

Description of cDNA Libraries

| Library (lib #) | Description | Number of Clones in this Clustering |
|---|---|---|
| 1 | Km12 L4<br>Human Colon Cell Line, High Metastatic Potential (derived from Km12C)<br>"High Colon" | 307133 |

TABLE 20-continued

Description of cDNA Libraries

| Library (lib #) | Description | Number of Clones in this Clustering |
|---|---|---|
| 2 | Km12C<br>Human Colon Cell Line, Low Metastatic Potential<br>"Low Colon" | 284755 |
| 3 | MDA-MB-231<br>Human Breast Cancer Cell Line, High Metastatic Potential; micro-metastases in lung<br>"High Breast" | 326937 |
| 4 | MCF7<br>Human Breast Cancer Cell, Non Metastatic<br>"Low Breast" | 318979 |
| 8 | MV-522<br>Human Lung Cancer Cell Line, High Metastatic Potential "High Lung" | 223620 |
| 9 | UCP-3<br>Human Lung Cancer Cell Line, Low Metastatic Potential<br>"Low Lung" | 312503 |
| 12 | Human microvascular endothelial cells (HMEC) - Untreated<br>PCR (OligodT) cDNA library | 41938 |
| 13 | Human microvascular endothelial cells (HMEC) - Basic fibroblast growth factor (bFGF) treated<br>PCR (OligodT) cDNA library | 42100 |
| 14 | Human microvascular endothelial cells (HMEC) - Vascular endothelial growth factor (VEGF) treated<br>PCR (OligodT) cDNA library | 42825 |
| 15 | Normal Colon - UC#2 Patient<br>PCR (OligodT) cDNA library<br>"Normal Colon Tumor Tissue" | 34285 |
| 16 | Colon Tumor - UC#2 Patient<br>PCR (OligodT) cDNA library<br>"Normal Colon Tumor Tissue" | 35625 |
| 17 | Liver Metastasis from Colon Tumor of UC#2 Patient<br>PCR (OligodT) cDNA library<br>"High Colon Metastasis Tissue" | 36984 |
| 18 | Normal Colon - UC#3 Patient<br>PCR (OligodT) cDNA library<br>"Normal Colon Tumor Tissue" | 36216 |
| 19 | Colon Tumor - UC#3 Patient<br>PCR (OligodT) cDNA library<br>"High Colon Tumor Tissue" | 41388 |
| 20 | Liver Metastasis from Colon Tumor of UC#3 Patient<br>PCR (OligodT) cDNA library<br>"High Colon Metastasis Tissue" | 30956 |

The KM12L4 and KM12C cell lines are described in Example 14 above. The MDA-MB-231 cell line was originally isolated from pleural effusions (Cailleau, *J. Natl. Cancer. Inst.* (1974) 53:661), is of high metastatic potential, and forms poorly differentiated adenocarcinoma grade II in nude mice consistent with breast carcinoma. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., *Cancer Res.* (1979) 39:870 (MDA-MB-231 and MCF-7); Gastpar et al., *J Med Chem* (1998) 41:4965 (MDA-MB-231 and MCF-7); Ranson et al., *Br J Cancer* (1998) 77:1586 (MDA-MB-231 and MCF-7); Kuang et al., *Nucleic Acids Res* (1998) 26:1116 (MDA-MB-231 and MCF-7); Varki et al., *Int J Cancer* (1987) 40:46 (UCP-3); Varki et al., *Tumour Biol.* (1990) 11:327; (MV-522 and UCP-3); Varki et al., *Anticancer Res.* (1990) 10:637; (MV-522); Kelner et al., *Anticancer Res* (1995) 15:867 (MV-522); and Zhang et al., *Anticancer Drugs* (1997) 8:696 (MV522)). The samples of libraries 15-20 are derived from two different patients (UC#2, and UC#3). The bFGF-treated HMEC were prepared by incubation with bFGF at 10 ng/ml for 2 hrs; the VEGF-treated HMEC were prepared by incubation with 20 ng/ml BEGF for 2 hrs. Following incubation with the respective growth factor, the cells were washed and lysis buffer added for RNA preparation.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., *Genomics* (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences between Proportions," pp 296-298 (1974).

Example 18

Polynucleotides Differentially Expressed in High Metastatic Potential Breast Cancer Cells Versus Low Metastatic Breast Cancer Cells A number of polynucleotide sequences have been identified that are differentially expressed between cells derived from high metastatic potential breast cancer tissue and low metastatic breast cancer cells. Expression of these sequences in breast cancer can be valuable in determining diagnostic, prognostic and/or treatment information. For example, sequences that are highly expressed in the high metastatic potential cells can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

The differential expression of these polynucleotides can be used as a diagnostic marker, a prognostic marker, for risk assessment, patient treatment and the like. These polynucleotide sequences can also be used in combination with other known molecular and/or biochemical markers.

The following tables summarize polynucleotides that are differentially expressed between high metastatic potential breast cancer cells and low metastatic potential breast cancer cells.

TABLE 21

Differentially expressed polynucleotides: Higher expression in high metastatic potential breast cancer (lib3) relative to low metastatic breast cancer cells (lib4)

| SEQ ID NOS: | Sequence Name | Cluster ID | Lib3 clones | Lib4 clones | lib3/lib4 | Zscore |
|---|---|---|---|---|---|---|
| 889 | RTA00000197AR.f.12.1 | 3513 | 17 | 5 | 3.317240 | 2.287632 |
| 990 | RTA00000185AF.a.19.2 | 5749 | 9 | 0 | 8.780930 | 2.629923 |
| 998 | RTA00000196F.e.7.1 | 1039 | 10 | 2 | 4.878294 | 1.978215 |
| 1003 | RTA00000182AF.1.12.1 | 1027 | 41 | 17 | 2.353059 | 2.926571 |
| 1009 | RTA00000192AF.g.23.1 | 6455 | 6 | 0 | 5.853953 | 2.011224 |
| 1018 | RTA00000181AF.e.22.3 | 3442 | 17 | 4 | 4.146550 | 2.562391 |
| 1027 | RTA00000198AF.c.17.1 | 6923 | 6 | 0 | 5.853953 | 2.011224 |
| 1208 | RTA00000187AF.g.13.1 | 2991 | 10 | 1 | 9.756589 | 2.371428 |
| 1210 | RTA00000192AF.o.19.1 | 3549 | 10 | 1 | 9.756589 | 2.371428 |
| 1231 | RTA00000191AF.j.14.1 | 1002 | 42 | 20 | 2.048883 | 2.570309 |
| 1340 | RTA00000190AF.p.3.1 | 2378 | 34 | 0 | 33.17240 | 5.588184 |
| 1354 | RTA00000178AF.n.23.1 | 3298 | 12 | 1 | 11.70790 | 2.729313 |
| 1356 | RTA00000191AF.c.3.1 | 3549 | 10 | 1 | 9.756589 | 2.371428 |
| 1373 | RTA00000178AF.b.13.1 | 3114 | 9 | 1 | 8.780930 | 2.174815 |
| 1404 | RTA00000184AF.i.23.3 | 1577 | 25 | 3 | 8.130490 | 3.903813 |
| 1450 | RTA00000179AR.e.01.4 | 2493 | 33 | 9 | 3.577416 | 3.469507 |
| 1488 | RTA00000197F.i.12.1 | 3605 | 14 | 1 | 13.65922 | 3.050936 |
| 1490 | RTA00000186AF.d.24.1 | 3114 | 9 | 1 | 8.780930 | 2.174815 |
| 1598 | RTA00000187AF.1.11.1 | 4482 | 14 | 3 | 4.553074 | 2.374769 |
| 1719 | RTA00000401F.m.02.1 | 1573 | 34 | 7 | 4.738914 | 3.982056 |
| 1746 | RTA00000422F.c.02.1 | 2902 | 18 | 5 | 3.512372 | 2.443314 |
| 1765 | RTA00000418F.m.19.1 | 8890 | 6 | 0 | 5.853953 | 2.011224 |
| 1786 | RTA00000351R.g.11.1 | 3077 | 17 | 4 | 4.146550 | 2.562391 |
| 1939 | RTA00000408F.1.13.1 | 4423 | 12 | 1 | 11.70790 | 2.729313 |
| 1948 | RTA00000404F.m.10.2 | 779 | 60 | 22 | 2.660887 | 3.974953 |

TABLE 21-continued

Differentially expressed polynucleotides: Higher expression in high metastatic potential breast cancer (lib3) relative to low metastatic breast cancer cells (lib4)

| SEQ ID NOS: | Sequence Name | Cluster ID | Lib3 clones | Lib4 clones | lib3/lib4 | Zscore |
|---|---|---|---|---|---|---|
| 1975 | RTA00000400F.k.22.1 | 2512 | 7 | 0 | 6.829612 | 2.235371 |
| 2014 | RTA00000340R.f.05.1 | 3202 | 18 | 3 | 5.853953 | 2.998867 |
| 2028 | RTA00000422F.c.17.1 | 1360 | 26 | 11 | 2.306102 | 2.226876 |
| 2049 | RTA00000118A.a.23.1 | 3500 | 12 | 3 | 3.902635 | 2.018050 |
| 2198 | RTA00000401F.k.14.1 | 211 | 121 | 43 | 2.745458 | 5.856098 |
| 2968 | RTA00000191AF.j.14.1 | 1002 | 42 | 20 | 2.048883 | 2.570309 |
| 2379 | RTA00000405F.l.11.1 | 2055 | 29 | 8 | 3.536763 | 3.213373 |
| 2595 | RTA00000423F.j.03.1 | 5391 | 6 | 0 | 5.853953 | 2.011224 |
| 2608 | RTA00000399F.o.24.1 | 2272 | 17 | 1 | 16.58620 | 3.483575 |
| 2621 | RTA00000401F.j.15.1 | 3061 | 14 | 0 | 13.65922 | 3.428594 |
| 2639 | RTA00000348R.o.12.1 | 2263 | 6 | 0 | 5.853953 | 2.011224 |
| 2713 | RTA00000340F.f.22.1 | 1720 | 57 | 8 | 6.951569 | 5.855075 |
| 2726 | RTA00000401F.g.22.1 | 1147 | 28 | 12 | 2.276537 | 2.294031 |
| 2734 | RTA00000346F.o.16.1 | 176 | 170 | 44 | 3.769591 | 8.366611 |
| 2759 | RTA00000400F.g.02.1 | 1508 | 21 | 5 | 4.097767 | 2.879196 |
| 2884 | RTA00000527F.j.02.2 | 4896 | 11 | 0 | 10.73224 | 2.974502 |
| 2903 | RTA00000528F.i.22.1 | 2478 | 17 | 5 | 3.317240 | 2.287632 |
| 3067 | RTA00000528F.j.11.1 | 1070 | 26 | 6 | 4.227855 | 3.289393 |
| 3089 | RTA00000527F.k.09.1 | 213 | 17 | 4 | 4.146550 | 2.562391 |
| 3144 | RTA00000528F.b.03.1 | 2078 | 11 | 2 | 5.366124 | 2.174565 |
| 3169 | RTA00000525F.d.13.1 | 349 | 77 | 1 | 75.12573 | 8.384408 |
| 3306 | RTA00000528F.g.22.2 | 920 | 76 | 32 | 2.317189 | 4.010278 |
| 3332 | RTA00000528F.h.02.2 | 1701 | 18 | 4 | 4.390465 | 2.714073 |
| 3336 | RTA00000528F.c.11.1 | 1701 | 18 | 4 | 4.390465 | 2.714073 |

TABLE 22

Differentially expressed polynucleotides: Higher expression in low metastatic breast cancer cells (lib4) relative to high metastatic potential breast cancer (lib3)

| SEQ ID NOS: | Sequence Name | Cluster ID | Lib4 Clones | Lib 3 Clones | lib4/lib3 | Zscore |
|---|---|---|---|---|---|---|
| 859 | RTA00000177AR.n.8.1 | 4188 | 4 | 13 | 3.33108 | 1.99126 |
| 880 | RTA00000181AF.p.4.3 | 40392 | 1 | 8 | 8.19958 | 2.03713 |
| 888 | RTA00000199F.f.08.2 | 12445 | 0 | 11 | 11.2744 | 3.05623 |
| 933 | RTA00000177AF.n.8.3 | 4188 | 4 | 13 | 3.33108 | 1.99126 |
| 1016 | RTA00000186AF.p.09.2 | 6879 | 3 | 43 | 14.6909 | 5.83444 |
| 1047 | RTA00000201F.d.09.1 | 1827 | 37 | 157 | 4.34910 | 8.71727 |
| 1105 | RTA00000192AF.a.24.1 | 13183 | 0 | 7 | 7.17463 | 2.30057 |
| 1263 | RTA00000182AF.j.20.1 | 4769 | 2 | 20 | 10.2494 | 3.68254 |
| 1264 | RTA00000181AF.c.11.1 | 4769 | 2 | 20 | 10.2494 | 3.68254 |
| 1347 | RTA00000197AF.k.9.1 | 3138 | 1 | 10 | 10.2494 | 2.45316 |
| 1396 | RTA00000193AF.b.24.1 | 35 | 386 | 1967 | 5.22298 | 33.2328 |
| 1408 | RTA00000200AF.g.18.1 | 1600 | 0 | 23 | 23.5738 | 4.64683 |
| 1414 | RTA00000183AF.a.19.2 | 3788 | 0 | 6 | 6.14969 | 2.07158 |
| 1434 | RTA00000190AF.d.2.1 | 2444 | 26 | 55 | 2.16815 | 3.22244 |
| 1537 | RTA00000198F.m.12.1 | 4 | 987 | 2807 | 2.91492 | 30.3819 |
| 1551 | RTA00000179AF.p.15.1 | 5622 | 2 | 13 | 6.66216 | 2.62993 |
| 1555 | RTA00000198F.i.2.1 | 8076 | 0 | 9 | 9.22453 | 2.70385 |
| 1570 | RTA00000200R.f.10.1 | 4 | 987 | 2807 | 2.91492 | 30.3819 |
| 1590 | RTA00000178AF.i.01.2 | 4 | 987 | 2807 | 2.91492 | 30.3819 |
| 1600 | RTA00000404F.a.02.1 | 9738 | 1 | 13 | 13.3243 | 2.98623 |
| 1834 | RTA00000126A.o.23.1 | 6268 | 3 | 18 | 6.14969 | 3.11179 |
| 1966 | RTA00000401F.o.06.1 | 2679 | 4 | 23 | 5.89345 | 3.52846 |
| 1986 | RTA00000411F.a.15.1 | 73812 | 0 | 12 | 12.2993 | 3.21838 |
| 2130 | RTA00000345F.n.12.1 | 7337 | 3 | 16 | 5.46639 | 2.80694 |
| 2133 | RTA00000126A.g.7.1 | 1902 | 13 | 48 | 3.78442 | 4.45002 |
| 2279 | RTA00000345F.e.11.1 | 4392 | 1 | 8 | 8.19958 | 2.03713 |
| 2704 | RTA00000340F.p.18.1 | 287 | 6 | 173 | 29.5526 | 12.5749 |
| 2777 | RTA00000400F.f.11.1 | 4088 | 0 | 82 | 84.0457 | 9.05778 |
| 2778 | RTA00000341F.o.12.1 | 2883 | 9 | 21 | 2.39154 | 2.07600 |
| 2823 | RTA00000122A.h.24.1 | 48 | 412 | 1020 | 2.53749 | 16.5262 |
| 2824 | RTA00000346F.j.13.1 | 5337 | 5 | 17 | 3.48482 | 2.40321 |
| 2851 | RTA00000400F.g.08.1 | 1275 | 15 | 32 | 2.18655 | 2.41857 |
| 2867 | RTA00000523F.d.19.1 | 26489 | 1 | 8 | 8.19958 | 2.03713 |
| 3253 | RTA00000526F.d.17.1 | 2757 | 4 | 16 | 4.09979 | 2.51500 |
| 2064 | RTA00000528F.d.04.1 | 2395 | 12 | 37 | 3.16025 | 3.51521 |

Example 19

Polynucleotides Differentially Expressed in High Metastatic Potential Lung Cancer Cells Versus Low Metastatic Lung Cancer Cells A number of polynucleotide sequences have been identified that are differentially expressed between cells derived from high metastatic potential lung cancer tissue and low metastatic lung cancer cells. Expression of these sequences in lung cancer tissue can be valuable in determining diagnostic, prognostic and/or treatment information. For example, sequences that are highly expressed in the high metastatic potential cells are associated can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

The differential expression of these polynucleotides can be used as a diagnostic marker, a prognostic marker, for risk assessment, patient treatment and the like. These polynucleotide sequences can also be used in combination with other known molecular and/or biochemical markers.

The following tables summarize polynucleotides that are differentially expressed between high metastatic potential lung cancer cells and low metastatic potential lung cancer cells:

TABLE 23

Differentially expressed polynucleotides: Higher expression in high metastatic potential lung cancer cells (lib8) relative to low metastatic lung cancer cells (lib9)

| SEQ ID NO: | Sequence Name | Cluster ID | Lib8 clones | Lib9 clones | lib8/lib9 | Zscore |
|---|---|---|---|---|---|---|
| 854 | RTA00000198AF.n.16.1 | 3721 | 9 | 0 | 12.5772 | 3.20845 |
| 898 | RTA00000200F.o.22.1 | 983 | 8 | 1 | 11.1797 | 2.53243 |
| 909 | RTA00000198AF.m.16.1 | 51 | 348 | 66 | 7.36849 | 17.4315 |
| 1015 | RTA00000198R.c.07.1 | 19181 | 6 | 0 | 8.38484 | 2.48169 |
| 1047 | RTA00000201F.d.09.1 | 1827 | 45 | 15 | 4.19242 | 5.09891 |
| 1096 | RTA00000181AF.e.18.3 | 8 | 1355 | 122 | 15.5211 | 39.0214 |
| 1097 | RTA00000181AF.e.17.3 | 8 | 1355 | 122 | 15.5211 | 39.0214 |
| 1129 | RTA00000181AR.j.14.3 | 5399 | 12 | 0 | 16.7696 | 3.80239 |
| 1263 | RTA00000182AF.j.20.1 | 4769 | 10 | 3 | 4.65824 | 2.29362 |
| 1264 | RTA00000181AF.c.11.1 | 4769 | 10 | 3 | 4.65824 | 2.29362 |
| 1335 | RTA00000196F.k.11.1 | 3 | 986 | 392 | 3.51507 | 22.4683 |
| 1369 | RTA00000198AF.c.7.1 | 19181 | 6 | 0 | 8.38484 | 2.48169 |
| 1370 | RTA00000185AF.e.20.1 | 5865 | 12 | 0 | 16.7696 | 3.80239 |
| 1396 | RTA00000193AF.b.24.1 | 35 | 868 | 11 | 110.273 | 34.2897 |
| 1537 | RTA00000198F.m.12.1 | 4 | 506 | 209 | 3.38335 | 15.7309 |
| 1544 | RTA00000183AF.i.18.2 | 40129 | 7 | 0 | 9.78231 | 2.74441 |
| 1570 | RTA00000200R.f.10.1 | 4 | 506 | 209 | 3.38335 | 15.7309 |
| 1586 | RTA00000177AF.m.1.1 | 14929 | 23 | 16 | 2.00886 | 2.02420 |
| 1590 | RTA00000178AF.i.01.2 | 4 | 506 | 209 | 3.38335 | 15.7309 |
| 1705 | RTA00000339F.f.11.1 | 5832 | 5 | 0 | 6.98736 | 2.18988 |
| 1834 | RTA00000126A.o.23.1 | 6268 | 5 | 0 | 6.98736 | 2.18988 |
| 1932 | RTA00000399F.f.11.1 | 40167 | 8 | 0 | 11.1797 | 2.98512 |
| 2132 | RTA00000423F.e.11.1 | 2566 | 11 | 2 | 7.68610 | 2.85611 |
| 2261 | RTA00000339F.o.07.1 | 2566 | 11 | 2 | 7.68610 | 2.85611 |
| 2288 | RTA00000419F.p.03.1 | 1937 | 10 | 3 | 4.65824 | 2.29362 |
| 2298 | RTA00000340F.1.05.1 | 38935 | 7 | 0 | 9.78231 | 2.74441 |
| 2414 | RTA00000403F.a.17.1 | 13686 | 8 | 0 | 11.1797 | 2.98512 |
| 2441 | RTA00000401F.n.23.1 | 1552 | 8 | 1 | 11.1797 | 2.53243 |
| 2823 | RTA00000122A.h.24.1 | 48 | 342 | 155 | 3.08345 | 12.2138 |
| 2868 | RTA00000528F.b.23.1 | 1605 | 22 | 4 | 7.68610 | 4.23808 |
| 2878 | RTA00000528F.m.16.1 | 4468 | 6 | 1 | 8.38484 | 1.97787 |
| 2970 | RTA00000526F.d.01.1 | 4468 | 6 | 1 | 8.38484 | 1.97787 |

TABLE 24

Differentially expressed polynucleotides: Higher expression in low metastatic lung cancer cells (lib9) relative to high metastatic potntial lung cancer cells

| SEQ ID NO: | Sequence Name | Cluster ID | Lib8 clones | Lib9 clones | lib9/lib8 | Zscore |
|---|---|---|---|---|---|---|
| 1018 | RTA00000181AF.e.22.3 | 3442 | 5 | 23 | 3.291654 | 2.368262 |
| 1098 | RTA00000178AF.n.2.1 | 17083 | 0 | 8 | 5.724617 | 2.034117 |
| 1310 | RTA00000177AF.p.20.1 | 4141 | 4 | 27 | 4.830145 | 3.070829 |
| 1415 | RTA00000198AF.b.14.1 | 801 | 16 | 46 | 2.057284 | 2.411087 |
| 1418 | RTA00000192AF.f.3.1 | 5257 | 5 | 25 | 3.577885 | 2.596857 |
| 1434 | RTA00000190AF.d.2.1 | 2444 | 12 | 37 | 2.206362 | 2.299984 |
| 1766 | RTA00000399F.1.14.1 | 3354 | 5 | 20 | 2.862308 | 1.998763 |

TABLE 24-continued

Differentially expressed polynucleotides: Higher expression in low
metastatic lung cancer cells (lib9) relative to high metastatic potntial lung cancer cells

| SEQ ID NO: | Sequence Name | Cluster ID | Lib8 clones | Lib9 clones | lib9/lib8 | Zscore |
|---|---|---|---|---|---|---|
| 2199 | RTA00000406F.m.04.1 | 14959 | 11 | 41 | 2.667151 | 2.865855 |
| 2266 | RTA00000405F.h.07.2 | 4984 | 3 | 16 | 3.816411 | 2.058861 |
| 2851 | RTA00000400F.g.08.1 | 1275 | 10 | 42 | 3.005423 | 3.147111 |
| 2882 | RTA00000527F.p.06.1 | 1292 | 8 | 33 | 2.951755 | 2.724411 |
| 3089 | RTA00000527F.k.09.1 | 213 | 137 | 403 | 2.104945 | 7.661033 |

Example 20

Polynucleotides Differentially Expressed in High Metastatic Potential Colon Cancer Cells Versus Low Metastatic Colon Cancer Cells A number of polynucleotide sequences have been identified that are differentially expressed between cells derived from high metastatic potential colon cancer tissue and low metastatic colon cancer cells. Expression of these sequences in colon cancer tissue can be valuable in determining diagnostic, prognostic and/or treatment information. For example, sequences that are highly expressed in the high metastatic potential cells can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

The differential expression of these polynucleotides can be used as a diagnostic marker, a prognostic marker, for risk assessment, patient treatment and the like. These polynucleotide sequences can also be used in combination with other known molecular and/or biochemical markers.

The following table summarizes identified polynucleotides with differential expression between high metastatic potential colon cancer cells and low metastatic potential colon cancer cells:

TABLE 25

Differentially expressed polynucleotides: Higher expression in high
metastatic potential colon cancer (lib1) relative to low metastatic colon cancer cells (lib2)

| SEQ ID NO: | Sequence Name | Cluster ID | Lib1 clones | Lib2 clones | lib1/lib2 | Zscore |
|---|---|---|---|---|---|---|
| 1072 | RTA00000187AR.h.15.2 | 6660 | 7 | 0 | 6.489973399 | 2.169320547 |
| 1124 | RTA00000193AF.b.18.1 | 7542 | 8 | 0 | 7.417112456 | 2.36964728 |
| 1199 | RTA00000184AR.b.24.1 | 5777 | 9 | 1 | 8.344251513 | 2.09555146 |
| 1335 | RTA00000196F.k.11.1 | 3 | 5268 | 2164 | 2.257009497 | 32.96556438 |
| 1447 | RTA00000183AR.d.11.3 | 6420 | 8 | 0 | 7.417112456 | 2.36964728 |
| 1524 | RTA00000177AF.f.10.1 | 6420 | 8 | 0 | 7.417112456 | 2.36964728 |
| 1596 | RTA00000192AF.o.7.1 | 5275 | 11 | 2 | 5.099264814 | 2.083995588 |
| 1597 | RTA00000192AF.o.17.1 | 5275 | 11 | 2 | 5.099264814 | 2.083995588 |
| 2085 | RTA00000346F.1.13.1 | 7542 | 8 | 0 | 7.417112456 | 2.36964728 |
| 2108 | RTA00000349R.g.10.1 | 5777 | 9 | 1 | 8.344251513 | 2.09555146 |
| 2245 | RTA00000421F.m.14.1 | 3524 | 21 | 6 | 3.2449867 | 2.499690198 |
| 2286 | RTA00000350R.g.10.1 | 9026 | 7 | 0 | 6.489973399 | 2.169320547 |
| 2358 | RTA00000399F.o.06.1 | 13574 | 7 | 0 | 6.489973399 | 2.169320547 |
| 2695 | RTA00000421F.a.06.1 | 2385 | 27 | 4 | 6.258188635 | 3.743586088 |
| 2759 | RTA00000400F.g.02.1 | 1508 | 46 | 17 | 2.508729213 | 3.230059264 |
| 2868 | RTA00000528F.b.23.1 | 1605 | 36 | 11 | 3.034273278 | 3.244010467 |
| 2910 | RTA00000528F.m.12.1 | 5768 | 12 | 0 | | 3.046665462 |

TABLE 26

Differentially expressed polynucleotides: Higher expression in low
metastatic colon cancer cells (lib2) relative to high metastatic potential
colon cancer (lib1)

| SEQ ID NOS: | Sequence Name | Cluster ID | Lib1 clones | Lib2 clones | lib2/lib1 | Zscore |
|---|---|---|---|---|---|---|
| 877 | RTA00000178AR.a.20.1 | 945 | 9 | 21 | 2.51670 | 2.21703 |
| 1094 | RTA00000192AF.j.21.1 | 2289 | 3 | 23 | 8.26916 | 3.92187 |
| 1126 | RTA00000193AF.c.15.1 | 3726 | 3 | 14 | 5.03340 | 2.58312 |
| 1214 | RTA00000179AF.c.15.3 | 2995 | 4 | 13 | 3.50540 | 2.09770 |
| 1231 | RTA00000191AF.j.14.1 | 1002 | 12 | 65 | 5.84234 | 6.26259 |
| 1287 | RTA00000197AR.i.17.1 | 3516 | 5 | 17 | 3.66719 | 2.52439 |
| 1304 | RTA00000179AF.c.15.1 | 2995 | 4 | 13 | 3.50540 | 2.09770 |
| 1389 | RTA00000196F.a.2.1 | 3575 | 5 | 14 | 3.02004 | 2.00158 |

TABLE 26-continued

Differentially expressed polynucleotides: Higher expression in low metastatic colon cancer cells (lib2) relative to high metastatic potential colon cancer (lib1)

| SEQ ID NOS: | Sequence Name | Cluster ID | Lib1 clones | Lib2 clones | lib2/lib1 | Zscore |
|---|---|---|---|---|---|---|
| 1404 | RTA00000184AF.i.23.3 | 1577 | 12 | 40 | 3.59528 | 4.01991 |
| 1547 | RTA00000198F.1.09.1 | 3611 | 2 | 13 | 7.01081 | 2.73040 |
| 1548 | RTA00000190AF.o.12.1 | 3438 | 5 | 14 | 3.02004 | 2.00158 |
| 1939 | RTA00000408F.1.13.1 | 4423 | 1 | 8 | 8.62869 | 2.11495 |
| 1948 | RTA00000404F.m.10.2 | 779 | 27 | 54 | 2.15717 | 3.23169 |
| 2049 | RTA00000118A.a.23.1 | 3500 | 3 | 13 | 4.67387 | 2.40298 |
| 2198 | RTA00000401F.k.14.1 | 211 | 109 | 206 | 2.03843 | 6.08597 |
| 2231 | RTA00000191AF.j.14.1 | 1002 | 12 | 65 | 5.84234 | 6.26259 |
| 2578 | RTA00000345F.b.17.1 | 945 | 9 | 21 | 2.51670 | 2.21703 |
| 2586 | RTA00000422F.b.22.1 | 2368 | 14 | 34 | 2.61942 | 3.00662 |
| 2798 | RTA00000401F.j.23.1 | 570 | 59 | 148 | 2.70560 | 6.66631 |
| 3106 | RTA00000527F.o.12.1 | 688 | 29 | 60 | 2.23155 | 3.53946 |
| 3169 | RTA00000525F.d.13.1 | 349 | 69 | 138 | 2.15717 | 5.27497 |

Example 21

Polynucleotides Differentially Expressed in High Metastatic Potential Colon Cancer Patient Tissue Versus Normal Patient Tissue A number of polynucleotide sequences have been identified that are differentially expressed between cells derived from high metastatic potential colon cancer tissue and normal tissue. Expression of these sequences in colon cancer tissue can be valuable in determining diagnostic, prognostic and/or treatment information. For example, sequences that are highly expressed in the high metastatic potential cells are associated can be indicative of increased expression of genes or regulatory sequences involved in the advanced disease state which involves processes such as angiogenesis, dedifferentiation, cell replication, and metastasis. A patient sample displaying an increased level of one or more of these polynucleotides may thus warrant more aggressive treatment.

The differential expression of these polynucleotides can be used as a diagnostic marker, a prognostic marker, for risk assessment, patient treatment and the like. These polynucleotide sequences can also be used in combination with other known molecular and/or biochemical markers.

The following tables summarize polynucleotides that are differentially expressed between high metastatic potential colon cancer cells and normal colon cells:

TABLE 27

Differentially expressed polynucleotides isolated from samples from two patients (UC#2 and UC#3): Higher expression in high metastatic potential colon tissue (UC#2: lib17; UC#3: lib20) vs. normal colon tissue (UC#2: lib15; UC#3: lib18)

| SEQ ID NO: | Sequence Name | Cluster ID | lib15 clones | lib17 clones | lib17/lib15 | Zscore |
|---|---|---|---|---|---|---|
| 909 | RTA00000198AF.m.16.1 | 51 | 1 | 10 | 9.27022 | 2.28830 |
| 2624 | RTA00000118A.j.24.1 | 18 | 4 | 23 | 5.33037 | 3.27028 |
| 2743 | RTA00000345F.j.09.1 | 13 | 14 | 80 | 5.29727 | 6.34580 |

| SEQ ID NO: | Sequence Name | Cluster ID | lib18 clones | lib20 clones | lib20/lib18 | Zscore |
|---|---|---|---|---|---|---|
| 2743 | RTA00000345F.j.09.1 | 13 | 12 | 23 | 2.24234 | 2.16077 |

TABLE 28

Differentially expressed polynucleotides isolated from samples from two patients (UC#2 and UC#3): Higher expression in normal colon tissue (UC#2: lib15; UC#3: lib18) vs. high metastatic potential colon tissue (UC#2: lib17; UC#3: lib20).

| SEQ ID NO: | Sequence Name | Cluster ID | Lib5 Clones | L1ib7 Clones | lib15/lib17 | Z Score: >2.5899%; >1.96 |
|---|---|---|---|---|---|---|
| 1335 | RTA00000196F.k.11.1 | 3 | 242 | 26 | 10.04 | 13.78900072 |

| SEQ ID NO: | Sequence Name | Cluster ID | Lib18 clones | Lib20 clones | lib18/lib20 | Zscore |
|---|---|---|---|---|---|---|
| 1335 | RTA00000196F.k.11.1 | 3 | 409 | 46 | 7.59993 | 15.3998 |

Example 22

Polynucleotides Differentially Expressed in High Colon Tumor Potential Patient Tissue Versus Metastasized Colon Cancer Patient Tissue A number of polynucleotide sequences have been identified that are differentially expressed between cells derived from high tumor potential colon cancer tissue and cells derived from high metastatic potential colon cancer cells. Expression of these sequences in colon cancer tissue can be valuable in determining diagnostic, prognostic and/or treatment information associated with the transformation of precancerous tissue to malignant tissue. This information can be useful in the prevention of achieving the advanced malignant state in these tissues, and can be important in risk assessment for a patient.

The following table summarizes identified polynucleotides with differential expression between high tumor potential colon cancer tissue and cells derived from high metastatic potential colon cancer cells:

TABLE 29

Differentially expressed polynucleotides: High tumor potential colon tissue vs. metastatic colon tissue

| SEQ ID NO: | Sequence Name | Cluster ID | L19 clones | L20 clones | lib19/lib20 | Zscore |
|---|---|---|---|---|---|---|
| 1096 | RTA00000181AF.e.18.3 | 8 | 14 | 1 | 10.4712 | 2.56699 |
| 1097 | RTA00000181AF.e.17.3 | 8 | 14 | 1 | 10.4712 | 2.56699 |
| 1335 | RTA00000196F.k.11.1 | 3 | 328 | 46 | 5.33318 | 11.8962 |
| 1425 | RTA00000191AF.p.3.2 | 17 | 24 | 2 | 8.97535 | 3.41950 |
| 1537 | RTA00000198F.m.12.1 | 4 | 26 | 8 | 2.43082 | 2.09705 |
| 1570 | RTA00000200R.f.10.1 | 4 | 26 | 8 | 2.43082 | 2.09705 |
| 1590 | RTA00000178AF.i.01.2 | 4 | 26 | 8 | 2.43082 | 2.09705 |
| 2624 | RTA00000118A.j.24.1 | 18 | 80 | 13 | 4.60274 | 5.51440 |
| 2743 | RTA00000345F.j.09.1 | 13 | 148 | 23 | 4.81287 | 7.68618 |

Example 23

Polynucleotides Differentially Expressed in High Tumor Potential Colon Cancer Patient Tissue Versus Normal Patient Tissue A number of polynucleotide sequences have been identified that are differentially expressed between cells derived from high tumor potential colon cancer tissue and normal tissue. Expression of these sequences in colon cancer tissue can be valuable in determining diagnostic, prognostic and/or treatment information associated with the prevention of achieving the malignant state in these tissues, and can be important in risk assessment for a patient. For example, sequences that are highly expressed in the potential colon cancer cells are associated with or can be indicative of increased expression of genes or regulatory sequences involved in early tumor progression. A patient sample displaying an increased level of one or more of these polynucleotides may thus warrant closer attention or more frequent screening procedures to catch the malignant state as early as possible.

The following tables summarize polynucleotides that are differentially expressed between high metastatic potential colon cancer cells and normal colon cells:

TABLE 30

Differentially expressed polynucleotides detected in samples from two patients (UC#2 and UC#3): Higher expression in tumor potential colon tissue (UC#2: lib16; UC#3: lib19)vs. normal colon tissue (UC#2: lib15; UC#3: lib18)

| SEQ ID NO: | Sequence Name | Cluster ID | Lib15 clones | Lib16 clones | lib16/lib15 | Zscore |
|---|---|---|---|---|---|---|
| 2743 | RTA00000345F.j.09.1 | 13 | 14 | 50 | 3.43709 | 4.22436 |

| SEQ ID NO: | Sequence Name | Cluster ID | Lib18 clones | Lib19 clones | lib19/lib18 | Zscore |
|---|---|---|---|---|---|---|
| 909 | RTA00000198AF.m.16.1 | 51 | 0 | 14 | 12.2505 | 3.23250 |
| 1096 | RTA00000181AF.e.18.3 | 8 | 1 | 14 | 12.2505 | 2.84687 |
| 1097 | RTA00000181AF.e.17.3 | 8 | 1 | 14 | 12.2505 | 2.84687 |
| 1425 | RTA00000191AF.p.3.2 | 17 | 4 | 24 | 5.25021 | 3.24580 |
| 1537 | RTA00000198F.m.12.1 | 4 | 6 | 26 | 3.79182 | 2.98901 |
| 1560 | RTA00000200F.p.05.1 | 3984 | 0 | 7 | 6.12525 | 2.09621 |
| 1570 | RTA00000200R.f.10.1 | 4 | 6 | 26 | 3.79182 | 2.98901 |
| 1590 | RTA00000178AF.i.01.2 | 4 | 6 | 26 | 3.79182 | 2.98901 |
| 2624 | RTA00000118A.j.24.1 | 18 | 10 | 80 | 7.00028 | 6.65963 |
| 2743 | RTA00000345F.j.09.1 | 13 | 12 | 148 | 10.7921 | 9.86174 |

TABLE 31

| | | | Lib15 | Lib16 | | |
|---|---|---|---|---|---|---|
| SEQ ID NO: | Sequence Name | Cluster ID | clones | clones | lib15/lib16 | Zscore |
| 1335 | RTA00000196F.k.11.1 | 3 | 242 | 39 | 6.44765 | 12.3988 |

Differentially expressed polynucleotides: Higher expression in normal colon tissue (UC#2: lib15) vs. tumor potential colon tissue (UC#2: lib16)

Example 24

Polynucleotides Differentially Expressed in Growth Factor-Stimulated Human Microvascular Endothelial Cells (HMEC) Relative to Untreated HMEC A number of polynucleotide sequences have been identified that are differentially expressed between human microvascular endothelial cells (HMEC) that have been treated with growth factors relative to untreated HMEC.

Sequences that are differentially expressed between growth factor-treated HMEC and untreated HMEC can represent sequences encoding gene products involved in angiogenesis, metastasis (cell migration), and other development and oncogenic processes. For example, sequences that are more highly expressed in HMEC treated with growth factors (such as bFGF or VEGF) relative to untreated HMEC can serve as markers of cancer cells of higher metastatic potential. Detection of expression of these sequences in colon cancer tissue can be valuable in determining diagnostic, prognostic and/or treatment information associated with the prevention of achieving the malignant state in these tissues, and can be important in risk assessment for a patient. A patient sample displaying an increased level of one or more of these polynucleotides may thus warrant closer attention or more frequent screening procedures to catch the malignant state as early as possible.

The following table summarizes identified polynucleotides with differential expression between growth factor-treated and untreated HMEC.

TABLE 32

Differentially expressed polynucleotides: Higher expression in bFGF treated HMEC (lib13) vs. untreated HMEC (lib12)

| SEQ ID NO: | Sequence Name | Cluster ID | Lib12 clones | Lib13 clones | lib13/lib12 | Zscore |
|---|---|---|---|---|---|---|
| 1492 | RTA00000199F.i.9.1 | 7 | 25 | 52 | 2.07199 | 2.94741 |

TABLE 33

Differentially expressed polynucleotides: Higher expression in VEGF treated HMEC (lib14) vs. untreated HMEC (lib12)

| SEQ ID NO: | Sequence Name | Cluster ID | Lib12 clones | Lib14 clones | lib14/lib12 | Zscore |
|---|---|---|---|---|---|---|
| 1492 | RTA00000199F.i.9.1 | 7 | 25 | 67 | 2.62449 | 4.17666 |
| 2743 | RTA00000345F.j.09.1 | 13 | 22 | 49 | 2.18114 | 2.99887 |

Example 25

Polynucleotides Differentially Expressed Across Multiple Libraries

A number of polynucleotide sequences have been identified that are differentially expressed between cancerous cells and normal cells across all three tissue types tested (i.e., breast, colon, and lung). Expression of these sequences in a tissue or any origin can be valuable in determining diagnostic, prognostic and/or treatment information associated with the prevention of achieving the malignant state in these tissues, and can be important in risk assessment for a patient. These polynucleotides can also serve as non-tissue specific markers of, for example, risk of metastasis of a tumor. The following table summarizes identified polynucleotides that were differentially expressed but without tissue type-specificity in the breast, colon, and lung libraries tested.

TABLE 34

Polynucleotides Differentially Expressed Across Multiple Library Comparisons

| SEQ ID NO. | Cluster | Clones in 1st Lib | Clones in 2nd Lib | Ratio | Cell or Tissue Sample and Cancer State Compared (Z Score) |
|---|---|---|---|---|---|
| 2868 | 1605 | lib1 | lib2 | lib1/lib2 | colon: high met > low met |
| | | 36 | 11 | 3.0342732 | (3.2440104) |
| | | lib8 | lib9 | lib8/lib9 | lung: high met > low met |
| | | 22 | 4 | 7.6861036 | (4.2380835) |

TABLE 34-continued

Polynucleotides Differentially Expressed Across Multiple Library Comparisons

| SEQ ID NO. | Cluster | Clones in 1st Lib | Clones in 2nd Lib | Ratio | Cell or Tissue Sample and Cancer State Compared (Z Score) |
|---|---|---|---|---|---|
| 909 | 51 | lib8 | lib9 | lib8/lib9 | lung: high met > low met |
| | | 348 | 66 | 7.3684960 | (17.431560) |
| | | lib18 | lib19 | lib19/lib18 | pt #3 colon: tumor > normal |
| | | 0 | 14 | 12.250507 | (3.2325073) |
| | | lib15 | lib17 | lib17/lib15 | pt #2 colon: met > normal |
| | | 1 | 10 | 9.2702249 | (2.2883061) |
| 1018 | 3442 | lib8 | lib9 | lib9/lib8 | lung: low met > high met |
| | | 5 | 23 | 3.2916548 | (2.3682625) |
| | | lib3 | lib4 | lib3/lib4 | breast: high met > low met |
| | | 17 | 4 | 4.1465504 | (2.5623912) |
| 1047 | 1827 | lib8 | lib9 | lib8/lib9 | lung: high met > low met |
| | | 45 | 15 | 4.1924201 | (5.0989192) |
| | | lib3 | lib4 | lib4/lib3 | breast: low met > high met |
| | | 37 | 157 | 4.3491051 | (8.7172773) |
| 3089 | 213 | lib8 | lib9 | lib9/lib8 | lung: low met > high met |
| | | 137 | 403 | 2.1049458 | (7.6610331) |
| | | lib3 | lib4 | lib3/lib4 | breast: high met > low met |
| | | 17 | 4 | 4.1465504 | (2.5623912) |
| 1834 | 6268 | lib8 | lib9 | lib8/lib9 | lung: high met > low met |
| | | 5 | 0 | 6.9873669 | (2.1898837) |
| | | lib3 | lib4 | lib4/lib3 | breast: low met > high met |
| | | 3 | 18 | 6.1496901 | (3.1117967) |
| 1096 | 8 | lib8 | lib9 | lib8/lib9 | lung: high met > low met |
| | | 1355 | 122 | 15.521118 | (39.021411) |
| | | lib19 | lib20 | lib19/lib20 | pt. #3 colon: tumor > met |
| | | 14 | 1 | 10.471247 | (2.5669948) |
| | | lib18 | lib19 | lib19/lib18 | pt #3 colon: tumor > normal |
| | | 1 | 14 | 12.250507 | (2.8468716) |
| 1097 | 8 | lib8 | lib9 | lib8/lib9 | lung: high met > low met |
| | | 1355 | 122 | 15.521118 | (39.021411) |
| | | lib19 | lib20 | lib19/lib20 | pt. #3 colon: tumor > met |
| | | 14 | 1 | 10.471247 | (2.5669948) |
| | | lib18 | lib19 | lib19/lib18 | pt #3 colon: tumor > normal |
| | | 1 | 14 | 12.250507 | (2.8468716) |
| 3169 | 349 | lib3 | lib4 | lib3/lib4 | breast: high met > low met |
| | | 77 | 1 | 75.125736 | (8.3844087) |
| | | lib1 | lib2 | lib2/lib1 | colon: low met > high met |
| | | 69 | 138 | 2.1571737 | (5.2749799) |
| 1939 | 4423 | lib3 | lib4 | lib3/lib4 | breast: high met > low met |
| | | 12 | 1 | 11.707907 | (2.7293134) |
| | | lib1 | lib2 | lib2/lib1 | colon: low met > high met |
| | | 1 | 8 | 8.6286948 | (2.1149516) |
| 1968 | 779 | lib3 | lib4 | lib3/lib4 | breast: high met > low met |
| | | 60 | 22 | 2.6608879 | (3.9749537) |
| | | lib1 | lib2 | lib2/lib1 | colon: low met > high met |
| | | 27 | 54 | 2.1571737 | (3.2316908) |
| 1231 | 1002 | lib3 | lib4 | lib3/lib4 | breast: high met > low met |
| | | 42 | 20 | 2.0488837 | (2.5703094) |
| | | lib1 | lib2 | lib2/lib1 | colon: low met > high met |
| | | 12 | 65 | 5.8423454 | (6.2625969) |
| 1263 | 4769 | lib8 | lib9 | lib8/lib9 | lung: high met > low met |
| | | 10 | 3 | 4.6582446 | (2.2936274) |
| | | lib3 | lib4 | lib4/lib3 | breast: low met > high met |
| | | 2 | 20 | 10.249483 | (3.6825426) |
| 1264 | 4769 | lib8 | lib9 | lib8/lib9 | lung: high met > low met |
| | | 10 | 3 | 4.6582446 | (2.2936274) |
| | | lib3 | lib4 | lib4/lib3 | breast: low met > high met |
| | | 2 | 20 | 10.249483 | (3.6825426) |
| 2049 | 3500 | lib3 | lib4 | lib3/lib4 | breast: high met > low met |
| | | 12 | 3 | 3.9026356 | (2.0180506) |
| | | lib1 | lib2 | lib2/lib1 | colon: low met > high met |
| | | 3 | 13 | 4.6738763 | (2.4029818) |
| 1335 | 3 | lib1 | lib2 | lib1/lib2 | colon: high met > low met |
| | | 5268 | 2164 | 2.2570094 | (32.965564) |
| | | lib8 | lib9 | lib8/lib9 | lung: high met > low met |
| | | 986 | 392 | 3.5150733 | (22.468331) |
| | | lib19 | lib20 | lib19/lib20 | pt #3 colon: tumor > met |
| | | 328 | 46 | 5.3331820 | (11.896271) |
| | | lib18 | lib20 | lib18/lib20 | pt #3 colon: normal > met |
| | | 409 | 46 | 7.5999342 | (15.399861) |
| | | lib15 | lib17 | lib15/lib17 | pt#2 colon: normal > met |
| | | 242 | 26 | 10.04 | (13.789000) |
| | | lib15 | lib16 | lib15/lib16 | pt#2 colon: normal > tumor |
| | | 242 | 39 | 6.44765 | 12.39883 |

TABLE 34-continued

Polynucleotides Differentially Expressed Across Multiple Library Comparisons

| SEQ ID NO. | Cluster | Clones in 1st Lib | Clones in 2nd Lib | Ratio | Cell or Tissue Sample and Cancer State Compared (Z Score) |
|---|---|---|---|---|---|
| 1396 | 35 | lib8 | lib9 | lib8/lib9 | lung: high met > low met |
|  |  | 868 | 11 | 110.27335 | (34.289704) |
|  |  | lib3 | lib4 | lib4/lib3 | breast: low met > high met |
|  |  | 386 | 1967 | 5.2229880 | (33.232871) |
| 1404 | 1577 | lib3 | lib4 | lib3/lib4 | breast: high met > low met |
|  |  | 25 | 3 | 8.1304909 | (3.9038139) |
|  |  | lib1 | lib2 | lib2/lib1 | colon: low met > high met |
|  |  | 12 | 40 | 3.5952895 | (4.0199130) |
| 1425 | 17 | lib19 | lib20 | lib19/lib20 | pt #3 colon: tumor > met |
|  |  | 24 | 2 | 8.9753551 | (3.4195074) |
|  |  | lib18 | lib19 | lib19/lib18 | pt #3 colon: tumor > normal |
|  |  | 4 | 24 | 5.2502174 | (3.2458055) |
| 1434 | 2444 | lib3 | lib4 | lib4/lib3 | breast: low met > high met |
|  |  | 26 | 55 | 2.1681599 | (3.2224421) |
|  |  | lib8 | lib9 | lib9/lib8 | lung: low met > high met |
|  |  | 12 | 37 | 2.2063628 | (2.2999846) |
| 2198 | 211 | lib3 | lib4 | lib3/lib4 | breast: high met > low met |
|  |  | 121 | 43 | 2.7454588 | (5.8560985) |
|  |  | lib1 | lib2 | lib2/lib1 | colon: low met > high met |
|  |  | 109 | 206 | 2.0384302 | (6.0859794) |
| 2231 | 1002 | lib3 | lib4 | lib3/lib4 | breast: high met > low met |
|  |  | 42 | 20 | 2.0488837 | (2.5703094) |
|  |  | lib1 | lib2 | lib2/lib1 | colon: low met > high met |
|  |  | 12 | 65 | 5.8423454 | (6.2625969) |
| 1492 | 7 | lib12 | lib14 | lib14/lib12 | HMEC: VEGF > untreated |
|  |  | 25 | 67 | 2.6244913 | (4.1766696) |
|  |  | lib12 | lib13 | lib13/lib12 | HMEC: bFGF > untreated |
|  |  | 25 | 52 | 2.0719962 | (2.9474155) |
| 1537 | 4 | lib8 | lib9 | lib8/lib9 | lung: high met > low met |
|  |  | 506 | 209 | 3.3833566 | (15.730912) |
|  |  | lib3 | lib4 | lib4/lib3 | breast: low met > high met |
|  |  | 987 | 2807 | 2.9149240 | (30.381945) |
|  |  | lib19 | lib20 | lib19/lib20 | pt#3 colon: tumor > met |
|  |  | 26 | 8 | 2.4308253 | (2.0970580) |
|  |  | lib18 | lib19 | lib19/lib18 | pt#3 colon: tumor > normal |
|  |  | 6 | 26 | 3.7918237 | (2.9890107) |
| 1570 | 4 | lib8 | lib9 | lib8/lib9 | lung: high met > low met |
|  |  | 506 | 209 | 3.3833566 | (15.730912) |
|  |  | lib3 | lib4 | lib4/lib3 | breast: low met > high met |
|  |  | 987 | 2807 | 2.9149240 | (30.381945) |
|  |  | lib19 | lib20 | lib19/lib20 | pt#3 colon: tumor > met |
|  |  | 26 | 8 | 2.4308253 | (2.0970580) |
|  |  | lib18 | lib19 | lib19/lib18 | pt#3 colon: tumor > normal |
|  |  | 6 | 26 | 3.7918237 | (2.9890107) |
| 1590 | 4 | lib8 | lib9 | lib8/lib9 | lung: high met > low met |
|  |  | 506 | 209 | 3.3833566 | (15.730912) |
|  |  | lib3 | lib4 | lib4/lib3 | breast: low met > high met |
|  |  | 987 | 2807 | 2.9149240 | (30.381945) |
|  |  | lib19 | lib20 | lib19/lib20 | pt#3 colon: tumor > met |
|  |  | 26 | 8 | 2.4308253 | (2.0970580) |
|  |  | lib18 | lib19 | lib19/lib18 | pt#3 colon: tumor > normal |
|  |  | 6 | 26 | 3.7918237 | (2.9890107) |
| 2624 | 18 | lib19 | lib20 | lib19/lib20 | pt#3 colon: tumor > met |
|  |  | 80 | 13 | 4.6027462 | (5.5144093) |
|  |  | lib18 | lib19 | lib19/lib18 | pt#3 colon: tumor > normal |
|  |  | 10 | 80 | 7.0002899 | (6.6596394) |
|  |  | lib15 | lib17 | lib17/lib15 | pt#3 colon: met > normal |
|  |  | 4 | 23 | 5.3303793 | (3.2702852) |
| 2743 | 13 | lib19 | lib20 | lib19/lib20 | pt#3 colon: tumor > met |
|  |  | 148 | 23 | 4.8128716 | (7.6861840) |
|  |  | lib18 | lib20 | lib20/lib18 | pt#3 colon: met > normal |
|  |  | 12 | 23 | 2.2423439 | (2.1607719) |
|  |  | lib18 | lib19 | lib19/lib18 | pt#3 colon: tumor > normal |
|  |  | 12 | 148 | 10.792113 | (9.8617485) |
|  |  | lib15 | lib17 | lib17/lib15 | pt#2 colon: met > normal |
|  |  | 14 | 80 | 5.2972714 | (6.3458044) |
|  |  | lib15 | lib16 | lib16/lib15 | pt#2 colon: tumor > normal |
|  |  | 14 | 50 | 3.4370927 | (4.2243697) |
|  |  | lib12 | lib14 | lib14/lib12 | HMEC: VEGF > untreated |
|  |  | 22 | 49 | 2.1811410 | (2.9988774) |
| 2759 | 1508 | lib1 | lib2 | lib1/lib2 | colon: high met > low met |
|  |  | 46 | 17 | 2.5087292 | (3.2300592) |
|  |  | lib3 | lib4 | lib3/lib4 | breast: high met > low met |
|  |  | 21 | 5 | 4.0977674 | (2.8791960) |

TABLE 34-continued

Polynucleotides Differentially Expressed Across Multiple Library Comparisons

| SEQ ID NO. | Cluster | Clones in 1st Lib | Clones in 2nd Lib | Ratio | Cell or Tissue Sample and Cancer State Compared (Z Score) |
|---|---|---|---|---|---|
| 2823 | 48 | lib8 | lib9 | lib8/lib9 | lung: high met > low met |
|  |  | 342 | 155 | 3.0834574 | (12.213852) |
|  |  | lib3 | lib4 | lib4/lib3 | breast: low met > high met |
|  |  | 412 | 1020 | 2.5374934 | (16.526285) |
| 2851 | 1275 | lib3 | lib4 | lib4/lib3 | breast: low met > high met |
|  |  | 15 | 32 | 2.1865564 | (2.4185764) |
|  |  | lib8 | lib9 | lib9/lib8 | lung: low met > high met |
|  |  | 10 | 42 | 3.0054239 | 3.1471113 | high met = high metastatic potential;
low met = low metastatic potential;
met = metastasized;
tumor = non-metastasized tumor;
Pt = patient;
2 = UC#2;
3 = UC#3;
HMEC = human microvascular endothelial cell;
bFGF = bFGF treated;
VEGF = VEGF treated

Example 12

Polynucleotides Exhibiting Colon-Specific Expression

The cDNA libraries described herein were also analyzed to identify those polynucleotides that were specifically expressed in colon cells or tissue, i.e., the polynucleotides were identified in libraries prepared from colon cell lines or tissue, but not in libraries of breast or lung origin. The polynucleotides that were expressed in a colon cell line and/or in colon tissue, but were present in the breast or lung cDNA libraries described herein, are shown in Table 35 (inserted before claims).

TABLE 35

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 847 | RTA00000197AF.e.24.1 | 39250 | 2 | 0 | 0 | 0 | 0 | 0 | 0 | 0 |
| 851 | RTA00000197AR.e.12.1 | 22095 | 3 | 0 | 0 | 0 | 0 | 0 | 0 | 0 |
| 860 | RTA00000196AF.e.16.1 | 39252 | 2 | 0 | 0 | 0 | 0 | 0 | 0 | 0 |
| 862 | RTA00000196AF.c.17.1 | 39602 | 2 | 0 | 0 | 0 | 0 | 0 | 0 | 0 |
| 865 | RTA00000131A.g.19.2 | 36535 | 2 | 0 | 0 | 0 | 0 | 0 | 0 | 0 |
| 866 | RTA00000187AR.o.10.2 | 8984 | 4 | 3 | 0 | 0 | 0 | 2 | 0 | 0 |
| 867 | RTA00000198R.b.08.1 | 22636 | 3 | 0 | 0 | 0 | 0 | 0 | 0 | 0 |
| 870 | RTA00000200R.g.09.1 | 22785 | 3 | 0 | 0 | 0 | 0 | 0 | 0 | 0 |
| 873 | RTA00000200AF.b.19.1 | 22847 | 3 | 0 | 0 | 0 | 0 | 0 | 0 | 0 |
| 875 | RTA00000200F.m.15.1 | 22601 | 3 | 0 | 0 | 0 | 1 | 0 | 0 | 0 |
| 881 | RTA00000181AF.n.15.2 | 86128 | 1 | 0 | 0 | 0 | 0 | 0 | 0 | 0 |
| 882 | RTA00000196R.k.07.1 | 22443 | 2 | 0 | 0 | 0 | 0 | 0 | 0 | 1 |
| 884 | RTA00000200AR.e.02.1 | 36059 | 2 | 0 | 0 | 0 | 1 | 1 | 1 | 0 |
| 892 | RTA00000177AR.a.23.5 | 6995 | 4 | 2 | 0 | 0 | 0 | 0 | 0 | 0 |
| 893 | RTA00000198R.o.05.1 | 26702 | 2 | 0 | 0 | 0 | 0 | 0 | 0 | 0 |
| 894 | RTA00000201R.a.02.1 | 35362 | 2 | 0 | 0 | 0 | 0 | 0 | 0 | 0 |
| 905 | RTA00000197AF.h.11.1 | 22264 | 3 | 0 | 0 | 0 | 0 | 0 | 0 | 0 |
| 910 | RTA00000199F.c.09.2 | 16824 | 3 | 1 | 0 | 0 | 0 | 0 | 0 | 0 |
| 919 | RTA00000180AR.h.19.2 | 84182 | 1 | 0 | 0 | 0 | 0 | 0 | 0 | 0 |
| 922 | RTA00000199R.f.09.1 | 22907 | 3 | 0 | 0 | 0 | 0 | 0 | 0 | 0 |
| 923 | RTA00000199AF.p.4.1 | 10282 | 3 | 3 | 0 | 0 | 0 | 0 | 0 | 0 |
| 929 | RTA00000200R.o.03.1 | 22807 | 3 | 0 | 0 | 0 | 0 | 0 | 0 | 0 |
| 930 | RTA00000189AF.l.22.1 | 33333 | 1 | 1 | 0 | 0 | 0 | 0 | 0 | 0 |
| 931 | RTA00000195AF.d.20.1 | 37574 | 2 | 0 | 0 | 0 | 0 | 0 | 0 | 0 |
| 936 | RTA00000198AF.j.18.1 | 22759 | 3 | 0 | 0 | 0 | 0 | 0 | 0 | 0 |
| 939 | RTA00000180AF.g.3.1 | 9024 | 5 | 2 | 0 | 0 | 0 | 0 | 0 | 0 |
| 946 | RTA00000199R.j.08.1 | 37844 | 2 | 0 | 0 | 0 | 0 | 0 | 0 | 0 |
| 947 | RTA00000199F.e.10.1 | 22906 | 3 | 0 | 0 | 0 | 0 | 0 | 1 | 0 |
| 949 | RTA00000179AF.g.12.3 | 36390 | 2 | 0 | 0 | 0 | 0 | 0 | 0 | 0 |
| 952 | RTA00000183AR.h.23.2 | 18957 | 3 | 0 | 0 | 0 | 0 | 0 | 0 | 0 |
| 953 | RTA00000197AF.d.12.1 | 39546 | 2 | 0 | 0 | 0 | 0 | 0 | 0 | 0 |
| 960 | RTA00000181AR.k.24.3 | 7005 | 8 | 2 | 0 | 0 | 0 | 0 | 0 | 0 |
| 963 | RTA00000181AR.k.24.2 | 7005 | 8 | 2 | 0 | 0 | 0 | 0 | 0 | 0 |
| 968 | RTA00000199AR.m.06.1 | 19122 | 3 | 0 | 0 | 0 | 0 | 0 | 0 | 0 |
| 973 | RTA00000134A.d.10.1 | 18957 | 3 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 981 | RTA00000181AF.m.4.3 | 13238 | 4 | 1 | 0 | 0 | 0 | 0 | 0 | 0 |
| 985 | RTA00000196AF.c.6.1 | 23148 | 3 | 0 | 0 | 0 | 0 | 0 | 0 | 0 |
| 986 | RTA00000198AF.k.19.1 | 75879 | 1 | 0 | 0 | 0 | 0 | 0 | 0 | 0 |
| 987 | RTA00000199R.h.09.1 | 76020 | 1 | 0 | 0 | 0 | 0 | 0 | 0 | 0 |
| 988 | RTA00000198AF.o.18.1 | 13018 | 4 | 0 | 0 | 0 | 1 | 0 | 0 | 0 |
| 992 | RTA00000199F.h.17.2 | 36254 | 2 | 0 | 0 | 0 | 0 | 0 | 0 | 0 |
| 993 | RTA00000181AR.h.06.3 | 87226 | 1 | 0 | 0 | 0 | 0 | 0 | 0 | 0 |
| 1010 | RTA00000198AF.f.21.1 | 22676 | 3 | 0 | 0 | 0 | 0 | 0 | 0 | 0 |
| 1017 | RTA00000200AR.b.07.1 | 17125 | 4 | 0 | 0 | 0 | 0 | 0 | 0 | 0 |
| 1022 | RTA00000200F.o.03.1 | 22807 | 3 | 0 | 0 | 0 | 0 | 0 | 0 | 0 |
| 1024 | RTA00000199AF.j.12.1 | 22461 | 3 | 0 | 0 | 0 | 0 | 0 | 0 | 0 |
| 1029 | RTA00000195AF.d.4.1 | 22766 | 3 | 0 | 0 | 0 | 0 | 0 | 0 | 0 |
| 1038 | RTA00000200R.k.01.1 | 40049 | 2 | 0 | 0 | 0 | 0 | 0 | 0 | 0 |
| 1039 | RTA00000198AF.c.10.1 | 77149 | 1 | 0 | 0 | 0 | 0 | 0 | 0 | 0 |
| 1042 | RTA00000197AR.e.07.1 | 86969 | 1 | 0 | 0 | 0 | 0 | 0 | 0 | 0 |
| 1043 | RTA00000199R.c.09.1 | 16824 | 3 | 1 | 0 | 0 | 0 | 0 | 0 | 0 |
| 1050 | RTA00000181AF.o.04.2 | 22205 | 3 | 0 | 0 | 0 | 0 | 0 | 0 | 0 |
| 1051 | RTA00000199AF.l.19.1 | 22460 | 3 | 0 | 0 | 0 | 0 | 0 | 0 | 0 |
| 1052 | RTA00000198AF.h.22.1 | 22366 | 2 | 1 | 0 | 0 | 0 | 0 | 0 | 0 |
| 1055 | RTA00000199AF.m.15.1 | 10101 | 3 | 0 | 0 | 0 | 0 | 0 | 0 | 0 |
| 1056 | RTA00000197AF.j.9.1 | 13236 | 4 | 1 | 0 | 0 | 0 | 0 | 0 | 0 |
| 1074 | RTA00000185AR.b.18.1 | 12171 | 3 | 2 | 0 | 0 | 0 | 0 | 0 | 0 |
| 1079 | RTA00000201AF.a.02.1 | 35362 | 2 | 0 | 0 | 0 | 0 | 0 | 0 | 0 |
| 1080 | RTA00000183AR.h.23.1 | 18957 | 3 | 0 | 0 | 0 | 0 | 0 | 0 | 0 |
| 1082 | RTA00000187AR.k.12.1 | 78415 | 1 | 0 | 0 | 0 | 0 | 0 | 0 | 0 |
| 1086 | RTA00000198AF.m.17.1 | 77992 | 1 | 0 | 0 | 0 | 0 | 0 | 0 | 0 |
| 1087 | RTA00000181AF.m.15.3 | 12081 | 4 | 0 | 0 | 0 | 0 | 0 | 0 | 0 |
| 1092 | RTA00000198R.c.14.1 | 39814 | 2 | 0 | 0 | 0 | 0 | 0 | 0 | 0 |
| 1093 | RTA00000200R.o.03.2 | 22807 | 3 | 0 | 0 | 0 | 0 | 0 | 0 | 0 |
| 1095 | RTA00000192AF.n.13.1 | 8210 | 2 | 6 | 0 | 0 | 0 | 0 | 0 | 0 |
| 1100 | RTA00000184AR.e.15.1 | 16347 | 4 | 0 | 0 | 0 | 0 | 0 | 0 | 0 |
| 1104 | RTA00000198R.m.17.1 | 77992 | 1 | 0 | 0 | 0 | 0 | 0 | 0 | 0 |
| 1114 | RTA00000178R.l.08.1 | 39648 | 2 | 0 | 0 | 0 | 0 | 0 | 0 | 0 |
| 1122 | RTA00000198AF.p.16.1 | 71877 | 1 | 0 | 0 | 0 | 0 | 0 | 0 | 0 |
| 1124 | RTA00000193AF.b.18.1 | 7542 | 8 | 0 | 0 | 2 | 1 | 0 | 1 | 0 |
| 1128 | RTA00000199F.d.10.2 | 22049 | 3 | 0 | 0 | 0 | 0 | 0 | 0 | 0 |
| 1131 | RTA00000200AF.b.07.1 | 17125 | 4 | 0 | 0 | 0 | 0 | 0 | 0 | 0 |
| 1132 | RTA00000181AR.i.06.3 | 19119 | 3 | 0 | 0 | 0 | 0 | 0 | 0 | 0 |
| 1133 | RTA00000196F.k.07.1 | 22443 | 2 | 0 | 0 | 0 | 0 | 0 | 0 | 1 |
| 1138 | RTA00000198AF.k.23.1 | 8995 | 2 | 5 | 0 | 0 | 0 | 0 | 0 | 0 |
| 1140 | RTA00000196AF.f.20.1 | 22774 | 3 | 0 | 0 | 0 | 0 | 0 | 0 | 0 |
| 1144 | RTA00000195AF.c.12.1 | 37582 | 2 | 0 | 0 | 0 | 0 | 0 | 0 | 0 |
| 1146 | RTA00000186AF.d.l.2 | 40044 | 2 | 0 | 0 | 1 | 0 | 0 | 0 | 0 |
| 1151 | RTA00000200F.n.05.2 | 18989 | 3 | 0 | 0 | 0 | 0 | 0 | 0 | 0 |
| 1152 | RTA00000178AF.j.20.1 | 15066 | 4 | 0 | 0 | 0 | 0 | 0 | 0 | 0 |
| 1154 | RTA00000188AF.m.08.1 | 22155 | 3 | 0 | 0 | 0 | 0 | 0 | 0 | 0 |
| 1159 | RTA00000199R.d.23.1 | 37477 | 2 | 0 | 0 | 0 | 0 | 0 | 0 | 0 |
| 1163 | RTA00000200F.n.05.1 | 18989 | 3 | 0 | 0 | 0 | 0 | 0 | 0 | 0 |
| 1164 | RTA00000196AF.m.13.1 | 16290 | 4 | 0 | 0 | 0 | 0 | 0 | 0 | 0 |
| 1169 | RTA00000182AF.d.18.4 | 37435 | 2 | 0 | 0 | 0 | 0 | 0 | 0 | 0 |
| 1172 | RTA00000200AF.g.09.1 | 22785 | 3 | 0 | 0 | 0 | 0 | 0 | 0 | 0 |
| 1174 | RTA00000177AR.m.17.4 | 14391 | 3 | 1 | 0 | 0 | 0 | 0 | 0 | 0 |
| 1175 | RTA00000197AR.c.20.1 | 16282 | 4 | 0 | 0 | 0 | 0 | 0 | 0 | 0 |
| 1181 | RTA00000177AR.m.17.3 | 14391 | 3 | 1 | 0 | 0 | 0 | 0 | 0 | 0 |
| 1186 | RTA00000196AF.d.10.1 | 22256 | 3 | 0 | 0 | 0 | 0 | 0 | 0 | 0 |
| 1187 | RTA00000201F.a.18.1 | 16837 | 2 | 2 | 0 | 0 | 0 | 0 | 0 | 0 |
| 1188 | RTA00000198AF.o.02.1 | 68756 | 1 | 0 | 0 | 0 | 0 | 0 | 0 | 0 |
| 1189 | RTA00000187AF.h.21.1 | 39171 | 2 | 0 | 0 | 0 | 0 | 0 | 0 | 0 |
| 1191 | RTA00000199F.b.03.2 | 38340 | 2 | 0 | 0 | 0 | 0 | 0 | 0 | 0 |
| 1202 | RTA00000198AF.g.7.1 | 13386 | 3 | 2 | 0 | 0 | 0 | 0 | 0 | 0 |
| 1206 | RTA00000197AR.c.24.1 | 82498 | 1 | 0 | 0 | 0 | 0 | 0 | 0 | 0 |
| 1215 | RTA00000197F.e.7.1 | 86969 | 1 | 0 | 0 | 0 | 0 | 0 | 0 | 0 |
| 1222 | RTA00000181AF.k.24.3 | 7005 | 8 | 2 | 0 | 0 | 0 | 0 | 0 | 0 |
| 1226 | RTA00000200AF.j.6.1 | 22902 | 3 | 0 | 0 | 0 | 0 | 0 | 0 | 0 |
| 1228 | RTA00000196AF.h.17.1 | 39215 | 2 | 0 | 0 | 0 | 0 | 0 | 0 | 0 |
| 1236 | RTA00000185AF.b.11.2 | 9024 | 5 | 2 | 0 | 0 | 0 | 0 | 0 | 0 |
| 1241 | RTA00000198AF.b.22.1 | 38956 | 2 | 0 | 0 | 0 | 0 | 0 | 0 | 0 |
| 1243 | RTA00000186AF.m.15.2 | 40122 | 2 | 0 | 0 | 0 | 0 | 0 | 0 | 0 |
| 1250 | RTA00000199F.f.09.2 | 22907 | 3 | 0 | 0 | 0 | 0 | 0 | 0 | 0 |
| 1252 | RTA00000183AR.l.15.1 | 39383 | 2 | 0 | 0 | 0 | 0 | 0 | 0 | 0 |
| 1257 | RTA00000200F.a.12.1 | 16751 | 4 | 0 | 0 | 0 | 0 | 0 | 0 | 0 |
| 1260 | RTA00000199F.a.5.1 | 22134 | 3 | 0 | 0 | 0 | 0 | 0 | 0 | 0 |
| 1262 | RTA00000187AR.k.01.1 | 78356 | 1 | 0 | 0 | 0 | 0 | 0 | 0 | 0 |
| 1268 | RTA00000187AR.j.24.1 | 78356 | 1 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1270 | RTA00000199AF.o.19.1 | 36927 | 2 | 0 | 0 | 0 | 0 | 0 | 0 | 0 |
| 1273 | RTA00000196F.i.19.1 | 39498 | 2 | 0 | 0 | 0 | 0 | 0 | 0 | 0 |
| 1274 | RTA00000198R.k.23.1 | 8995 | 2 | 5 | 0 | 0 | 0 | 0 | 0 | 0 |
| 1276 | RTA00000198AF.o.05.1 | 26702 | 2 | 0 | 0 | 0 | 0 | 0 | 0 | 0 |
| 1277 | RTA00000198R.j.18.1 | 22759 | 3 | 0 | 0 | 0 | 0 | 0 | 0 | 0 |
| 1279 | RTA00000182AR.c.22.1 | 16283 | 3 | 0 | 0 | 0 | 0 | 0 | 0 | 0 |
| 1282 | RTA00000180AR.g.03.4 | 9024 | 5 | 2 | 0 | 0 | 0 | 0 | 0 | 0 |
| 1295 | RTA00000200AF.b.20.1 | 40403 | 2 | 0 | 0 | 0 | 0 | 0 | 0 | 0 |
| 1299 | RTA00000198AF.d.12.1 | 21142 | 2 | 1 | 0 | 0 | 0 | 0 | 0 | 0 |
| 1300 | RTA00000200AF.b.12.1 | 22053 | 3 | 0 | 0 | 0 | 0 | 0 | 0 | 0 |
| 1301 | RTA00000191AR.l.7.2 | 14391 | 3 | 1 | 0 | 0 | 0 | 0 | 0 | 0 |
| 1305 | RTA00000190AF.e.13.1 | 38961 | 2 | 0 | 0 | 0 | 0 | 0 | 0 | 0 |
| 1306 | RTA00000196AF.n.17.1 | 12477 | 4 | 1 | 0 | 0 | 0 | 0 | 0 | 0 |
| 1311 | RTA00000195AF.b.19.1 | 77678 | 1 | 0 | 0 | 0 | 0 | 0 | 0 | 0 |
| 1319 | RTA00000187AR.m.3.3 | 17055 | 4 | 0 | 0 | 0 | 0 | 0 | 0 | 0 |
| 1320 | RTA00000200R.g.15.1 | 22898 | 3 | 0 | 0 | 0 | 0 | 0 | 0 | 0 |
| 1326 | RTA00000187AF.j.7.1 | 78091 | 1 | 0 | 0 | 0 | 0 | 0 | 0 | 0 |
| 1329 | RTA00000196AF.c.14.1 | 23105 | 3 | 0 | 0 | 0 | 0 | 0 | 0 | 0 |
| 1330 | RTA00000190AR.p.22.2 | 16368 | 4 | 0 | 0 | 0 | 0 | 0 | 0 | 0 |
| 1336 | RTA00000198AF.b.8.1 | 22636 | 3 | 0 | 0 | 0 | 0 | 0 | 0 | 0 |
| 1337 | RTA00000177AF.m.17.1 | 14391 | 3 | 1 | 0 | 0 | 0 | 0 | 0 | 0 |
| 1338 | RTA00000200AF.k.1.1 | 40049 | 2 | 0 | 0 | 0 | 0 | 0 | 0 | 0 |
| 1342 | RTA00000190AF.h.12.1 | 12977 | 5 | 0 | 0 | 0 | 0 | 0 | 0 | 0 |
| 1343 | RTA00000199F.b.22.2 | 17018 | 4 | 0 | 0 | 0 | 0 | 0 | 0 | 0 |
| 1352 | RTA00000187AF.i.14.2 | 19406 | 2 | 1 | 0 | 0 | 0 | 0 | 0 | 0 |
| 1355 | RTA00000196AF.g.10.1 | 12498 | 3 | 1 | 1 | 0 | 0 | 0 | 0 | 0 |
| 1361 | RTA00000184AF.e.14.1 | 16347 | 4 | 0 | 0 | 0 | 0 | 0 | 0 | 0 |
| 1366 | RTA00000178AR.h.17.2 | 23824 | 2 | 1 | 0 | 0 | 0 | 0 | 0 | 0 |
| 1375 | RTA00000195F.a.3.1 | 27179 | 2 | 0 | 0 | 0 | 0 | 0 | 0 | 0 |
| 1388 | RTA00000196F.j.13.1 | 23170 | 3 | 0 | 0 | 0 | 0 | 0 | 0 | 0 |
| 1391 | RTA00000196AF.g.8.1 | 39665 | 2 | 0 | 0 | 0 | 0 | 0 | 0 | 0 |
| 1393 | RTA00000198AF.c.16.1 | 26801 | 2 | 0 | 0 | 0 | 0 | 0 | 0 | 0 |
| 1397 | RTA00000201F.b.22.1 | 35728 | 2 | 0 | 0 | 0 | 0 | 0 | 0 | 1 |
| 1403 | RTA00000197AF.p.20.1 | 22795 | 3 | 0 | 0 | 0 | 0 | 0 | 0 | 0 |
| 1407 | RTA00000192AR.o.16.2 | 9061 | 5 | 2 | 0 | 0 | 0 | 0 | 0 | 0 |
| 1409 | RTA00000191AF.c.10.1 | 40422 | 2 | 0 | 0 | 0 | 0 | 0 | 0 | 0 |
| 1412 | RTA00000196AF.p.01.2 | 87143 | 1 | 0 | 0 | 0 | 0 | 0 | 0 | 0 |
| 1422 | RTA00000180AF.g.17.1 | 16653 | 3 | 1 | 0 | 0 | 0 | 0 | 0 | 0 |
| 1427 | RTA00000190AR.h.12.2 | 12977 | 5 | 0 | 0 | 0 | 0 | 0 | 0 | 0 |
| 1429 | RTA00000198AF.n.18.1 | 16715 | 3 | 1 | 0 | 0 | 0 | 0 | 0 | 0 |
| 1430 | RTA00000199R.o.11.1 | 23172 | 3 | 0 | 0 | 0 | 0 | 0 | 0 | 0 |
| 1432 | RTA00000191AF.b.4.1 | 14936 | 3 | 0 | 0 | 0 | 0 | 0 | 0 | 0 |
| 1433 | RTA00000192AF.l.1.1 | 16392 | 3 | 0 | 0 | 0 | 0 | 0 | 0 | 0 |
| 1437 | RTA00000196R.c.14.2 | 23105 | 3 | 0 | 0 | 0 | 0 | 0 | 0 | 0 |
| 1439 | RTA00000195R.a.06.1 | 35265 | 2 | 0 | 1 | 0 | 0 | 0 | 0 | 0 |
| 1446 | RTA00000195AF.b.21.1 | 39055 | 2 | 0 | 0 | 0 | 0 | 0 | 0 | 0 |
| 1456 | RTA00000197AR.e.22.1 | 78758 | 1 | 0 | 0 | 0 | 0 | 0 | 0 | 0 |
| 1459 | RTA00000197R.p.20.1 | 22795 | 3 | 0 | 0 | 0 | 0 | 0 | 0 | 0 |
| 1462 | RTA00000192AF.a.14.1 | 6874 | 6 | 3 | 0 | 0 | 1 | 0 | 0 | 0 |
| 1467 | RTA00000198R.b.24.1 | 19047 | 3 | 0 | 0 | 0 | 0 | 0 | 0 | 0 |
| 1471 | RTA00000199F.h.15.2 | 22269 | 3 | 0 | 0 | 0 | 0 | 0 | 0 | 0 |
| 1472 | RTA00000198AF.g.16.1 | 6602 | 1 | 1 | 0 | 0 | 0 | 0 | 0 | 0 |
| 1478 | RTA00000192AF.j.6.1 | 11494 | 4 | 0 | 0 | 0 | 0 | 0 | 0 | 0 |
| 1479 | RTA00000181AF.p.7.3 | 38773 | 2 | 0 | 0 | 0 | 0 | 0 | 0 | 0 |
| 1481 | RTA00000200AF.g.15.1 | 22898 | 3 | 0 | 0 | 0 | 0 | 0 | 0 | 0 |
| 1487 | RTA00000184AF.c.9.1 | 16245 | 4 | 0 | 0 | 0 | 0 | 0 | 0 | 0 |
| 1489 | RTA00000177AF.k.9.1 | 16245 | 4 | 0 | 0 | 0 | 0 | 0 | 0 | 0 |
| 1493 | RTA00000190AR.l.19.2 | 88204 | 1 | 0 | 0 | 0 | 0 | 0 | 0 | 0 |
| 1506 | RTA00000201R.a.15.1 | 57347 | 1 | 0 | 0 | 0 | 0 | 0 | 0 | 0 |
| 1508 | RTA00000195R.a.23.1 | 86432 | 1 | 0 | 0 | 0 | 0 | 0 | 0 | 0 |
| 1514 | RTA00000186AF.p.17.3 | 38383 | 2 | 0 | 0 | 0 | 0 | 0 | 0 | 0 |
| 1518 | RTA00000197AR.e.24.1 | 39250 | 2 | 0 | 0 | 0 | 0 | 0 | 0 | 0 |
| 1527 | RTA00000187AR.j.01.1 | 79028 | 1 | 0 | 0 | 0 | 0 | 0 | 0 | 0 |
| 1530 | RTA00000201F.f.07.1 | 51116 | 1 | 0 | 0 | 0 | 0 | 0 | 0 | 0 |
| 1538 | RTA00000201R.c.19.1 | 22357 | 2 | 1 | 0 | 0 | 0 | 0 | 0 | 0 |
| 1546 | RTA00000177AR.b.8.5 | 17062 | 3 | 0 | 0 | 0 | 0 | 0 | 0 | 0 |
| 1556 | RTA00000201F.b.21.1 | 9071 | 3 | 4 | 0 | 0 | 0 | 0 | 0 | 0 |
| 1561 | RTA00000200F.o.10.2 | 36432 | 2 | 0 | 0 | 0 | 0 | 0 | 0 | 0 |
| 1562 | RTA00000196F.l.14.2 | 23144 | 3 | 0 | 0 | 0 | 0 | 0 | 0 | 0 |
| 1569 | RTA00000197AF.b.1.1 | 12134 | 1 | 1 | 0 | 0 | 0 | 0 | 0 | 0 |
| 1577 | RTA00000200AF.d.20.1 | 26600 | 2 | 0 | 0 | 0 | 0 | 0 | 0 | 0 |
| 1587 | RTA00000178AF.k.9.1 | 16342 | 3 | 0 | 0 | 0 | 0 | 0 | 0 | 0 |
| 1592 | RTA00000198AF.b.24.1 | 19047 | 3 | 0 | 0 | 0 | 0 | 0 | 0 | 0 |
| 1601 | RTA00000406F.d.16.1 | 15040 | 2 | 2 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1604 | RTA00000408F.o.12.2 | 78578 | 1 | 0 | 0 | 0 | 0 | 0 | 0 | 0 |
| 1605 | RTA00000119A.j.15.1 | 79623 | 1 | 0 | 0 | 0 | 0 | 0 | 0 | 0 |
| 1606 | RTA00000413F.d.12.1 | 66467 | 1 | 0 | 0 | 0 | 0 | 0 | 0 | 0 |
| 1607 | RTA00000423F.i.12.1 | 9118 | 4 | 3 | 0 | 0 | 0 | 0 | 0 | 0 |
| 1610 | RTA00000411F.k.05.1 | 64777 | 1 | 0 | 0 | 0 | 0 | 0 | 0 | 0 |
| 1613 | RTA00000419F.b.09.1 | 78128 | 1 | 0 | 0 | 0 | 0 | 0 | 0 | 0 |
| 1616 | RTA00000411F.m.15.1 | 78014 | 1 | 0 | 0 | 0 | 0 | 0 | 0 | 0 |
| 1618 | RTA00000123A.k.23.1 | 80313 | 1 | 0 | 0 | 0 | 0 | 0 | 0 | 0 |
| 1621 | RTA00000130A.m.15.1 | 81630 | 1 | 0 | 0 | 0 | 0 | 0 | 0 | 0 |
| 1622 | RTA00000411F.k.20.1 | 64973 | 1 | 0 | 0 | 0 | 0 | 0 | 0 | 0 |
| 1624 | RTA00000418F.k.05.1 | 73021 | 1 | 0 | 0 | 0 | 0 | 0 | 0 | 0 |
| 1625 | RTA00000423F.h.18.1 | 37972 | 2 | 0 | 0 | 0 | 0 | 0 | 0 | 0 |
| 1627 | RTA00000422F.p.06.2 | 39282 | 2 | 0 | 0 | 0 | 0 | 0 | 0 | 0 |
| 1628 | RTA00000404F.n.16.2 | 39095 | 2 | 0 | 0 | 0 | 0 | 0 | 0 | 0 |
| 1629 | RTA00000411F.m.24.1 | 77568 | 1 | 0 | 0 | 0 | 0 | 0 | 0 | 0 |
| 1630 | RTA00000134A.j.10.1 | 81383 | 1 | 0 | 0 | 0 | 0 | 0 | 0 | 0 |
| 1631 | RTA00000409F.j.02.1 | 76417 | 1 | 0 | 0 | 0 | 0 | 0 | 0 | 0 |
| 1632 | RTA00000403F.j.15.1 | 23840 | 2 | 1 | 0 | 0 | 0 | 0 | 0 | 0 |
| 1633 | RTA00000411F.n.11.1 | 77276 | 1 | 0 | 0 | 0 | 0 | 0 | 0 | 0 |
| 1634 | RTA00000339F.i.13.1 | 5970 | 6 | 4 | 0 | 0 | 0 | 0 | 0 | 0 |
| 1636 | RTA00000406F.o.15.1 | 37482 | 2 | 0 | 0 | 0 | 0 | 0 | 0 | 0 |
| 1637 | RTA00000412F.g.04.2 | 64457 | 1 | 0 | 0 | 0 | 0 | 0 | 0 | 0 |
| 1639 | RTA00000352R.l.06.1 | 40343 | 2 | 0 | 0 | 0 | 0 | 0 | 0 | 0 |
| 1640 | RTA00000419F.b.12.1 | 63148 | 1 | 0 | 0 | 0 | 0 | 0 | 0 | 0 |
| 1641 | RTA00000423F.k.17.2 | 37512 | 2 | 0 | 0 | 0 | 0 | 0 | 0 | 0 |
| 1643 | RTA00000418F.k.14.1 | 76133 | 1 | 0 | 0 | 0 | 0 | 1 | 0 | 0 |
| 1644 | RTA00000409F.l.12.1 | 26755 | 1 | 0 | 0 | 0 | 0 | 0 | 0 | 0 |
| 1645 | RTA00000404F.c.20.1 | 39088 | 2 | 0 | 0 | 0 | 0 | 0 | 1 | 0 |
| 1646 | RTA00000423F.g.09.1 | 38958 | 2 | 0 | 0 | 0 | 0 | 0 | 0 | 0 |
| 1648 | RTA00000406F.d.12.1 | 38575 | 2 | 0 | 0 | 0 | 0 | 0 | 0 | 0 |
| 1649 | RTA00000411F.f.02.1 | 63386 | 1 | 0 | 0 | 0 | 0 | 0 | 0 | 0 |
| 1650 | RTA00000129A.n.21.1 | 79381 | 1 | 0 | 0 | 0 | 0 | 0 | 0 | 0 |
| 1651 | RTA00000409F.m.12.1 | 73490 | 1 | 0 | 0 | 0 | 0 | 0 | 0 | 0 |
| 1652 | RTA00000410F.c.04.1 | 74099 | 1 | 0 | 0 | 0 | 0 | 0 | 0 | 0 |
| 1654 | RTA00000406F.m.09.1 | 26891 | 2 | 0 | 0 | 0 | 0 | 0 | 0 | 0 |
| 1655 | RTA00000411F.b.06.1 | 77884 | 1 | 0 | 0 | 0 | 0 | 0 | 0 | 0 |
| 1656 | RTA00000409F.l.21.1 | 73143 | 1 | 0 | 0 | 0 | 0 | 0 | 0 | 0 |
| 1662 | RTA00000404F.l.20.2 | 38638 | 2 | 0 | 0 | 0 | 0 | 0 | 0 | 0 |
| 1663 | RTA00000413F.d.18.1 | 65305 | 1 | 0 | 0 | 0 | 0 | 0 | 0 | 0 |
| 1664 | RTA00000404F.p.04.2 | 39069 | 2 | 0 | 0 | 0 | 0 | 0 | 0 | 0 |
| 1665 | RTA00000405F.g.19.2 | 37150 | 2 | 0 | 0 | 0 | 0 | 0 | 0 | 0 |
| 1666 | RTA00000409F.a.22.1 | 75200 | 1 | 0 | 0 | 0 | 0 | 0 | 0 | 0 |
| 1668 | RTA00000405F.o.18.1 | 11016 | 4 | 2 | 0 | 0 | 0 | 0 | 0 | 0 |
| 1673 | RTA00000408F.e.22.2 | 26930 | 1 | 0 | 0 | 0 | 0 | 0 | 0 | 0 |
| 1675 | RTA00000413F.d.16.1 | 63331 | 1 | 0 | 0 | 0 | 0 | 0 | 0 | 0 |
| 1678 | RTA00000419F.g.08.1 | 66700 | 1 | 0 | 0 | 0 | 0 | 0 | 0 | 0 |
| 1679 | RTA00000122A.g.16.1 | 81366 | 1 | 0 | 0 | 0 | 0 | 0 | 0 | 0 |
| 1680 | RTA00000419F.c.16.1 | 65254 | 1 | 0 | 0 | 0 | 0 | 0 | 0 | 0 |
| 1681 | RTA00000411F.b.03.1 | 23634 | 1 | 2 | 0 | 0 | 0 | 0 | 0 | 0 |
| 1686 | RTA00000403F.l.20.1 | 18267 | 1 | 0 | 0 | 0 | 0 | 0 | 0 | 0 |
| 1689 | RTA00000411F.a.02.1 | 78537 | 1 | 0 | 0 | 0 | 0 | 0 | 0 | 0 |
| 1691 | RTA00000412F.l.04.1 | 66372 | 1 | 0 | 0 | 0 | 0 | 0 | 0 | 0 |
| 1693 | RTA00000406F.a.23.1 | 38712 | 2 | 0 | 0 | 0 | 0 | 0 | 0 | 0 |
| 1695 | RTA00000120A.n.19.3 | 80004 | 1 | 0 | 0 | 0 | 0 | 0 | 0 | 0 |
| 1696 | RTA00000403F.e.01.1 | 38965 | 2 | 0 | 0 | 0 | 0 | 0 | 0 | 0 |
| 1697 | RTA00000411F.l.03.1 | 62702 | 1 | 0 | 0 | 0 | 0 | 0 | 0 | 0 |
| 1700 | RTA00000121A.m.2.1 | 81064 | 1 | 0 | 0 | 0 | 0 | 0 | 0 | 0 |
| 1702 | RTA00000418F.j.12.1 | 73316 | 1 | 0 | 0 | 0 | 0 | 0 | 0 | 0 |
| 1706 | RTA00000125A.g.16.1 | 21497 | 2 | 1 | 0 | 0 | 0 | 0 | 0 | 0 |
| 1707 | RTA00000418F.o.18.1 | 78676 | 1 | 0 | 0 | 0 | 0 | 0 | 0 | 0 |
| 1709 | RTA00000408F.k.14.1 | 73856 | 1 | 0 | 0 | 0 | 0 | 0 | 0 | 0 |
| 1715 | RTA00000403F.o.15.1 | 39140 | 2 | 0 | 0 | 0 | 0 | 0 | 0 | 0 |
| 1716 | RTA00000341F.m.13.1 | 26502 | 1 | 0 | 0 | 0 | 0 | 0 | 0 | 0 |
| 1717 | RTA00000408F.h.03.1 | 78382 | 1 | 0 | 0 | 0 | 0 | 0 | 0 | 0 |
| 1718 | RTA00000423F.k.05.1 | 37472 | 2 | 0 | 0 | 0 | 0 | 0 | 0 | 0 |
| 1720 | RTA00000418F.p.19.1 | 78544 | 1 | 0 | 0 | 0 | 0 | 0 | 0 | 0 |
| 1721 | RTA00000420F.f.06.1 | 64812 | 1 | 0 | 0 | 0 | 0 | 0 | 0 | 0 |
| 1722 | RTA00000122A.j.18.1 | 81317 | 1 | 0 | 0 | 0 | 0 | 0 | 0 | 0 |
| 1723 | RTA00000420F.d.05.1 | 64432 | 1 | 0 | 0 | 0 | 0 | 0 | 0 | 0 |
| 1724 | RTA00000403F.m.18.1 | 39185 | 2 | 0 | 0 | 0 | 0 | 0 | 0 | 0 |
| 1726 | RTA00000411F.j.05.1 | 40709 | 1 | 1 | 0 | 0 | 0 | 0 | 0 | 0 |
| 1727 | RTA00000403F.a.04.1 | 23529 | 2 | 1 | 0 | 0 | 0 | 0 | 0 | 0 |
| 1729 | RTA00000406F.f.12.1 | 21895 | 2 | 1 | 0 | 0 | 0 | 0 | 0 | 0 |
| 1730 | RTA00000418F.g.22.1 | 74837 | 1 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1732 | RTA00000404F.l.20.1 | 38638 | 2 | 0 | 0 | 0 | 0 | 0 | 0 | 0 |
| 1733 | RTA00000408F.i.08.2 | 75811 | 1 | 0 | 0 | 0 | 0 | 0 | 0 | 0 |
| 1734 | RTA00000122A.d.5.1 | 81155 | 1 | 0 | 0 | 0 | 0 | 0 | 0 | 0 |
| 1738 | RTA00000419F.b.19.1 | 65534 | 1 | 0 | 0 | 0 | 0 | 0 | 0 | 0 |
| 1740 | RTA00000418F.k.19.1 | 74932 | 1 | 0 | 0 | 0 | 0 | 0 | 0 | 0 |
| 1744 | RTA00000419F.g.12.1 | 66171 | 1 | 0 | 0 | 0 | 0 | 0 | 0 | 0 |
| 1745 | RTA00000404F.n.11.2 | 38001 | 2 | 0 | 0 | 0 | 0 | 0 | 0 | 0 |
| 1748 | RTA00000419F.o.24.1 | 65092 | 1 | 0 | 0 | 0 | 0 | 0 | 0 | 0 |
| 1749 | RTA00000419F.k.19.1 | 75447 | 1 | 0 | 0 | 0 | 0 | 0 | 0 | 0 |
| 1751 | RTA00000127A.i.20.1 | 81418 | 1 | 0 | 0 | 0 | 0 | 0 | 0 | 0 |
| 1752 | RTA00000422F.g.22.1 | 22561 | 3 | 0 | 0 | 0 | 0 | 0 | 0 | 0 |
| 1754 | RTA00000413F.h.13.1 | 65190 | 1 | 0 | 0 | 0 | 0 | 0 | 0 | 0 |
| 1757 | RTA00000348R.j.16.1 | 7005 | 8 | 2 | 0 | 0 | 0 | 0 | 0 | 0 |
| 1760 | RTA00000418F.n.22.1 | 79062 | 1 | 0 | 0 | 0 | 0 | 0 | 0 | 0 |
| 1761 | RTA00000406F.l.08.1 | 39016 | 2 | 0 | 0 | 0 | 0 | 0 | 0 | 0 |
| 1764 | RTA00000409F.j.07.1 | 75190 | 1 | 0 | 0 | 0 | 0 | 0 | 0 | 0 |
| 1767 | RTA00000411F.e.22.1 | 63638 | 1 | 0 | 0 | 0 | 0 | 0 | 0 | 0 |
| 1768 | RTA00000347F.a.17.1 | 16723 | 3 | 1 | 0 | 0 | 0 | 0 | 0 | 0 |
| 1770 | RTA00000404F.n.20.1 | 26865 | 2 | 0 | 0 | 0 | 0 | 0 | 0 | 0 |
| 1773 | RTA00000404F.b.02.1 | 38984 | 2 | 0 | 0 | 0 | 0 | 0 | 0 | 0 |
| 1775 | RTA00000403F.b.10.1 | 73268 | 1 | 0 | 0 | 0 | 0 | 0 | 0 | 0 |
| 1776 | RTA00000406F.i.12.1 | 39080 | 2 | 0 | 0 | 0 | 0 | 0 | 0 | 0 |
| 1777 | RTA00000406F.h.08.1 | 16228 | 2 | 2 | 0 | 0 | 0 | 0 | 0 | 0 |
| 1778 | RTA00000418F.i.19.1 | 79180 | 1 | 0 | 0 | 0 | 0 | 0 | 0 | 0 |
| 1780 | RTA00000412F.h.21.1 | 64348 | 1 | 0 | 0 | 0 | 0 | 0 | 0 | 0 |
| 1782 | RTA00000120A.g.18.1 | 81255 | 1 | 0 | 0 | 0 | 0 | 0 | 0 | 0 |
| 1784 | RTA00000423F.j.05.1 | 37958 | 2 | 0 | 0 | 0 | 0 | 0 | 0 | 0 |
| 1785 | RTA00000132A.k.6.1 | 81284 | 1 | 0 | 0 | 0 | 0 | 0 | 0 | 0 |
| 1787 | RTA00000406F.p.04.1 | 37458 | 2 | 0 | 0 | 0 | 0 | 0 | 0 | 0 |
| 1788 | RTA00000347F.a.13.1 | 22446 | 3 | 0 | 0 | 0 | 0 | 0 | 0 | 0 |
| 1789 | RTA00000419F.p.23.1 | 64748 | 1 | 0 | 0 | 0 | 0 | 0 | 0 | 0 |
| 1790 | RTA00000419F.d.17.1 | 64353 | 1 | 0 | 0 | 0 | 0 | 0 | 0 | 0 |
| 1793 | RTA00000124A.k.5.1 | 80252 | 1 | 0 | 0 | 0 | 0 | 0 | 0 | 0 |
| 1794 | RTA00000404F.h.22.1 | 18735 | 2 | 1 | 0 | 0 | 0 | 0 | 1 | 0 |
| 1796 | RTA00000410F.o.05.1 | 75262 | 1 | 0 | 0 | 0 | 0 | 0 | 0 | 0 |
| 1797 | RTA00000339R.l.14.1 | 19119 | 3 | 0 | 0 | 0 | 0 | 0 | 0 | 0 |
| 1798 | RTA00000403F.m.13.2 | 39077 | 2 | 0 | 0 | 0 | 0 | 0 | 0 | 0 |
| 1801 | RTA00000419F.g.22.1 | 64515 | 1 | 0 | 0 | 0 | 0 | 0 | 0 | 0 |
| 1802 | RTA00000404F.g.21.1 | 37947 | 2 | 0 | 0 | 0 | 0 | 0 | 0 | 0 |
| 1804 | RTA00000138A.n.4.1 | 21920 | 2 | 1 | 0 | 0 | 0 | 0 | 0 | 0 |
| 1805 | RTA00000410F.b.15.1 | 77100 | 1 | 0 | 0 | 0 | 0 | 0 | 0 | 0 |
| 1807 | RTA00000419F.j.23.1 | 74470 | 1 | 0 | 0 | 0 | 0 | 0 | 0 | 0 |
| 1808 | RTA00000411F.j.02.1 | 65310 | 1 | 0 | 0 | 0 | 0 | 0 | 0 | 0 |
| 1809 | RTA00000419F.p.24.1 | 63477 | 1 | 0 | 0 | 0 | 0 | 0 | 0 | 0 |
| 1810 | RTA00000404F.a.19.1 | 38624 | 2 | 0 | 0 | 0 | 0 | 0 | 0 | 0 |
| 1817 | RTA00000346F.e.13.1 | 74653 | 1 | 0 | 0 | 0 | 0 | 0 | 0 | 0 |
| 1818 | RTA00000419F.c.18.1 | 41394 | 1 | 1 | 0 | 0 | 0 | 0 | 0 | 0 |
| 1822 | RTA00000404F.e.22.1 | 11344 | 3 | 3 | 0 | 0 | 0 | 0 | 0 | 0 |
| 1825 | RTA00000125A.k.10.1 | 81644 | 1 | 0 | 0 | 0 | 0 | 0 | 0 | 0 |
| 1826 | RTA00000347F.c.06.1 | 18846 | 2 | 1 | 0 | 0 | 0 | 0 | 0 | 0 |
| 1827 | RTA00000411F.k.19.1 | 64200 | 1 | 0 | 0 | 0 | 0 | 0 | 0 | 0 |
| 1828 | RTA00000345F.i.09.1 | 27250 | 2 | 0 | 0 | 0 | 0 | 0 | 0 | 0 |
| 1829 | RTA00000423F.k.01.1 | 40426 | 2 | 0 | 0 | 0 | 0 | 0 | 0 | 0 |
| 1830 | RTA00000408F.d.06.1 | 78997 | 1 | 0 | 0 | 0 | 0 | 0 | 0 | 0 |
| 1831 | RTA00000128A.b.20.1 | 79761 | 1 | 0 | 0 | 0 | 0 | 0 | 0 | 0 |
| 1833 | RTA00000195AF.d.4.1 | 22766 | 3 | 0 | 0 | 0 | 0 | 0 | 0 | 0 |
| 1835 | RTA00000403F.h.12.1 | 15205 | 2 | 1 | 0 | 0 | 0 | 0 | 0 | 0 |
| 1836 | RTA00000119A.j.22.1 | 80336 | 1 | 0 | 0 | 0 | 0 | 0 | 0 | 0 |
| 1839 | RTA00000126A.n.7.2 | 79557 | 1 | 0 | 0 | 1 | 0 | 0 | 0 | 0 |
| 1841 | RTA00000404F.j.08.1 | 39066 | 2 | 0 | 0 | 0 | 0 | 0 | 0 | 0 |
| 1842 | RTA00000410F.c.14.1 | 77809 | 1 | 0 | 0 | 0 | 0 | 0 | 0 | 0 |
| 1843 | RTA00000120A.g.23.1 | 81189 | 1 | 0 | 0 | 0 | 0 | 0 | 0 | 0 |
| 1844 | RTA00000195AF.d.20.1 | 37574 | 2 | 0 | 0 | 0 | 0 | 0 | 0 | 0 |
| 1846 | RTA00000412F.j.17.1 | 64071 | 1 | 0 | 0 | 0 | 0 | 0 | 0 | 0 |
| 1848 | RTA00000119A.j.10.1 | 79646 | 1 | 0 | 0 | 0 | 0 | 0 | 0 | 0 |
| 1854 | RTA00000419F.o.16.1 | 62867 | 1 | 0 | 0 | 0 | 0 | 0 | 0 | 0 |
| 1856 | RTA00000411F.c.17.1 | 77664 | 1 | 0 | 0 | 0 | 0 | 0 | 0 | 0 |
| 1857 | RTA00000406F.k.15.1 | 38549 | 2 | 0 | 0 | 0 | 0 | 0 | 0 | 0 |
| 1858 | RTA00000406F.a.02.1 | 37744 | 2 | 0 | 0 | 0 | 0 | 0 | 0 | 0 |
| 1860 | RTA00000341F.b.06.1 | 17008 | 4 | 0 | 0 | 0 | 0 | 0 | 0 | 0 |
| 1861 | RTA00000409F.n.14.1 | 78190 | 1 | 0 | 0 | 0 | 0 | 0 | 0 | 0 |
| 1863 | RTA00000345F.j.08.1 | 16731 | 3 | 1 | 0 | 0 | 0 | 0 | 0 | 0 |
| 1865 | RTA00000419F.g.15.1 | 32519 | 1 | 1 | 0 | 0 | 0 | 0 | 0 | 0 |
| 1866 | RTA00000423F.a.19.1 | 21396 | 1 | 2 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1868 | RTA00000422F.e.08.1 | 39020 | 2 | 0 | 0 | 0 | 0 | 0 | 0 | 0 |
| 1869 | RTA00000411F.d.15.1 | 74890 | 1 | 0 | 0 | 0 | 0 | 0 | 0 | 0 |
| 1871 | RTA00000411F.l.15.1 | 66704 | 1 | 0 | 0 | 0 | 0 | 0 | 0 | 0 |
| 1873 | RTA00000405F.e.08.1 | 37916 | 2 | 0 | 0 | 0 | 1 | 0 | 0 | 0 |
| 1874 | RTA00000353R.j.24.1 | 23089 | 3 | 0 | 0 | 0 | 0 | 0 | 0 | 0 |
| 1876 | RTA00000418F.o.06.1 | 75930 | 1 | 0 | 0 | 0 | 0 | 0 | 0 | 0 |
| 1877 | RTA00000404F.c.10.1 | 23534 | 2 | 1 | 0 | 0 | 0 | 0 | 0 | 0 |
| 1878 | RTA00000418F.i.21.1 | 78728 | 1 | 0 | 0 | 0 | 0 | 0 | 0 | 0 |
| 1880 | RTA00000411F.l.13.1 | 43114 | 1 | 1 | 0 | 0 | 0 | 0 | 0 | 0 |
| 1881 | RTA00000407F.a.24.1 | 37560 | 2 | 0 | 0 | 0 | 0 | 0 | 0 | 0 |
| 1882 | RTA00000346F.n.06.1 | 12439 | 4 | 0 | 0 | 0 | 0 | 0 | 0 | 0 |
| 1883 | RTA00000412F.l.21.1 | 65183 | 1 | 0 | 0 | 0 | 0 | 0 | 0 | 0 |
| 1884 | RTA00000413F.i.02.1 | 65857 | 1 | 0 | 0 | 0 | 0 | 0 | 0 | 0 |
| 1885 | RTA00000404F.i.19.1 | 38698 | 2 | 0 | 0 | 0 | 0 | 0 | 0 | 0 |
| 1887 | RTA00000403F.a.11.1 | 73109 | 1 | 0 | 0 | 0 | 0 | 0 | 0 | 0 |
| 1889 | RTA00000411F.k.16.1 | 64759 | 1 | 0 | 0 | 0 | 0 | 0 | 1 | 0 |
| 1890 | RTA00000405F.c.01.1 | 19236 | 2 | 0 | 0 | 0 | 0 | 0 | 0 | 0 |
| 1891 | RTA00000423F.i.18.1 | 14996 | 4 | 0 | 0 | 0 | 0 | 0 | 0 | 0 |
| 1894 | RTA00000406F.a.07.1 | 26607 | 2 | 0 | 0 | 0 | 0 | 0 | 0 | 0 |
| 1895 | RTA00000347F.d.06.1 | 39122 | 2 | 0 | 0 | 0 | 0 | 0 | 0 | 0 |
| 1896 | RTA00000419F.b.18.1 | 67034 | 1 | 0 | 0 | 0 | 0 | 0 | 0 | 0 |
| 1897 | RTA00000406F.h.07.1 | 38003 | 2 | 0 | 0 | 0 | 0 | 0 | 0 | 0 |
| 1898 | RTA00000405F.l.15.1 | 19575 | 2 | 1 | 0 | 0 | 0 | 0 | 0 | 0 |
| 1899 | RTA00000406F.g.17.1 | 37979 | 2 | 0 | 0 | 0 | 0 | 0 | 0 | 0 |
| 1902 | RTA00000130A.h.22.1 | 80933 | 1 | 0 | 0 | 0 | 0 | 0 | 0 | 0 |
| 1905 | RTA00000404F.d.13.1 | 39036 | 2 | 0 | 0 | 0 | 0 | 0 | 0 | 0 |
| 1908 | RTA00000340F.n.01.1 | 39081 | 2 | 0 | 0 | 0 | 0 | 0 | 0 | 0 |
| 1909 | RTA00000419F.d.06.1 | 65496 | 1 | 0 | 0 | 0 | 0 | 0 | 0 | 0 |
| 1910 | RTA00000419F.n.09.1 | 66070 | 1 | 0 | 0 | 0 | 0 | 0 | 0 | 0 |
| 1911 | RTA00000399F.i.08.1 | 38927 | 2 | 0 | 0 | 0 | 0 | 0 | 0 | 0 |
| 1913 | RTA00000423F.g.13.1 | 38028 | 2 | 0 | 0 | 0 | 0 | 0 | 0 | 0 |
| 1916 | RTA00000195AF.b.21.1 | 39055 | 2 | 0 | 0 | 0 | 0 | 0 | 0 | 0 |
| 1917 | RTA00000403F.h.05.1 | 39096 | 2 | 0 | 0 | 0 | 0 | 0 | 0 | 0 |
| 1919 | RTA00000422F.p.07.2 | 39024 | 2 | 0 | 0 | 1 | 0 | 0 | 0 | 0 |
| 1922 | RTA00000421F.n.19.1 | 16409 | 3 | 1 | 0 | 0 | 0 | 0 | 0 | 0 |
| 1924 | RTA00000345F.k.21.1 | 40204 | 2 | 0 | 0 | 0 | 0 | 0 | 0 | 0 |
| 1926 | RTA00000405F.a.11.1 | 39124 | 2 | 0 | 0 | 0 | 0 | 0 | 0 | 0 |
| 1928 | RTA00000413F.e.16.1 | 63836 | 1 | 0 | 0 | 0 | 0 | 0 | 0 | 0 |
| 1930 | RTA00000404F.o.18.2 | 39110 | 2 | 0 | 0 | 0 | 0 | 0 | 0 | 0 |
| 1931 | RTA00000409F.i.24.1 | 76967 | 1 | 0 | 0 | 0 | 0 | 0 | 0 | 0 |
| 1935 | RTA00000340F.n.13.1 | 17055 | 4 | 0 | 0 | 0 | 0 | 0 | 0 | 0 |
| 1936 | RTA00000340F.p.04.1 | 78533 | 1 | 0 | 0 | 0 | 0 | 0 | 0 | 0 |
| 1937 | RTA00000411F.c.05.1 | 73368 | 1 | 0 | 0 | 0 | 0 | 0 | 0 | 0 |
| 1941 | RTA00000404F.i.02.1 | 39015 | 2 | 0 | 0 | 0 | 0 | 0 | 0 | 0 |
| 1943 | RTA00000403F.m.15.2 | 26901 | 2 | 0 | 0 | 0 | 0 | 0 | 0 | 0 |
| 1944 | RTA00000412F.h.23.2 | 65118 | 1 | 0 | 0 | 0 | 0 | 0 | 0 | 0 |
| 1945 | RTA00000418F.j.08.1 | 73382 | 1 | 0 | 0 | 0 | 0 | 0 | 0 | 0 |
| 1946 | RTA00000125A.n.4.1 | 81984 | 1 | 0 | 0 | 0 | 0 | 0 | 0 | 0 |
| 1947 | RTA00000412F.l.19.1 | 65825 | 1 | 0 | 0 | 0 | 0 | 0 | 0 | 0 |
| 1949 | RTA00000129A.p.3.1 | 32644 | 1 | 1 | 0 | 0 | 0 | 0 | 0 | 0 |
| 1950 | RTA00000340F.p.20.1 | 17008 | 4 | 0 | 0 | 0 | 0 | 0 | 0 | 0 |
| 1951 | RTA00000411F.a.10.1 | 73073 | 1 | 0 | 0 | 0 | 0 | 0 | 0 | 0 |
| 1952 | RTA00000409F.n.17.1 | 76725 | 1 | 0 | 0 | 0 | 0 | 0 | 0 | 0 |
| 1953 | RTA00000404F.c.03.2 | 39198 | 2 | 0 | 0 | 0 | 0 | 0 | 0 | 0 |
| 1954 | RTA00000420F.a.19.1 | 34192 | 1 | 1 | 0 | 0 | 0 | 0 | 0 | 0 |
| 1958 | RTA00000420F.d.12.1 | 64095 | 1 | 0 | 0 | 0 | 0 | 0 | 0 | 0 |
| 1959 | RTA00000409F.j.19.1 | 73792 | 1 | 0 | 0 | 0 | 0 | 0 | 0 | 0 |
| 1960 | RTA00000422F.d.16.1 | 39133 | 2 | 0 | 0 | 0 | 0 | 0 | 0 | 0 |
| 1961 | RTA00000418F.m.16.1 | 74986 | 1 | 0 | 0 | 0 | 0 | 0 | 0 | 0 |
| 1962 | RTA00000405F.c.11.1 | 39068 | 2 | 0 | 0 | 0 | 0 | 0 | 0 | 0 |
| 1963 | RTA00000404F.k.22.1 | 39084 | 2 | 0 | 0 | 0 | 0 | 0 | 0 | 0 |
| 1964 | RTA00000418F.k.07.1 | 75067 | 1 | 0 | 0 | 0 | 0 | 0 | 0 | 0 |
| 1965 | RTA00000403F.c.10.1 | 75261 | 1 | 0 | 0 | 0 | 0 | 0 | 0 | 0 |
| 1968 | RTA00000410F.m.05.1 | 74964 | 1 | 0 | 0 | 0 | 0 | 0 | 0 | 0 |
| 1969 | RTA00000405F.i.20.1 | 38532 | 2 | 0 | 0 | 0 | 0 | 0 | 0 | 0 |
| 1971 | RTA00000408F.p.24.1 | 74286 | 1 | 0 | 0 | 0 | 0 | 0 | 0 | 0 |
| 1972 | RTA00000418F.k.18.1 | 75385 | 1 | 0 | 0 | 0 | 0 | 0 | 0 | 0 |
| 1973 | RTA00000422F.m.04.1 | 38702 | 2 | 0 | 0 | 0 | 0 | 0 | 0 | 0 |
| 1977 | RTA00000403F.a.07.1 | 73559 | 1 | 0 | 0 | 0 | 0 | 0 | 0 | 0 |
| 1979 | RTA00000403F.b.19.1 | 22327 | 2 | 1 | 0 | 0 | 0 | 0 | 0 | 0 |
| 1980 | RTA00000418F.m.23.1 | 77195 | 1 | 0 | 0 | 0 | 0 | 0 | 0 | 0 |
| 1982 | RTA00000404F.i.18.1 | 21912 | 2 | 1 | 0 | 0 | 0 | 0 | 0 | 0 |
| 1983 | RTA00000422F.i.14.1 | 39300 | 2 | 0 | 0 | 0 | 0 | 0 | 0 | 0 |
| 1984 | RTA00000418F.m.14.1 | 75711 | 1 | 0 | 0 | 1 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 1985 | RTA00000406F.o.12.1 | 37459 | 2 | 0 | 0 | 0 | 0 | 0 | 0 | 0 |
| 1987 | RTA00000411F.a.07.1 | 74547 | 1 | 0 | 0 | 0 | 0 | 0 | 0 | 0 |
| 1988 | RTA00000411F.c.02.1 | 72852 | 1 | 0 | 0 | 0 | 0 | 0 | 0 | 0 |
| 1990 | RTA00000130A.h.16.1 | 80761 | 1 | 0 | 0 | 0 | 0 | 0 | 0 | 0 |
| 1991 | RTA00000410F.p.23.1 | 73948 | 1 | 0 | 0 | 0 | 0 | 0 | 0 | 0 |
| 1992 | RTA00000418F.m.24.1 | 77114 | 1 | 0 | 0 | 0 | 0 | 0 | 0 | 0 |
| 1994 | RTA00000408F.j.19.2 | 73752 | 1 | 0 | 0 | 0 | 0 | 0 | 0 | 0 |
| 1996 | RTA00000118A.d.17.1 | 81921 | 1 | 0 | 0 | 0 | 0 | 0 | 0 | 0 |
| 1997 | RTA00000407F.b.04.1 | 63221 | 1 | 0 | 0 | 0 | 0 | 0 | 0 | 0 |
| 1998 | RTA00000411F.e.07.1 | 65008 | 1 | 0 | 0 | 0 | 0 | 0 | 0 | 0 |
| 2000 | RTA00000132A.c.11.1 | 87278 | 1 | 0 | 0 | 0 | 0 | 0 | 0 | 0 |
| 2001 | RTA00000420F.e.16.1 | 63639 | 1 | 0 | 0 | 0 | 0 | 0 | 0 | 0 |
| 2003 | RTA00000404F.b.11.1 | 39079 | 2 | 0 | 0 | 0 | 0 | 0 | 0 | 0 |
| 2004 | RTA00000418F.k.17.1 | 75390 | 1 | 0 | 0 | 0 | 0 | 0 | 0 | 0 |
| 2005 | RTA00000129A.k.12.1 | 79322 | 1 | 0 | 0 | 0 | 0 | 0 | 0 | 0 |
| 2006 | RTA00000340R.m.07.1 | 78415 | 1 | 0 | 0 | 0 | 0 | 0 | 0 | 0 |
| 2007 | RTA00000405F.d.14.1 | 35209 | 2 | 0 | 0 | 0 | 0 | 0 | 1 | 0 |
| 2008 | RTA00000406F.f.11.1 | 38601 | 2 | 0 | 0 | 0 | 0 | 0 | 0 | 0 |
| 2009 | RTA00000120A.h.5.1 | 80344 | 1 | 0 | 0 | 0 | 0 | 0 | 0 | 0 |
| 2011 | RTA00000411F.g.06.1 | 66065 | 1 | 0 | 0 | 0 | 0 | 0 | 0 | 0 |
| 2012 | RTA00000408F.d.16.1 | 76318 | 1 | 0 | 0 | 0 | 0 | 0 | 0 | 0 |
| 2015 | RTA00000404F.c.19.1 | 39026 | 2 | 0 | 0 | 0 | 0 | 0 | 0 | 1 |
| 2017 | RTA00000410F.a.01.1 | 73354 | 1 | 0 | 0 | 0 | 0 | 0 | 0 | 0 |
| 2018 | RTA00000408F.h.08.1 | 74575 | 1 | 0 | 0 | 0 | 0 | 0 | 0 | 0 |
| 2019 | RTA00000422F.b.16.1 | 17045 | 4 | 0 | 0 | 0 | 0 | 0 | 0 | 0 |
| 2020 | RTA00000419F.f.10.1 | 66193 | 1 | 0 | 0 | 0 | 0 | 0 | 0 | 0 |
| 2021 | RTA00000418F.l.04.1 | 74140 | 1 | 0 | 0 | 0 | 0 | 0 | 0 | 0 |
| 2022 | RTA00000410F.a.16.1 | 73548 | 1 | 0 | 0 | 0 | 0 | 0 | 0 | 0 |
| 2023 | RTA00000138A.e.13.1 | 79608 | 1 | 0 | 0 | 0 | 0 | 0 | 0 | 0 |
| 2024 | RTA00000130A.b.5.1 | 79579 | 1 | 0 | 0 | 0 | 0 | 0 | 0 | 0 |
| 2025 | RTA00000408F.j.15.2 | 74759 | 1 | 0 | 0 | 0 | 0 | 0 | 0 | 0 |
| 2026 | RTA00000410F.m.20.1 | 74285 | 1 | 0 | 0 | 0 | 0 | 0 | 0 | 0 |
| 2029 | RTA00000419F.e.04.1 | 62963 | 1 | 0 | 0 | 0 | 0 | 0 | 0 | 0 |
| 2031 | RTA00000418F.g.05.1 | 73075 | 1 | 0 | 0 | 0 | 0 | 0 | 0 | 0 |
| 2032 | RTA00000419F.n.02.1 | 65963 | 1 | 0 | 0 | 0 | 0 | 0 | 0 | 0 |
| 2035 | RTA00000119A.m.15.1 | 80989 | 1 | 0 | 0 | 0 | 0 | 0 | 0 | 0 |
| 2038 | RTA00000413F.g.23.1 | 40700 | 1 | 1 | 0 | 0 | 0 | 0 | 0 | 0 |
| 2039 | RTA00000403F.a.18.1 | 75726 | 1 | 0 | 0 | 0 | 0 | 0 | 0 | 0 |
| 2040 | RTA00000404F.m.20.2 | 39144 | 2 | 0 | 0 | 0 | 0 | 0 | 0 | 0 |
| 2043 | RTA00000419F.h.04.1 | 65034 | 1 | 0 | 0 | 0 | 0 | 0 | 0 | 0 |
| 2044 | RTA00000408F.d.12.1 | 75782 | 1 | 0 | 0 | 0 | 0 | 0 | 0 | 0 |
| 2045 | RTA00000133A.m.19.2 | 80167 | 1 | 0 | 0 | 0 | 0 | 0 | 0 | 0 |
| 2050 | RTA00000126A.o.22.1 | 81752 | 1 | 0 | 0 | 0 | 0 | 0 | 0 | 0 |
| 2051 | RTA00000419F.n.13.1 | 66026 | 1 | 0 | 0 | 0 | 0 | 0 | 0 | 0 |
| 2052 | RTA00000130A.h.13.1 | 80790 | 1 | 0 | 0 | 0 | 0 | 0 | 0 | 0 |
| 2056 | RTA00000411F.m.19.1 | 74924 | 1 | 0 | 0 | 0 | 0 | 0 | 0 | 0 |
| 2058 | RTA00000419F.k.06.1 | 78493 | 1 | 0 | 0 | 0 | 0 | 0 | 0 | 0 |
| 2060 | RTA00000412F.d.16.1 | 26829 | 1 | 0 | 0 | 0 | 0 | 0 | 0 | 0 |
| 2061 | RTA00000119A.j.23.1 | 79835 | 1 | 0 | 0 | 0 | 0 | 0 | 0 | 0 |
| 2063 | RTA00000195AF.c.12.1 | 37582 | 2 | 0 | 0 | 0 | 0 | 0 | 0 | 0 |
| 2067 | RTA00000423F.c.19.1 | 40472 | 2 | 0 | 0 | 0 | 0 | 0 | 0 | 0 |
| 2068 | RTA00000405F.g.24.1 | 39076 | 2 | 0 | 0 | 0 | 0 | 0 | 0 | 0 |
| 2070 | RTA00000419F.c.11.1 | 65504 | 1 | 0 | 0 | 0 | 0 | 0 | 0 | 0 |
| 2071 | RTA00000135A.f.14.2 | 79969 | 1 | 0 | 0 | 0 | 0 | 0 | 0 | 0 |
| 2072 | RTA00000403F.a.05.1 | 18808 | 1 | 1 | 0 | 0 | 0 | 0 | 0 | 0 |
| 2073 | RTA00000405F.e.17.1 | 38662 | 2 | 0 | 0 | 0 | 0 | 0 | 0 | 0 |
| 2074 | RTA00000411F.d.05.1 | 75812 | 1 | 0 | 0 | 0 | 0 | 0 | 0 | 0 |
| 2076 | RTA00000418F.d.03.1 | 76824 | 1 | 0 | 0 | 0 | 0 | 0 | 0 | 0 |
| 2077 | RTA00000418F.h.08.1 | 76401 | 1 | 0 | 0 | 0 | 0 | 0 | 0 | 0 |
| 2078 | RTA00000418F.m.10.1 | 79110 | 1 | 0 | 0 | 0 | 0 | 0 | 0 | 0 |
| 2079 | RTA00000411F.i.15.1 | 31612 | 1 | 1 | 0 | 0 | 0 | 0 | 0 | 0 |
| 2080 | RTA00000413F.i.23.1 | 63073 | 1 | 0 | 0 | 0 | 0 | 0 | 0 | 0 |
| 2081 | RTA00000411F.e.24.1 | 64781 | 1 | 0 | 0 | 0 | 0 | 0 | 0 | 0 |
| 2082 | RTA00000406F.g.22.1 | 38590 | 2 | 0 | 0 | 0 | 0 | 0 | 0 | 0 |
| 2083 | RTA00000126A.n.13.2 | 79735 | 1 | 0 | 0 | 0 | 0 | 0 | 0 | 0 |
| 2084 | RTA00000419F.a.02.1 | 77993 | 1 | 0 | 0 | 0 | 0 | 0 | 0 | 0 |
| 2085 | RTA00000346F.l.13.1 | 7542 | 8 | 0 | 0 | 2 | 1 | 0 | 1 | 0 |
| 2089 | RTA00000120A.d.15.1 | 80533 | 1 | 0 | 0 | 0 | 0 | 0 | 0 | 0 |
| 2090 | RTA00000418F.f.21.1 | 75157 | 1 | 0 | 0 | 0 | 0 | 0 | 0 | 0 |
| 2092 | RTA00000129A.d.1.2 | 80058 | 1 | 0 | 0 | 0 | 0 | 0 | 0 | 0 |
| 2095 | RTA00000419F.m.20.1 | 76720 | 1 | 0 | 0 | 0 | 0 | 0 | 0 | 0 |
| 2097 | RTA00000406F.e.15.1 | 39074 | 2 | 0 | 0 | 0 | 0 | 0 | 0 | 0 |
| 2099 | RTA00000411F.c.10.1 | 73117 | 1 | 0 | 0 | 0 | 0 | 0 | 0 | 0 |
| 2103 | RTA00000413F.d.05.1 | 64788 | 1 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2104 | RTA00000121A.o.3.1 | 81437 | 1 | 0 | 0 | 0 | 0 | 0 | 0 | 0 |
| 2106 | RTA00000420F.e.02.1 | 40259 | 2 | 0 | 0 | 0 | 0 | 0 | 0 | 0 |
| 2112 | RTA00000126A.k.7.2 | 79866 | 1 | 0 | 0 | 0 | 0 | 0 | 0 | 0 |
| 2114 | RTA00000419F.l.03.1 | 79060 | 1 | 0 | 0 | 0 | 0 | 0 | 0 | 0 |
| 2116 | RTA00000118A.a.2.1 | 38067 | 2 | 0 | 0 | 0 | 0 | 0 | 0 | 0 |
| 2117 | RTA00000410F.m.18.1 | 76365 | 1 | 0 | 0 | 0 | 0 | 0 | 0 | 0 |
| 2119 | RTA00000406F.c.20.1 | 38578 | 2 | 0 | 0 | 0 | 0 | 0 | 0 | 0 |
| 2120 | RTA00000413F.b.14.1 | 66591 | 1 | 0 | 0 | 0 | 0 | 0 | 0 | 0 |
| 2121 | RTA00000406F.c.18.1 | 14368 | 2 | 0 | 0 | 0 | 0 | 0 | 0 | 0 |
| 2122 | RTA00000418F.j.09.1 | 76352 | 1 | 0 | 0 | 0 | 0 | 0 | 0 | 0 |
| 2123 | RTA00000419F.f.23.1 | 65002 | 1 | 0 | 0 | 0 | 0 | 0 | 0 | 0 |
| 2125 | RTA00000411F.a.05.1 | 76699 | 1 | 0 | 0 | 0 | 0 | 0 | 0 | 0 |
| 2126 | RTA00000419F.m.21.1 | 77947 | 1 | 0 | 0 | 0 | 0 | 0 | 0 | 0 |
| 2127 | RTA00000405F.n.16.1 | 21503 | 2 | 1 | 1 | 0 | 0 | 0 | 0 | 0 |
| 2128 | RTA00000422F.o.19.2 | 13084 | 3 | 2 | 0 | 0 | 0 | 0 | 0 | 0 |
| 2129 | RTA00000408F.n.02.2 | 76993 | 1 | 0 | 0 | 0 | 0 | 0 | 0 | 0 |
| 2134 | RTA00000119A.g.7.1 | 83580 | 1 | 0 | 0 | 0 | 0 | 0 | 0 | 0 |
| 2135 | RTA00000411F.i.02.1 | 66975 | 1 | 0 | 0 | 0 | 0 | 0 | 0 | 0 |
| 2136 | RTA00000408F.l.09.1 | 75487 | 1 | 0 | 0 | 0 | 0 | 0 | 0 | 0 |
| 2137 | RTA00000423F.g.04.1 | 23012 | 2 | 1 | 0 | 0 | 0 | 0 | 0 | 0 |
| 2139 | RTA00000418F.i.18.1 | 78024 | 1 | 0 | 0 | 0 | 0 | 0 | 0 | 0 |
| 2140 | RTA00000411F.h.15.1 | 65160 | 1 | 0 | 0 | 0 | 0 | 0 | 0 | 0 |
| 2141 | RTA00000410F.i.19.1 | 78988 | 1 | 0 | 0 | 0 | 0 | 0 | 0 | 0 |
| 2142 | RTA00000419F.k.24.1 | 75596 | 1 | 0 | 0 | 0 | 0 | 0 | 0 | 0 |
| 2145 | RTA00000409F.i.09.1 | 75279 | 1 | 0 | 0 | 0 | 0 | 0 | 0 | 0 |
| 2146 | RTA00000419F.h.02.1 | 63985 | 1 | 0 | 0 | 0 | 0 | 0 | 0 | 0 |
| 2147 | RTA00000413F.b.12.1 | 64932 | 1 | 0 | 0 | 0 | 0 | 0 | 0 | 0 |
| 2148 | RTA00000121A.h.18.1 | 16376 | 4 | 0 | 0 | 0 | 0 | 0 | 0 | 0 |
| 2149 | RTA00000411F.n.20.1 | 75816 | 1 | 0 | 0 | 0 | 0 | 0 | 0 | 0 |
| 2151 | RTA00000411F.n.12.1 | 73308 | 1 | 0 | 0 | 0 | 0 | 0 | 0 | 0 |
| 2152 | RTA00000408F.j.12.2 | 18226 | 1 | 0 | 0 | 0 | 0 | 0 | 0 | 0 |
| 2153 | RTA00000409F.i.03.1 | 75968 | 1 | 0 | 0 | 0 | 0 | 0 | 0 | 0 |
| 2156 | RTA00000409F.j.05.1 | 74128 | 1 | 0 | 0 | 0 | 0 | 0 | 0 | 0 |
| 2157 | RTA00000419F.m.04.1 | 74367 | 1 | 0 | 0 | 0 | 0 | 0 | 0 | 0 |
| 2158 | RTA00000418F.k.03.1 | 78901 | 1 | 0 | 0 | 0 | 0 | 0 | 0 | 0 |
| 2159 | RTA00000419F.d.16.1 | 64357 | 1 | 0 | 0 | 0 | 0 | 0 | 0 | 0 |
| 2160 | RTA00000420F.e.10.1 | 65899 | 1 | 0 | 0 | 0 | 0 | 0 | 0 | 0 |
| 2163 | RTA00000418F.k.08.1 | 18259 | 1 | 0 | 0 | 0 | 0 | 0 | 0 | 0 |
| 2166 | RTA00000410F.c.02.1 | 75055 | 1 | 0 | 0 | 0 | 0 | 0 | 0 | 0 |
| 2168 | RTA00000403F.h.18.1 | 39241 | 2 | 0 | 0 | 0 | 0 | 0 | 0 | 0 |
| 2169 | RTA00000405F.n.13.1 | 23810 | 2 | 1 | 0 | 0 | 0 | 0 | 0 | 0 |
| 2170 | RTA00000355R.e.14.1 | 16837 | 2 | 2 | 0 | 0 | 0 | 0 | 0 | 0 |
| 2171 | RTA00000422F.l.03.1 | 39147 | 2 | 0 | 0 | 0 | 0 | 0 | 0 | 0 |
| 2173 | RTA00000403F.o.14.1 | 38971 | 2 | 0 | 0 | 0 | 0 | 0 | 0 | 0 |
| 2177 | RTA00000127A.f.11.1 | 81463 | 1 | 0 | 0 | 0 | 0 | 0 | 0 | 0 |
| 2179 | RTA00000403F.o.07.1 | 39037 | 2 | 0 | 0 | 0 | 0 | 0 | 0 | 0 |
| 2180 | RTA00000403F.d.19.1 | 39243 | 2 | 0 | 0 | 0 | 0 | 0 | 0 | 0 |
| 2182 | RTA00000406F.i.17.1 | 37902 | 2 | 0 | 0 | 0 | 0 | 0 | 0 | 0 |
| 2183 | RTA00000418F.d.22.1 | 75324 | 1 | 0 | 0 | 0 | 0 | 0 | 0 | 0 |
| 2184 | RTA00000340R.o.12.1 | 53732 | 1 | 0 | 0 | 0 | 0 | 0 | 0 | 0 |
| 2185 | RTA00000125A.g.24.1 | 80397 | 1 | 0 | 0 | 0 | 0 | 0 | 0 | 0 |
| 2186 | RTA00000130A.o.21.1 | 80218 | 1 | 0 | 0 | 0 | 0 | 0 | 0 | 0 |
| 2187 | RTA00000420F.a.23.1 | 42158 | 1 | 1 | 0 | 0 | 0 | 0 | 0 | 0 |
| 2188 | RTA00000411F.m.18.1 | 75629 | 1 | 0 | 0 | 0 | 0 | 0 | 0 | 0 |
| 2189 | RTA00000407F.b.22.1 | 37487 | 2 | 0 | 0 | 0 | 0 | 0 | 0 | 0 |
| 2190 | RTA00000409F.a.16.1 | 73990 | 1 | 0 | 0 | 0 | 0 | 0 | 0 | 0 |
| 2192 | RTA00000341F.k.12.1 | 62985 | 1 | 0 | 0 | 0 | 0 | 0 | 0 | 0 |
| 2193 | RTA00000129A.c.18.2 | 37216 | 2 | 0 | 0 | 0 | 0 | 0 | 0 | 0 |
| 2194 | RTA00000410F.d.10.1 | 77561 | 1 | 0 | 0 | 0 | 0 | 0 | 0 | 0 |
| 2195 | RTA00000351R.i.03.1 | 6874 | 6 | 3 | 0 | 0 | 1 | 0 | 0 | 0 |
| 2196 | RTA00000135A.l.1.2 | 39426 | 2 | 0 | 0 | 0 | 0 | 0 | 0 | 0 |
| 2197 | RTA00000420F.b.18.1 | 66136 | 1 | 0 | 0 | 0 | 0 | 0 | 0 | 0 |
| 2200 | RTA00000403F.o.13.1 | 39049 | 2 | 0 | 0 | 0 | 0 | 0 | 0 | 0 |
| 2201 | RTA00000411F.f.06.1 | 64186 | 1 | 0 | 0 | 0 | 0 | 0 | 0 | 0 |
| 2203 | RTA00000351R.c.13.1 | 11476 | 6 | 0 | 0 | 0 | 0 | 0 | 0 | 0 |
| 2206 | RTA00000420F.d.16.1 | 64485 | 1 | 0 | 0 | 0 | 0 | 0 | 0 | 0 |
| 2207 | RTA00000404F.i.12.1 | 39001 | 2 | 0 | 0 | 0 | 0 | 0 | 0 | 0 |
| 2208 | RTA00000404F.o.10.2 | 16785 | 2 | 2 | 0 | 0 | 0 | 0 | 0 | 0 |
| 2209 | RTA00000419F.d.07.1 | 21421 | 1 | 2 | 0 | 0 | 0 | 0 | 0 | 0 |
| 2210 | RTA00000404F.p.02.2 | 39097 | 2 | 0 | 1 | 0 | 0 | 0 | 0 | 0 |
| 2211 | RTA00000125A.k.14.1 | 79457 | 1 | 0 | 0 | 0 | 0 | 0 | 0 | 0 |
| 2212 | RTA00000122A.j.22.1 | 81151 | 1 | 0 | 0 | 0 | 0 | 0 | 0 | 0 |
| 2213 | RTA00000406F.i.13.1 | 37904 | 2 | 0 | 0 | 0 | 0 | 0 | 0 | 0 |
| 2214 | RTA00000135A.b.23.1 | 35241 | 2 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2217 | RTA00000423F.l.04.1 | 14320 | 2 | 0 | 0 | 0 | 0 | 0 | 0 | 0 |
| 2218 | RTA00000420F.b.04.1 | 63820 | 1 | 0 | 0 | 0 | 0 | 0 | 0 | 0 |
| 2220 | RTA00000408F.i.18.2 | 74410 | 1 | 0 | 0 | 0 | 0 | 0 | 0 | 0 |
| 2222 | RTA00000341F.j.05.1 | 36177 | 2 | 0 | 0 | 0 | 0 | 0 | 0 | 0 |
| 2223 | RTA00000420F.a.16.1 | 63345 | 1 | 0 | 0 | 0 | 0 | 0 | 0 | 0 |
| 2225 | RTA00000410F.j.01.1 | 73399 | 1 | 0 | 0 | 0 | 0 | 0 | 0 | 0 |
| 2226 | RTA00000408F.p.21.1 | 77930 | 1 | 0 | 0 | 0 | 0 | 0 | 0 | 0 |
| 2227 | RTA00000412F.d.19.1 | 75743 | 1 | 0 | 0 | 0 | 0 | 0 | 0 | 0 |
| 2228 | RTA00000352R.c.04.1 | 71976 | 1 | 0 | 0 | 0 | 0 | 0 | 0 | 0 |
| 2229 | RTA00000413F.f.19.1 | 65189 | 1 | 0 | 0 | 0 | 0 | 0 | 0 | 0 |
| 2230 | RTA00000411F.e.03.1 | 73648 | 1 | 0 | 0 | 0 | 0 | 0 | 0 | 0 |
| 2233 | RTA00000418F.c.04.1 | 41587 | 1 | 1 | 0 | 0 | 0 | 0 | 0 | 0 |
| 2234 | RTA00000418F.o.17.1 | 79069 | 1 | 0 | 0 | 0 | 0 | 0 | 0 | 0 |
| 2235 | RTA00000418F.e.21.1 | 74773 | 1 | 0 | 0 | 0 | 0 | 0 | 0 | 0 |
| 2236 | RTA00000419F.d.14.1 | 64945 | 1 | 0 | 0 | 0 | 0 | 0 | 0 | 0 |
| 2240 | RTA00000410F.j.20.1 | 73601 | 1 | 0 | 0 | 0 | 0 | 0 | 0 | 0 |
| 2243 | RTA00000119A.j.9.1 | 82060 | 1 | 0 | 0 | 0 | 0 | 0 | 0 | 0 |
| 2247 | RTA00000340F.i.13.1 | 79299 | 1 | 0 | 0 | 0 | 0 | 0 | 0 | 0 |
| 2248 | RTA00000412F.g.03.1 | 64740 | 1 | 0 | 0 | 0 | 0 | 0 | 0 | 0 |
| 2249 | RTA00000122A.g.17.1 | 32655 | 1 | 1 | 0 | 0 | 0 | 0 | 0 | 0 |
| 2251 | RTA00000419F.n.12.1 | 66086 | 1 | 0 | 0 | 0 | 0 | 0 | 0 | 0 |
| 2254 | RTA00000351R.p.14.1 | 13166 | 2 | 3 | 0 | 0 | 0 | 0 | 0 | 0 |
| 2255 | RTA00000403F.e.08.1 | 19126 | 3 | 0 | 0 | 0 | 0 | 0 | 0 | 0 |
| 2256 | RTA00000124A.k.20.1 | 80913 | 1 | 0 | 0 | 0 | 0 | 0 | 0 | 0 |
| 2257 | RTA00000121A.n.2.1 | 33585 | 1 | 1 | 0 | 0 | 0 | 0 | 0 | 0 |
| 2258 | RTA00000422F.m.24.1 | 39159 | 2 | 0 | 1 | 0 | 1 | 1 | 2 | 2 |
| 2259 | RTA00000408F.e.24.2 | 75002 | 1 | 0 | 0 | 0 | 0 | 0 | 0 | 0 |
| 2262 | RTA00000403F.b.12.1 | 78775 | 1 | 0 | 0 | 0 | 0 | 0 | 0 | 0 |
| 2263 | RTA00000404F.a.09.1 | 38985 | 2 | 0 | 0 | 0 | 0 | 0 | 0 | 0 |
| 2265 | RTA00000403F.o.19.1 | 78615 | 1 | 0 | 0 | 0 | 0 | 0 | 0 | 0 |
| 2268 | RTA00000410F.b.10.1 | 74504 | 1 | 0 | 0 | 0 | 0 | 0 | 0 | 0 |
| 2270 | RTA00000413F.h.12.1 | 66929 | 1 | 0 | 0 | 0 | 0 | 0 | 0 | 0 |
| 2271 | RTA00000406F.k.14.1 | 38651 | 2 | 0 | 0 | 0 | 0 | 0 | 0 | 0 |
| 2273 | RTA00000411F.f.17.1 | 65661 | 1 | 0 | 0 | 0 | 0 | 0 | 0 | 0 |
| 2274 | RTA00000411F.k.10.1 | 64506 | 1 | 0 | 0 | 0 | 0 | 0 | 0 | 0 |
| 2275 | RTA00000411F.g.21.1 | 64500 | 1 | 0 | 0 | 0 | 0 | 0 | 0 | 0 |
| 2276 | RTA00000119A.h.24.1 | 82266 | 1 | 0 | 0 | 0 | 0 | 0 | 0 | 0 |
| 2278 | RTA00000408F.m.22.2 | 72949 | 1 | 0 | 0 | 0 | 0 | 0 | 0 | 0 |
| 2281 | RTA00000410F.i.17.1 | 78147 | 1 | 0 | 0 | 0 | 0 | 0 | 0 | 0 |
| 2284 | RTA00000129A.a.13.2 | 79780 | 1 | 0 | 0 | 0 | 0 | 0 | 0 | 0 |
| 2285 | RTA00000129A.k.21.1 | 82067 | 1 | 0 | 0 | 0 | 0 | 0 | 0 | 0 |
| 2286 | RTA00000350R.g.10.1 | 9026 | 7 | 0 | 0 | 1 | 0 | 0 | 0 | 0 |
| 2287 | RTA00000413F.d.23.1 | 66030 | 1 | 0 | 0 | 0 | 0 | 0 | 0 | 0 |
| 2291 | RTA00000411F.d.10.1 | 76445 | 1 | 0 | 0 | 0 | 0 | 0 | 0 | 0 |
| 2292 | RTA00000404F.b.19.1 | 39281 | 2 | 0 | 0 | 0 | 0 | 0 | 0 | 0 |
| 2293 | RTA00000418F.c.07.1 | 73245 | 1 | 0 | 0 | 0 | 0 | 0 | 0 | 0 |
| 2294 | RTA00000418F.j.15.1 | 74855 | 1 | 0 | 0 | 0 | 0 | 1 | 0 | 0 |
| 2297 | RTA00000413F.b.16.1 | 65126 | 1 | 0 | 0 | 0 | 0 | 0 | 0 | 0 |
| 2299 | RTA00000350R.m.14.1 | 39171 | 2 | 0 | 0 | 0 | 0 | 0 | 0 | 0 |
| 2300 | RTA00000418F.l.11.1 | 77158 | 1 | 0 | 0 | 0 | 0 | 0 | 0 | 0 |
| 2301 | RTA00000130A.d.5.1 | 82051 | 1 | 0 | 0 | 0 | 0 | 0 | 0 | 0 |
| 2302 | RTA00000339F.n.05.1 | 39648 | 2 | 0 | 0 | 0 | 0 | 0 | 0 | 0 |
| 2304 | RTA00000407F.a.23.1 | 23489 | 2 | 1 | 0 | 0 | 0 | 0 | 0 | 0 |
| 2306 | RTA00000403F.h.11.1 | 39219 | 2 | 0 | 0 | 0 | 0 | 0 | 0 | 0 |
| 2307 | RTA00000406F.j.13.1 | 38688 | 2 | 0 | 0 | 0 | 0 | 0 | 0 | 0 |
| 2308 | RTA00000352R.p.09.1 | 16915 | 4 | 0 | 0 | 0 | 0 | 0 | 0 | 0 |
| 2309 | RTA00000413F.g.24.1 | 65481 | 1 | 0 | 0 | 0 | 0 | 0 | 0 | 0 |
| 2313 | RTA00000420F.a.08.1 | 19473 | 1 | 2 | 0 | 0 | 0 | 0 | 0 | 0 |
| 2316 | RTA00000404F.i.22.1 | 39082 | 2 | 0 | 0 | 0 | 0 | 0 | 0 | 0 |
| 2317 | RTA00000124A.k.23.1 | 81350 | 1 | 0 | 0 | 0 | 0 | 0 | 0 | 0 |
| 2318 | RTA00000404F.e.11.1 | 38991 | 2 | 0 | 0 | 0 | 0 | 0 | 0 | 0 |
| 2319 | RTA00000129A.d.2.4 | 80119 | 1 | 0 | 0 | 0 | 0 | 0 | 0 | 0 |
| 2322 | RTA00000419F.o.15.1 | 32487 | 1 | 1 | 0 | 0 | 0 | 0 | 0 | 0 |
| 2323 | RTA00000119A.m.17.1 | 79536 | 1 | 0 | 0 | 0 | 0 | 0 | 0 | 0 |
| 2324 | RTA00000410F.b.07.1 | 78916 | 1 | 0 | 0 | 0 | 0 | 0 | 0 | 0 |
| 2325 | RTA00000420F.b.19.1 | 36873 | 2 | 0 | 0 | 0 | 0 | 0 | 0 | 0 |
| 2327 | RTA00000411F.b.21.1 | 10051 | 1 | 0 | 0 | 0 | 0 | 0 | 0 | 0 |
| 2329 | RTA00000356R.c.16.1 | 16915 | 4 | 0 | 0 | 0 | 0 | 0 | 0 | 0 |
| 2331 | RTA00000412F.h.11.1 | 63175 | 1 | 0 | 0 | 0 | 0 | 0 | 0 | 0 |
| 2334 | RTA00000420F.a.11.1 | 66460 | 1 | 0 | 0 | 0 | 0 | 0 | 0 | 0 |
| 2335 | RTA00000120A.c.7.1 | 80985 | 1 | 0 | 0 | 1 | 0 | 0 | 0 | 0 |
| 2336 | RTA00000404F.e.15.1 | 39101 | 2 | 0 | 0 | 0 | 0 | 0 | 0 | 0 |
| 2337 | RTA00000422F.n.20.1 | 38676 | 2 | 0 | 0 | 0 | 0 | 0 | 1 | 0 |
| 2338 | RTA00000423F.h.20.1 | 38639 | 2 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2341 | RTA00000410F.b.18.1 | 76701 | 1 | 0 | 0 | 0 | 0 | 0 | 0 | 0 |
| 2343 | RTA00000423F.g.15.1 | 35173 | 2 | 0 | 0 | 0 | 0 | 0 | 0 | 0 |
| 2344 | RTA00000413F.b.04.1 | 66427 | 1 | 0 | 0 | 0 | 0 | 0 | 0 | 0 |
| 2347 | RTA00000346F.f.11.1 | 38528 | 2 | 0 | 0 | 0 | 0 | 0 | 0 | 0 |
| 2350 | RTA00000422F.i.02.1 | 76436 | 1 | 0 | 0 | 0 | 0 | 0 | 0 | 0 |
| 2351 | RTA00000410F.a.08.1 | 73324 | 1 | 0 | 0 | 0 | 0 | 0 | 0 | 0 |
| 2353 | RTA00000419F.e.02.1 | 65010 | 1 | 0 | 0 | 0 | 0 | 0 | 0 | 0 |
| 2355 | RTA00000403F.g.13.1 | 38718 | 2 | 0 | 0 | 0 | 0 | 0 | 0 | 0 |
| 2357 | RTA00000407F.a.01.1 | 12501 | 3 | 1 | 0 | 0 | 0 | 0 | 0 | 0 |
| 2360 | RTA00000411F.f.14.1 | 62984 | 1 | 0 | 0 | 0 | 0 | 0 | 0 | 0 |
| 2361 | RTA00000411F.c.04.1 | 76858 | 1 | 0 | 0 | 0 | 0 | 0 | 0 | 0 |
| 2362 | RTA00000135A.m.18.1 | 19255 | 2 | 0 | 0 | 0 | 0 | 0 | 0 | 0 |
| 2363 | RTA00000413F.c.17.1 | 36831 | 2 | 0 | 0 | 0 | 0 | 0 | 0 | 0 |
| 2365 | RTA00000404F.j.01.1 | 26859 | 2 | 0 | 0 | 0 | 0 | 0 | 0 | 0 |
| 2366 | RTA00000138A.p.10.1 | 81625 | 1 | 0 | 0 | 0 | 0 | 0 | 0 | 0 |
| 2370 | RTA00000423F.h.07.1 | 37933 | 2 | 0 | 0 | 0 | 0 | 0 | 0 | 0 |
| 2371 | RTA00000413F.e.04.1 | 64176 | 1 | 0 | 0 | 0 | 0 | 0 | 0 | 0 |
| 2372 | RTA00000406F.h.03.1 | 38585 | 2 | 0 | 0 | 0 | 0 | 0 | 0 | 0 |
| 2373 | RTA00000403F.e.24.1 | 16432 | 2 | 2 | 0 | 0 | 0 | 0 | 0 | 0 |
| 2375 | RTA00000403F.i.11.1 | 23535 | 2 | 1 | 0 | 0 | 0 | 0 | 0 | 0 |
| 2376 | RTA00000419F.g.02.1 | 62839 | 1 | 0 | 0 | 0 | 0 | 0 | 0 | 0 |
| 2377 | RTA00000347F.e.05.1 | 39814 | 2 | 0 | 0 | 0 | 0 | 0 | 0 | 0 |
| 2378 | RTA00000408F.l.16.1 | 73468 | 1 | 0 | 0 | 0 | 0 | 0 | 0 | 0 |
| 2380 | RTA00000423F.f.09.1 | 64823 | 1 | 0 | 0 | 0 | 0 | 0 | 0 | 0 |
| 2381 | RTA00000419F.k.03.1 | 40822 | 1 | 1 | 0 | 0 | 0 | 0 | 0 | 0 |
| 2382 | RTA00000406F.b.02.1 | 38744 | 2 | 0 | 0 | 0 | 0 | 0 | 0 | 0 |
| 2383 | RTA00000418F.o.14.1 | 33524 | 1 | 1 | 0 | 0 | 0 | 0 | 0 | 0 |
| 2385 | RTA00000404F.b.09.1 | 39166 | 2 | 0 | 0 | 0 | 0 | 0 | 0 | 0 |
| 2391 | RTA00000406F.k.11.1 | 38715 | 2 | 0 | 0 | 0 | 0 | 0 | 0 | 0 |
| 2393 | RTA00000406F.c.06.1 | 37924 | 2 | 0 | 0 | 0 | 0 | 0 | 0 | 0 |
| 2394 | RTA00000418F.n.07.1 | 76316 | 1 | 0 | 0 | 0 | 0 | 0 | 0 | 0 |
| 2395 | RTA00000419F.n.15.1 | 63484 | 1 | 0 | 0 | 0 | 0 | 0 | 0 | 0 |
| 2396 | RTA00000408F.n.06.2 | 76642 | 1 | 0 | 0 | 0 | 0 | 0 | 0 | 0 |
| 2397 | RTA00000420F.c.04.1 | 65007 | 1 | 0 | 0 | 0 | 0 | 0 | 0 | 0 |
| 2398 | RTA00000411F.j.15.1 | 66871 | 1 | 0 | 0 | 0 | 0 | 0 | 0 | 0 |
| 2400 | RTA00000128A.m.23.1 | 81441 | 1 | 0 | 0 | 0 | 0 | 0 | 0 | 0 |
| 2401 | RTA00000406F.g.03.1 | 38690 | 2 | 0 | 0 | 0 | 0 | 0 | 0 | 0 |
| 2402 | RTA00000405F.h.05.2 | 75706 | 1 | 0 | 0 | 0 | 0 | 0 | 0 | 0 |
| 2403 | RTA00000129A.n.24.1 | 81409 | 1 | 0 | 0 | 0 | 0 | 0 | 0 | 0 |
| 2406 | RTA00000418F.n.11.1 | 78977 | 1 | 0 | 0 | 0 | 0 | 0 | 0 | 0 |
| 2409 | RTA00000120A.h.9.1 | 80736 | 1 | 0 | 0 | 0 | 0 | 0 | 0 | 0 |
| 2410 | RTA00000413F.a.12.1 | 63403 | 1 | 0 | 0 | 0 | 0 | 0 | 0 | 0 |
| 2411 | RTA00000412F.o.05.1 | 63575 | 1 | 0 | 0 | 0 | 0 | 0 | 0 | 0 |
| 2415 | RTA00000354R.n.04.1 | 22049 | 3 | 0 | 0 | 0 | 0 | 0 | 0 | 0 |
| 2417 | RTA00000406F.h.05.1 | 38542 | 2 | 0 | 0 | 0 | 0 | 0 | 0 | 0 |
| 2418 | RTA00000410F.b.24.1 | 75104 | 1 | 0 | 0 | 0 | 0 | 0 | 0 | 0 |
| 2419 | RTA00000423F.d.11.1 | 38950 | 2 | 0 | 0 | 0 | 0 | 0 | 0 | 0 |
| 2422 | RTA00000119A.k.1.1 | 81282 | 1 | 0 | 0 | 0 | 0 | 0 | 0 | 0 |
| 2423 | RTA00000420F.f.07.1 | 66312 | 1 | 0 | 0 | 0 | 0 | 0 | 0 | 0 |
| 2424 | RTA00000404F.k.22.2 | 39084 | 2 | 0 | 0 | 0 | 0 | 0 | 0 | 0 |
| 2425 | RTA00000422F.e.07.1 | 38964 | 2 | 0 | 0 | 0 | 0 | 0 | 0 | 0 |
| 2426 | RTA00000410F.f.12.1 | 73883 | 1 | 0 | 0 | 0 | 0 | 0 | 0 | 0 |
| 2428 | RTA00000411F.m.11.1 | 73196 | 1 | 0 | 0 | 0 | 0 | 0 | 0 | 0 |
| 2431 | RTA00000403F.o.10.2 | 38964 | 2 | 0 | 0 | 0 | 0 | 0 | 0 | 0 |
| 2434 | RTA00000413F.c.10.1 | 65600 | 1 | 0 | 0 | 0 | 0 | 0 | 0 | 0 |
| 2435 | RTA00000411F.b.17.1 | 72893 | 1 | 0 | 0 | 0 | 0 | 0 | 0 | 0 |
| 2437 | RTA00000408F.k.19.1 | 77593 | 1 | 0 | 0 | 0 | 0 | 0 | 0 | 0 |
| 2440 | RTA00000119A.i.8.1 | 82593 | 1 | 0 | 0 | 0 | 0 | 0 | 0 | 0 |
| 2442 | RTA00000418F.g.03.1 | 78737 | 1 | 0 | 0 | 0 | 0 | 0 | 0 | 0 |
| 2443 | RTA00000411F.a.09.1 | 78629 | 1 | 0 | 0 | 0 | 0 | 0 | 0 | 0 |
| 2445 | RTA00000419F.j.11.1 | 73183 | 1 | 0 | 0 | 0 | 0 | 0 | 0 | 0 |
| 2447 | RTA00000404F.n.18.2 | 37169 | 2 | 0 | 0 | 0 | 0 | 0 | 0 | 0 |
| 2448 | RTA00000122A.n.16.1 | 80553 | 1 | 0 | 0 | 0 | 0 | 0 | 0 | 0 |
| 2449 | RTA00000420F.c.07.1 | 65555 | 1 | 0 | 0 | 0 | 0 | 0 | 0 | 0 |
| 2452 | RTA00000408F.j.13.2 | 42275 | 1 | 1 | 0 | 0 | 0 | 0 | 0 | 0 |
| 2454 | RTA00000423F.a.01.1 | 39103 | 2 | 0 | 0 | 0 | 0 | 0 | 0 | 0 |
| 2457 | RTA00000341F.e.20.1 | 67422 | 1 | 0 | 0 | 0 | 0 | 0 | 0 | 0 |
| 2458 | RTA00000419F.m.22.1 | 75600 | 1 | 0 | 0 | 0 | 0 | 0 | 0 | 0 |
| 2459 | RTA00000419F.m.23.1 | 64263 | 1 | 0 | 0 | 0 | 0 | 0 | 0 | 0 |
| 2460 | RTA00000419F.b.06.1 | 76728 | 1 | 0 | 0 | 0 | 0 | 0 | 0 | 0 |
| 2462 | RTA00000406F.p.08.1 | 37573 | 2 | 0 | 0 | 0 | 0 | 0 | 0 | 2 |
| 2463 | RTA00000129A.n.17.1 | 79811 | 1 | 0 | 0 | 0 | 0 | 0 | 0 | 0 |
| 2465 | RTA00000407F.b.08.1 | 37513 | 2 | 0 | 0 | 0 | 0 | 0 | 0 | 0 |
| 2467 | RTA00000406F.i.08.1 | 37946 | 2 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2468 | RTA00000403F.h.07.1 | 26856 | 2 | 0 | 0 | 0 | 0 | 0 | 0 | 0 |
| 2469 | RTA00000418F.n.24.1 | 73153 | 1 | 0 | 0 | 0 | 0 | 0 | 0 | 0 |
| 2471 | RTA00000409F.l.20.1 | 74394 | 1 | 0 | 0 | 0 | 0 | 0 | 0 | 0 |
| 2472 | RTA00000418F.l.06.1 | 73317 | 1 | 0 | 0 | 0 | 0 | 0 | 0 | 0 |
| 2473 | RTA00000346F.o.22.1 | 7381 | 2 | 6 | 0 | 0 | 0 | 0 | 0 | 0 |
| 2474 | RTA00000129A.k.22.1 | 79639 | 1 | 0 | 0 | 0 | 0 | 0 | 0 | 0 |
| 2476 | RTA00000418F.m.22.1 | 74567 | 1 | 0 | 0 | 0 | 0 | 0 | 0 | 0 |
| 2477 | RTA00000413F.c.12.1 | 65334 | 1 | 0 | 0 | 0 | 0 | 0 | 0 | 0 |
| 2479 | RTA00000418F.g.20.1 | 74626 | 1 | 0 | 0 | 0 | 0 | 0 | 0 | 0 |
| 2480 | RTA00000413F.d.15.1 | 64943 | 1 | 0 | 0 | 0 | 0 | 0 | 0 | 0 |
| 2483 | RTA00000412F.c.10.1 | 76372 | 1 | 0 | 0 | 0 | 0 | 0 | 0 | 0 |
| 2484 | RTA00000122A.j.17.1 | 62736 | 1 | 0 | 0 | 0 | 0 | 0 | 0 | 0 |
| 2489 | RTA00000418F.j.19.1 | 78399 | 1 | 0 | 0 | 0 | 0 | 0 | 0 | 0 |
| 2490 | RTA00000137A.p.12.1 | 80614 | 1 | 0 | 0 | 0 | 0 | 0 | 0 | 0 |
| 2492 | RTA00000418F.p.10.1 | 75323 | 1 | 0 | 0 | 0 | 0 | 0 | 0 | 0 |
| 2493 | RTA00000408F.k.12.1 | 77246 | 1 | 0 | 0 | 0 | 0 | 0 | 0 | 0 |
| 2494 | RTA00000137A.j.11.4 | 79752 | 1 | 0 | 0 | 0 | 0 | 0 | 0 | 0 |
| 2496 | RTA00000419F.n.24.1 | 65995 | 1 | 0 | 0 | 0 | 0 | 0 | 0 | 0 |
| 2497 | RTA00000418F.l.03.1 | 79058 | 1 | 0 | 0 | 0 | 0 | 0 | 0 | 0 |
| 2499 | RTA00000419F.m.13.1 | 79052 | 1 | 0 | 0 | 0 | 0 | 0 | 0 | 0 |
| 2500 | RTA00000418F.j.14.1 | 32623 | 1 | 1 | 0 | 0 | 0 | 0 | 0 | 0 |
| 2501 | RTA00000403F.a.10.1 | 73952 | 1 | 0 | 0 | 0 | 0 | 0 | 0 | 0 |
| 2502 | RTA00000420F.a.21.1 | 66241 | 1 | 0 | 0 | 0 | 0 | 0 | 0 | 0 |
| 2503 | RTA00000127A.e.6.1 | 5885 | 4 | 2 | 0 | 0 | 0 | 0 | 0 | 0 |
| 2504 | RTA00000405F.g.21.2 | 38966 | 2 | 0 | 0 | 0 | 0 | 0 | 0 | 0 |
| 2505 | RTA00000405F.g.21.1 | 38966 | 2 | 0 | 0 | 0 | 0 | 0 | 0 | 0 |
| 2506 | RTA00000419F.m.06.1 | 75749 | 1 | 0 | 0 | 0 | 0 | 0 | 0 | 0 |
| 2507 | RTA00000423F.g.03.1 | 38007 | 2 | 0 | 0 | 0 | 0 | 0 | 0 | 0 |
| 2509 | RTA00000418F.f.03.1 | 78911 | 1 | 0 | 0 | 0 | 0 | 0 | 0 | 0 |
| 2512 | RTA00000120A.c.20.1 | 43235 | 1 | 1 | 0 | 0 | 0 | 1 | 0 | 0 |
| 2513 | RTA00000138A.m.15.1 | 41603 | 1 | 1 | 0 | 0 | 0 | 0 | 0 | 0 |
| 2514 | RTA00000408F.f.14.2 | 73024 | 1 | 0 | 0 | 0 | 0 | 0 | 0 | 0 |
| 2515 | RTA00000418F.p.20.1 | 78023 | 1 | 0 | 0 | 0 | 0 | 0 | 0 | 0 |
| 2516 | RTA00000423F.e.21.1 | 66961 | 1 | 0 | 0 | 0 | 0 | 0 | 0 | 0 |
| 2517 | RTA00000419F.j.22.1 | 73525 | 1 | 0 | 0 | 0 | 0 | 0 | 0 | 0 |
| 2518 | RTA00000410F.d.18.1 | 75458 | 1 | 0 | 0 | 0 | 0 | 0 | 0 | 0 |
| 2519 | RTA00000403F.b.24.1 | 78838 | 1 | 0 | 0 | 0 | 0 | 0 | 0 | 0 |
| 2521 | RTA00000410F.e.09.1 | 76093 | 1 | 0 | 0 | 0 | 0 | 0 | 0 | 0 |
| 2524 | RTA00000353R.h.10.1 | 39498 | 2 | 0 | 0 | 0 | 0 | 0 | 0 | 0 |
| 2526 | RTA00000411F.d.21.1 | 74794 | 1 | 0 | 0 | 0 | 0 | 0 | 0 | 0 |
| 2527 | RTA00000340F.m.04.1 | 19406 | 2 | 1 | 0 | 0 | 0 | 0 | 0 | 0 |
| 2528 | RTA00000411F.n.09.1 | 78962 | 1 | 0 | 0 | 0 | 0 | 0 | 0 | 0 |
| 2529 | RTA00000127A.h.22.2 | 13155 | 2 | 3 | 0 | 0 | 0 | 0 | 0 | 0 |
| 2530 | RTA00000420F.e.09.1 | 66325 | 1 | 0 | 0 | 0 | 0 | 0 | 0 | 0 |
| 2531 | RTA00000405F.p.03.1 | 11346 | 3 | 3 | 0 | 0 | 0 | 0 | 0 | 0 |
| 2532 | RTA00000419F.a.18.1 | 78484 | 1 | 0 | 0 | 0 | 0 | 0 | 0 | 0 |
| 2535 | RTA00000121A.n.23.1 | 26981 | 2 | 0 | 0 | 0 | 0 | 0 | 0 | 0 |
| 2536 | RTA00000121A.n.15.1 | 40849 | 1 | 1 | 0 | 0 | 0 | 0 | 0 | 0 |
| 2537 | RTA00000403F.i.23.1 | 11364 | 4 | 2 | 0 | 0 | 0 | 0 | 0 | 0 |
| 2538 | RTA00000405F.a.03.1 | 39065 | 2 | 0 | 0 | 0 | 0 | 0 | 0 | 0 |
| 2540 | RTA00000419F.p.08.1 | 65560 | 1 | 0 | 0 | 0 | 0 | 0 | 0 | 0 |
| 2541 | RTA00000126A.n.6.2 | 79917 | 1 | 0 | 0 | 0 | 0 | 0 | 0 | 0 |
| 2542 | RTA00000413F.c.03.1 | 64527 | 1 | 0 | 0 | 1 | 0 | 0 | 0 | 0 |
| 2543 | RTA00000422F.k.24.1 | 39118 | 2 | 0 | 0 | 0 | 0 | 0 | 0 | 0 |
| 2544 | RTA00000412F.c.17.1 | 75620 | 1 | 0 | 0 | 0 | 0 | 0 | 0 | 0 |
| 2546 | RTA00000347F.g.08.1 | 23121 | 3 | 0 | 0 | 0 | 0 | 0 | 0 | 0 |
| 2547 | RTA00000419F.o.06.1 | 64643 | 1 | 0 | 0 | 0 | 0 | 0 | 0 | 0 |
| 2548 | RTA00000340R.j.07.1 | 38954 | 2 | 0 | 0 | 0 | 0 | 0 | 0 | 0 |
| 2549 | RTA00000423F.j.02.1 | 38617 | 2 | 0 | 0 | 0 | 0 | 0 | 0 | 0 |
| 2550 | RTA00000419F.c.04.1 | 63749 | 1 | 0 | 0 | 0 | 0 | 0 | 0 | 0 |
| 2551 | RTA00000411F.a.01.1 | 74524 | 1 | 0 | 0 | 0 | 0 | 0 | 0 | 0 |
| 2552 | RTA00000406F.f.05.1 | 22961 | 2 | 1 | 0 | 0 | 0 | 0 | 1 | 0 |
| 2553 | RTA00000410F.n.05.1 | 77830 | 1 | 0 | 0 | 0 | 0 | 0 | 0 | 0 |
| 2554 | RTA00000404F.e.06.1 | 39315 | 2 | 0 | 0 | 0 | 0 | 0 | 0 | 0 |
| 2556 | RTA00000411F.c.03.1 | 79280 | 1 | 0 | 0 | 0 | 0 | 0 | 0 | 0 |
| 2562 | RTA00000405F.l.07.1 | 38636 | 2 | 0 | 0 | 0 | 0 | 0 | 0 | 0 |
| 2564 | RTA00000411F.n.06.1 | 73886 | 1 | 0 | 0 | 0 | 0 | 0 | 0 | 0 |
| 2565 | RTA00000422F.k.15.1 | 19253 | 2 | 0 | 0 | 0 | 0 | 0 | 0 | 0 |
| 2566 | RTA00000406F.h.16.1 | 38618 | 2 | 0 | 0 | 0 | 0 | 0 | 0 | 0 |
| 2567 | RTA00000419F.f.24.1 | 18717 | 1 | 1 | 0 | 0 | 0 | 0 | 0 | 0 |
| 2568 | RTA00000411F.d.18.1 | 76063 | 1 | 0 | 0 | 0 | 0 | 0 | 0 | 0 |
| 2571 | RTA00000408F.d.15.1 | 78467 | 1 | 0 | 0 | 0 | 0 | 0 | 0 | 0 |
| 2572 | RTA00000339F.b.22.1 | 6867 | 7 | 3 | 0 | 0 | 0 | 0 | 0 | 0 |
| 2574 | RTA00000411F.n.02.1 | 78049 | 1 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2575 | RTA00000419F.b.17.1 | 63261 | 1 | 0 | 0 | 0 | 0 | 0 | 0 | 0 |
| 2577 | RTA00000130A.e.20.1 | 79502 | 1 | 0 | 0 | 0 | 0 | 0 | 0 | 0 |
| 2579 | RTA00000411F.i.13.1 | 66138 | 1 | 0 | 0 | 0 | 0 | 0 | 0 | 0 |
| 2580 | RTA00000420F.e.20.1 | 64762 | 1 | 0 | 0 | 0 | 0 | 0 | 0 | 0 |
| 2581 | RTA00000126A.p.23.2 | 80915 | 1 | 0 | 0 | 0 | 0 | 0 | 0 | 0 |
| 2583 | RTA00000406F.g.08.1 | 37963 | 2 | 0 | 0 | 0 | 0 | 0 | 0 | 0 |
| 2584 | RTA00000409F.a.08.1 | 74978 | 1 | 0 | 0 | 0 | 0 | 0 | 0 | 0 |
| 2585 | RTA00000406F.d.24.1 | 37997 | 2 | 0 | 0 | 0 | 0 | 0 | 0 | 0 |
| 2588 | RTA00000418F.i.12.1 | 78971 | 1 | 0 | 0 | 0 | 0 | 0 | 0 | 0 |
| 2589 | RTA00000121A.h.19.1 | 80334 | 1 | 0 | 0 | 0 | 0 | 0 | 0 | 0 |
| 2590 | RTA00000419F.b.10.1 | 78566 | 1 | 0 | 0 | 0 | 0 | 0 | 0 | 0 |
| 2591 | RTA00000406F.m.10.1 | 38004 | 2 | 0 | 0 | 0 | 0 | 0 | 0 | 0 |
| 2592 | RTA00000406F.o.05.1 | 37894 | 2 | 0 | 0 | 0 | 0 | 0 | 0 | 0 |
| 2593 | RTA00000408F.b.04.2 | 39933 | 2 | 0 | 0 | 0 | 0 | 0 | 0 | 0 |
| 2594 | RTA00000411F.k.04.1 | 65407 | 1 | 0 | 0 | 0 | 0 | 0 | 0 | 0 |
| 2596 | RTA00000134A.l.9.1 | 81814 | 1 | 0 | 0 | 0 | 0 | 0 | 0 | 0 |
| 2598 | RTA00000418F.k.04.1 | 75864 | 1 | 0 | 0 | 0 | 0 | 0 | 0 | 0 |
| 2601 | RTA00000419F.p.18.1 | 63002 | 1 | 0 | 0 | 0 | 0 | 0 | 0 | 0 |
| 2603 | RTA00000419F.a.24.1 | 79290 | 1 | 0 | 0 | 0 | 0 | 0 | 0 | 0 |
| 2605 | RTA00000129A.e.14.1 | 80053 | 1 | 0 | 0 | 0 | 0 | 0 | 0 | 0 |
| 2606 | RTA00000404F.a.01.1 | 19251 | 2 | 0 | 0 | 0 | 0 | 0 | 0 | 0 |
| 2609 | RTA00000408F.n.16.2 | 73720 | 1 | 0 | 0 | 0 | 0 | 0 | 0 | 0 |
| 2613 | RTA00000412F.l.14.1 | 62792 | 1 | 0 | 0 | 0 | 0 | 0 | 0 | 0 |
| 2614 | RTA00000129A.b.6.2 | 39111 | 2 | 0 | 0 | 0 | 0 | 0 | 0 | 0 |
| 2615 | RTA00000406F.n.12.1 | 37517 | 2 | 0 | 0 | 0 | 0 | 0 | 0 | 0 |
| 2616 | RTA00000418F.e.03.1 | 73442 | 1 | 0 | 0 | 0 | 0 | 0 | 0 | 0 |
| 2618 | RTA00000403F.g.03.1 | 23537 | 2 | 1 | 0 | 0 | 0 | 0 | 0 | 0 |
| 2619 | RTA00000412F.p.06.1 | 65485 | 1 | 0 | 0 | 0 | 0 | 0 | 0 | 0 |
| 2620 | RTA00000419F.b.21.1 | 65366 | 1 | 0 | 0 | 0 | 0 | 0 | 0 | 0 |
| 2623 | RTA00000351R.j.16.1 | 64773 | 1 | 0 | 0 | 0 | 0 | 0 | 0 | 0 |
| 2625 | RTA00000419F.f.18.1 | 64047 | 1 | 0 | 0 | 0 | 0 | 0 | 0 | 0 |
| 2626 | RTA00000423F.i.16.1 | 38604 | 2 | 0 | 0 | 0 | 0 | 0 | 0 | 0 |
| 2628 | RTA00000411F.f.04.1 | 64526 | 1 | 0 | 0 | 0 | 0 | 0 | 0 | 0 |
| 2629 | RTA00000125A.c.17.1 | 80619 | 1 | 0 | 0 | 0 | 0 | 0 | 0 | 0 |
| 2630 | RTA00000404F.g.08.1 | 38980 | 2 | 0 | 0 | 0 | 0 | 0 | 0 | 0 |
| 2631 | RTA00000423F.c.13.1 | 39059 | 2 | 0 | 0 | 0 | 0 | 0 | 0 | 0 |
| 2634 | RTA00000404F.k.15.1 | 18225 | 2 | 0 | 0 | 0 | 0 | 0 | 0 | 0 |
| 2636 | RTA00000339F.l.12.1 | 7711 | 4 | 1 | 0 | 0 | 0 | 0 | 0 | 0 |
| 2637 | RTA00000406F.b.01.1 | 39006 | 2 | 0 | 0 | 0 | 0 | 0 | 0 | 0 |
| 2638 | RTA00000407F.c.08.1 | 37549 | 2 | 0 | 0 | 0 | 0 | 0 | 0 | 0 |
| 2640 | RTA00000403F.b.05.1 | 74300 | 1 | 0 | 0 | 0 | 0 | 0 | 0 | 0 |
| 2644 | RTA00000408F.j.05.2 | 73878 | 1 | 0 | 0 | 0 | 0 | 0 | 0 | 0 |
| 2646 | RTA00000419F.c.14.1 | 65727 | 1 | 0 | 0 | 0 | 0 | 0 | 0 | 0 |
| 2650 | RTA00000346F.h.24.1 | 4379 | 9 | 2 | 0 | 0 | 0 | 0 | 0 | 0 |
| 2651 | RTA00000420F.b.02.1 | 64013 | 1 | 0 | 0 | 0 | 0 | 0 | 0 | 0 |
| 2652 | RTA00000413F.b.24.1 | 65117 | 1 | 0 | 0 | 0 | 0 | 0 | 0 | 0 |
| 2653 | RTA00000412F.d.08.1 | 75328 | 1 | 0 | 0 | 0 | 0 | 0 | 0 | 0 |
| 2655 | RTA00000419F.m.18.1 | 76014 | 1 | 0 | 0 | 0 | 0 | 0 | 0 | 0 |
| 2656 | RTA00000419F.l.24.1 | 74628 | 1 | 0 | 0 | 0 | 0 | 0 | 0 | 0 |
| 2657 | RTA00000408F.c.06.1 | 78619 | 1 | 0 | 0 | 0 | 0 | 0 | 0 | 0 |
| 2658 | RTA00000405F.h.21.2 | 39072 | 2 | 0 | 0 | 0 | 0 | 0 | 0 | 0 |
| 2660 | RTA00000405F.g.05.2 | 38987 | 2 | 0 | 0 | 0 | 0 | 0 | 0 | 0 |
| 2661 | RTA00000411F.f.20.1 | 63501 | 1 | 0 | 0 | 0 | 0 | 0 | 0 | 0 |
| 2663 | RTA00000420F.d.19.1 | 43146 | 1 | 1 | 0 | 0 | 0 | 0 | 0 | 0 |
| 2664 | RTA00000195R.a.06.1 | 35265 | 2 | 0 | 1 | 0 | 0 | 0 | 0 | 0 |
| 2665 | RTA00000123A.f.2.1 | 80379 | 1 | 0 | 0 | 0 | 0 | 0 | 0 | 0 |
| 2666 | RTA00000411F.j.11.1 | 66154 | 1 | 0 | 0 | 0 | 0 | 0 | 0 | 0 |
| 2671 | RTA00000419F.j.03.1 | 77578 | 1 | 0 | 0 | 0 | 0 | 0 | 0 | 0 |
| 2673 | RTA00000423F.h.11.1 | 38977 | 2 | 0 | 0 | 0 | 0 | 0 | 0 | 0 |
| 2674 | RTA00000413F.b.17.1 | 21704 | 1 | 2 | 0 | 0 | 0 | 0 | 0 | 0 |
| 2677 | RTA00000423F.f.03.1 | 63852 | 1 | 0 | 0 | 0 | 0 | 0 | 0 | 0 |
| 2678 | RTA00000419F.e.10.1 | 63225 | 1 | 0 | 0 | 0 | 0 | 0 | 0 | 0 |
| 2680 | RTA00000403F.d.02.1 | 39224 | 2 | 0 | 0 | 0 | 0 | 0 | 0 | 0 |
| 2682 | RTA00000418F.j.20.1 | 77101 | 1 | 0 | 0 | 0 | 0 | 0 | 0 | 0 |
| 2690 | RTA00000356R.h.05.1 | 35052 | 2 | 0 | 1 | 0 | 0 | 0 | 0 | 0 |
| 2692 | RTA00000340F.i.15.1 | 26815 | 1 | 0 | 0 | 0 | 0 | 0 | 0 | 0 |
| 2694 | RTA00000345F.c.12.1 | 23824 | 2 | 1 | 0 | 0 | 0 | 0 | 0 | 0 |
| 2696 | RTA00000412F.o.03.1 | 65039 | 1 | 0 | 0 | 0 | 0 | 0 | 0 | 0 |
| 2697 | RTA00000409F.d.16.1 | 76090 | 1 | 0 | 0 | 0 | 0 | 0 | 0 | 0 |
| 2700 | RTA00000408F.j.17.2 | 78935 | 1 | 0 | 0 | 0 | 0 | 0 | 0 | 0 |
| 2701 | RTA00000126A.j.15.2 | 40425 | 2 | 0 | 0 | 0 | 0 | 0 | 0 | 0 |
| 2705 | RTA00000410F.b.17.1 | 77458 | 1 | 0 | 0 | 0 | 0 | 0 | 0 | 0 |
| 2706 | RTA00000419F.l.22.1 | 78444 | 1 | 0 | 0 | 0 | 0 | 0 | 0 | 0 |
| 2708 | RTA00000422F.f.22.1 | 38703 | 2 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2711 | RTA00000418F.c.05.1 | 76475 | 1 | 0 | 0 | 0 | 0 | 0 | 0 | 0 |
| 2712 | RTA00000418F.p.21.1 | 78068 | 1 | 0 | 0 | 0 | 0 | 0 | 0 | 0 |
| 2714 | RTA00000340F.i.08.1 | 12005 | 2 | 1 | 0 | 0 | 0 | 0 | 0 | 0 |
| 2715 | RTA00000410F.o.04.1 | 79018 | 1 | 0 | 0 | 0 | 0 | 0 | 0 | 0 |
| 2716 | RTA00000411F.l.16.1 | 16122 | 1 | 3 | 0 | 0 | 0 | 0 | 0 | 0 |
| 2717 | RTA00000411F.j.03.1 | 66263 | 1 | 0 | 0 | 0 | 0 | 0 | 0 | 0 |
| 2718 | RTA00000126A.k.24.1 | 39428 | 2 | 0 | 0 | 0 | 0 | 0 | 0 | 0 |
| 2720 | RTA00000120A.m.10.3 | 81376 | 1 | 0 | 0 | 0 | 0 | 0 | 0 | 0 |
| 2721 | RTA00000419F.f.16.1 | 64679 | 1 | 0 | 0 | 0 | 0 | 0 | 0 | 0 |
| 2722 | RTA00000408F.c.23.1 | 42261 | 1 | 1 | 0 | 0 | 0 | 0 | 0 | 0 |
| 2725 | RTA00000136A.h.6.1 | 81620 | 1 | 0 | 0 | 0 | 0 | 0 | 0 | 0 |
| 2730 | RTA00000418F.e.20.1 | 73741 | 1 | 0 | 0 | 0 | 0 | 0 | 0 | 0 |
| 2732 | RTA00000405F.l.03.1 | 38580 | 2 | 0 | 0 | 0 | 0 | 0 | 0 | 0 |
| 2733 | RTA00000418F.m.02.1 | 74550 | 1 | 0 | 0 | 0 | 0 | 0 | 0 | 0 |
| 2735 | RTA00000406F.c.05.1 | 22077 | 3 | 0 | 1 | 0 | 0 | 0 | 0 | 0 |
| 2737 | RTA00000411F.k.21.1 | 65349 | 1 | 0 | 0 | 0 | 0 | 0 | 0 | 0 |
| 2741 | RTA00000418F.i.06.1 | 75151 | 1 | 0 | 0 | 0 | 0 | 0 | 0 | 0 |
| 2742 | RTA00000423F.a.03.1 | 26796 | 2 | 0 | 0 | 0 | 0 | 0 | 0 | 0 |
| 2744 | RTA00000423F.k.21.2 | 37499 | 2 | 0 | 0 | 0 | 0 | 0 | 0 | 0 |
| 2746 | RTA00000404F.c.18.1 | 38982 | 2 | 0 | 0 | 0 | 0 | 0 | 0 | 0 |
| 2749 | RTA00000411F.g.24.1 | 65233 | 1 | 0 | 0 | 0 | 0 | 0 | 0 | 0 |
| 2751 | RTA00000405F.m.07.1 | 37733 | 2 | 0 | 0 | 0 | 0 | 0 | 0 | 0 |
| 2752 | RTA00000411F.j.07.1 | 66963 | 1 | 0 | 0 | 0 | 0 | 0 | 0 | 0 |
| 2754 | RTA00000353R.h.04.1 | 17123 | 4 | 0 | 0 | 0 | 0 | 0 | 0 | 0 |
| 2755 | RTA00000408F.f.10.2 | 75309 | 1 | 0 | 0 | 0 | 0 | 0 | 0 | 0 |
| 2757 | RTA00000405F.o.03.1 | 37575 | 2 | 0 | 0 | 0 | 0 | 0 | 0 | 0 |
| 2758 | RTA00000413F.b.18.1 | 39873 | 2 | 0 | 0 | 0 | 0 | 0 | 0 | 0 |
| 2764 | RTA00000408F.c.08.1 | 73473 | 1 | 0 | 0 | 0 | 0 | 0 | 0 | 0 |
| 2766 | RTA00000410F.c.06.1 | 77784 | 1 | 0 | 0 | 0 | 1 | 0 | 0 | 0 |
| 2768 | RTA00000405F.b.08.1 | 39182 | 2 | 0 | 0 | 0 | 0 | 0 | 0 | 0 |
| 2769 | RTA00000409F.l.24.1 | 73174 | 1 | 0 | 0 | 0 | 0 | 0 | 0 | 0 |
| 2770 | RTA00000406F.j.06.1 | 38952 | 2 | 0 | 0 | 0 | 0 | 0 | 0 | 0 |
| 2771 | RTA00000423F.h.03.1 | 37903 | 2 | 0 | 0 | 0 | 0 | 0 | 0 | 0 |
| 2773 | RTA00000121A.k.22.1 | 79523 | 1 | 0 | 0 | 0 | 0 | 0 | 0 | 0 |
| 2775 | RTA00000411F.m.06.1 | 24195 | 2 | 1 | 0 | 0 | 0 | 0 | 0 | 0 |
| 2776 | RTA00000126A.b.9.1 | 81279 | 1 | 0 | 0 | 0 | 0 | 0 | 0 | 0 |
| 2779 | RTA00000404F.l.05.1 | 38671 | 2 | 0 | 0 | 0 | 0 | 0 | 0 | 0 |
| 2785 | RTA00000419F.p.10.1 | 41448 | 1 | 1 | 0 | 0 | 0 | 0 | 0 | 0 |
| 2786 | RTA00000120A.c.19.1 | 81016 | 1 | 0 | 0 | 0 | 0 | 0 | 0 | 0 |
| 2792 | RTA00000411F.k.14.1 | 63987 | 1 | 0 | 0 | 0 | 0 | 0 | 0 | 0 |
| 2793 | RTA00000420F.e.05.1 | 63908 | 1 | 0 | 0 | 0 | 0 | 0 | 0 | 0 |
| 2796 | RTA00000128A.j.10.1 | 80085 | 1 | 0 | 0 | 0 | 0 | 0 | 0 | 0 |
| 2797 | RTA00000412F.f.10.2 | 65405 | 1 | 0 | 0 | 0 | 0 | 0 | 0 | 0 |
| 2799 | RTA00000422F.k.17.1 | 38955 | 2 | 0 | 0 | 0 | 0 | 0 | 0 | 0 |
| 2801 | RTA00000347F.h.10.1 | 22779 | 3 | 0 | 0 | 0 | 0 | 0 | 0 | 0 |
| 2803 | RTA00000419F.l.02.1 | 75736 | 1 | 0 | 0 | 0 | 0 | 0 | 0 | 0 |
| 2805 | RTA00000418F.b.20.1 | 73560 | 1 | 0 | 0 | 0 | 0 | 0 | 0 | 0 |
| 2808 | RTA00000408F.n.05.2 | 77883 | 1 | 0 | 0 | 0 | 0 | 0 | 0 | 0 |
| 2809 | RTA00000419F.o.09.1 | 66396 | 1 | 0 | 0 | 0 | 0 | 0 | 0 | 0 |
| 2814 | RTA00000422F.o.08.2 | 26832 | 2 | 0 | 0 | 0 | 0 | 0 | 0 | 0 |
| 2817 | RTA00000418F.m.18.1 | 76479 | 1 | 0 | 0 | 0 | 0 | 0 | 0 | 0 |
| 2818 | RTA00000347F.e.20.1 | 39911 | 2 | 0 | 0 | 0 | 0 | 0 | 0 | 0 |
| 2819 | RTA00000419F.e.23.1 | 65772 | 1 | 0 | 0 | 0 | 0 | 0 | 0 | 0 |
| 2826 | RTA00000411F.g.05.1 | 64664 | 1 | 0 | 0 | 0 | 0 | 0 | 0 | 0 |
| 2827 | RTA00000404F.b.10.1 | 37148 | 2 | 0 | 0 | 0 | 0 | 0 | 0 | 0 |
| 2828 | RTA00000422F.n.14.1 | 26787 | 2 | 0 | 0 | 0 | 0 | 0 | 0 | 0 |
| 2830 | RTA00000120A.m.13.3 | 80608 | 1 | 0 | 0 | 0 | 0 | 0 | 0 | 0 |
| 2831 | RTA00000412F.i.03.1 | 65617 | 1 | 0 | 0 | 0 | 0 | 0 | 0 | 0 |
| 2832 | RTA00000418F.l.02.1 | 39316 | 2 | 0 | 0 | 0 | 0 | 0 | 0 | 0 |
| 2834 | RTA00000411F.j.04.1 | 66219 | 1 | 0 | 0 | 0 | 0 | 0 | 0 | 0 |
| 2839 | RTA00000404F.a.18.1 | 36267 | 2 | 0 | 0 | 0 | 0 | 0 | 0 | 0 |
| 2840 | RTA00000408F.l.14.1 | 12001 | 2 | 3 | 0 | 0 | 0 | 0 | 0 | 0 |
| 2841 | RTA00000405F.d.10.1 | 39000 | 2 | 0 | 0 | 0 | 0 | 0 | 0 | 0 |
| 2843 | RTA00000418F.h.23.1 | 75153 | 1 | 0 | 0 | 0 | 0 | 0 | 0 | 0 |
| 2845 | RTA00000418F.j.11.1 | 73853 | 1 | 0 | 0 | 0 | 0 | 0 | 0 | 0 |
| 2846 | RTA00000408F.o.13.1 | 74895 | 1 | 0 | 0 | 0 | 0 | 0 | 0 | 0 |
| 2847 | RTA00000419F.o.07.1 | 14059 | 1 | 0 | 0 | 0 | 0 | 0 | 0 | 0 |
| 2848 | RTA00000419F.n.17.1 | 63186 | 1 | 0 | 0 | 0 | 0 | 0 | 0 | 0 |
| 2849 | RTA00000403F.f.15.1 | 22768 | 3 | 0 | 0 | 0 | 0 | 0 | 0 | 0 |
| 2850 | RTA00000408F.d.03.1 | 22768 | 3 | 0 | 0 | 0 | 0 | 0 | 0 | 0 |
| 2852 | RTA00000346F.f.02.1 | 62757 | 1 | 0 | 0 | 0 | 0 | 0 | 0 | 0 |
| 2854 | RTA00000413F.i.21.1 | 64066 | 1 | 0 | 0 | 0 | 0 | 0 | 0 | 0 |
| 2856 | RTA00000419F.h.21.1 | 64828 | 1 | 0 | 0 | 0 | 0 | 0 | 0 | 0 |
| 2865 | RTA00000121A.a.2.1 | 81843 | 1 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 2866 | RTA00000527F.g.13.1 | 36035 | 2 | 0 | 0 | 0 | 0 | 0 | 0 | 0 |
| 2869 | RTA00000426F.h.11.1 | 75479 | 1 | 0 | 0 | 0 | 0 | 0 | 0 | 0 |
| 2874 | RTA00000522F.b.22.1 | 75181 | 1 | 0 | 0 | 0 | 0 | 0 | 0 | 0 |
| 2877 | RTA00000522F.a.23.1 | 38613 | 2 | 0 | 0 | 0 | 0 | 0 | 0 | 0 |
| 2879 | RTA00000523F.b.02.1 | 65163 | 1 | 0 | 0 | 0 | 0 | 0 | 0 | 0 |
| 2880 | RTA00000425F.j.14.1 | 73397 | 1 | 0 | 0 | 0 | 0 | 0 | 0 | 0 |
| 2883 | RTA00000522F.e.16.1 | 75283 | 1 | 0 | 0 | 0 | 0 | 0 | 0 | 0 |
| 2886 | RTA00000523F.h.17.1 | 65586 | 1 | 0 | 0 | 0 | 0 | 0 | 0 | 0 |
| 2888 | RTA00000522F.p.07.1 | 76888 | 1 | 0 | 0 | 0 | 0 | 0 | 0 | 0 |
| 2889 | RTA00000522F.n.08.1 | 76343 | 1 | 0 | 0 | 0 | 0 | 0 | 0 | 0 |
| 2890 | RTA00000425F.c.06.1 | 78041 | 1 | 0 | 0 | 0 | 0 | 0 | 0 | 0 |
| 2891 | RTA00000427F.b.23.1 | 64297 | 1 | 0 | 0 | 0 | 0 | 0 | 0 | 0 |
| 2892 | RTA00000527F.p.02.1 | 36844 | 2 | 0 | 0 | 0 | 0 | 0 | 0 | 0 |
| 2893 | RTA00000427F.d.08.1 | 63967 | 1 | 0 | 0 | 0 | 0 | 0 | 0 | 0 |
| 2895 | RTA00000426F.m.07.1 | 63504 | 1 | 0 | 0 | 0 | 0 | 0 | 0 | 0 |
| 2896 | RTA00000427F.c.10.1 | 65478 | 1 | 0 | 0 | 0 | 0 | 0 | 0 | 0 |
| 2899 | RTA00000424F.m.15.1 | 73759 | 1 | 0 | 0 | 0 | 0 | 0 | 0 | 0 |
| 2900 | RTA00000426F.f.11.1 | 63102 | 1 | 0 | 0 | 0 | 0 | 0 | 0 | 0 |
| 2902 | RTA00000426F.f.20.1 | 65134 | 1 | 0 | 0 | 0 | 0 | 0 | 0 | 0 |
| 2907 | RTA00000527F.i.19.2 | 38089 | 2 | 0 | 0 | 0 | 0 | 0 | 0 | 0 |
| 2912 | RTA00000523F.e.18.1 | 62898 | 1 | 0 | 0 | 0 | 0 | 0 | 0 | 0 |
| 2913 | RTA00000527F.k.21.1 | 36051 | 2 | 0 | 0 | 0 | 0 | 0 | 0 | 0 |
| 2916 | RTA00000522F.n.02.1 | 74959 | 1 | 0 | 0 | 0 | 0 | 0 | 0 | 0 |
| 2919 | RTA00000425F.f.19.1 | 32635 | 1 | 1 | 0 | 0 | 0 | 0 | 0 | 0 |
| 2920 | RTA00000528F.e.23.1 | 19242 | 3 | 0 | 0 | 0 | 0 | 0 | 0 | 0 |
| 2921 | RTA00000522F.n.16.1 | 26769 | 1 | 0 | 0 | 0 | 0 | 0 | 0 | 0 |
| 2922 | RTA00000427F.c.20.1 | 26527 | 1 | 0 | 0 | 0 | 0 | 0 | 0 | 0 |
| 2923 | RTA00000527F.k.06.1 | 12469 | 3 | 1 | 0 | 0 | 0 | 0 | 0 | 0 |
| 2925 | RTA00000523F.i.06.1 | 66341 | 1 | 0 | 0 | 0 | 0 | 0 | 0 | 0 |
| 2926 | RTA00000427F.f.21.1 | 36853 | 2 | 0 | 0 | 0 | 0 | 0 | 0 | 0 |
| 2927 | RTA00000427F.j.19.1 | 41395 | 1 | 1 | 0 | 0 | 0 | 0 | 0 | 0 |
| 2928 | RTA00000522F.b.01.1 | 75691 | 1 | 0 | 0 | 0 | 0 | 0 | 0 | 0 |
| 2929 | RTA00000424F.i.24.1 | 79101 | 1 | 0 | 0 | 0 | 0 | 0 | 0 | 0 |
| 2930 | RTA00000523F.c.01.1 | 65710 | 1 | 0 | 0 | 0 | 0 | 0 | 0 | 0 |
| 2931 | RTA00000427F.b.15.1 | 66891 | 1 | 0 | 0 | 0 | 0 | 0 | 0 | 0 |
| 2934 | RTA00000522F.j.15.2 | 76535 | 1 | 0 | 0 | 0 | 0 | 0 | 0 | 0 |
| 2937 | RTA00000426F.f.19.1 | 66701 | 1 | 0 | 1 | 0 | 0 | 0 | 0 | 0 |
| 2940 | RTA00000523F.i.22.1 | 64688 | 1 | 0 | 0 | 0 | 0 | 0 | 0 | 0 |
| 2942 | RTA00000425F.i.17.1 | 43213 | 1 | 1 | 0 | 0 | 0 | 0 | 0 | 0 |
| 2945 | RTA00000425F.p.12.1 | 73219 | 1 | 0 | 0 | 0 | 0 | 0 | 0 | 0 |
| 2946 | RTA00000427F.j.07.1 | 64819 | 1 | 0 | 0 | 0 | 0 | 0 | 0 | 0 |
| 2948 | RTA00000527F.i.05.2 | 37481 | 2 | 0 | 0 | 0 | 0 | 0 | 0 | 0 |
| 2951 | RTA00000523F.k.01.1 | 41437 | 1 | 1 | 0 | 0 | 0 | 0 | 0 | 0 |
| 2952 | RTA00000425F.j.11.1 | 76667 | 1 | 0 | 0 | 0 | 0 | 0 | 0 | 0 |
| 2953 | RTA00000424F.b.22.4 | 72971 | 1 | 0 | 0 | 0 | 0 | 0 | 0 | 0 |
| 2955 | RTA00000525F.a.03.1 | 36786 | 2 | 0 | 0 | 0 | 0 | 0 | 0 | 0 |
| 2956 | RTA00000527F.i.21.2 | 37490 | 2 | 0 | 0 | 0 | 0 | 0 | 0 | 0 |
| 2957 | RTA00000424F.a.24.4 | 73951 | 1 | 0 | 0 | 0 | 0 | 0 | 0 | 0 |
| 2958 | RTA00000522F.k.14.1 | 74280 | 1 | 0 | 0 | 0 | 0 | 0 | 0 | 0 |
| 2959 | RTA00000522F.n.05.1 | 73260 | 1 | 0 | 0 | 0 | 0 | 0 | 0 | 0 |
| 2960 | RTA00000523F.c.18.1 | 66179 | 1 | 0 | 0 | 0 | 0 | 0 | 0 | 0 |
| 2961 | RTA00000523F.b.13.1 | 66330 | 1 | 0 | 0 | 0 | 0 | 0 | 0 | 0 |
| 2963 | RTA00000527F.p.16.1 | 23798 | 2 | 1 | 0 | 0 | 0 | 0 | 0 | 0 |
| 2964 | RTA00000425F.c.20.1 | 73581 | 1 | 0 | 0 | 0 | 0 | 0 | 0 | 0 |
| 2965 | RTA00000424F.i.21.1 | 73482 | 1 | 0 | 0 | 0 | 0 | 0 | 0 | 0 |
| 2966 | RTA00000523F.j.19.1 | 65910 | 1 | 0 | 0 | 0 | 0 | 0 | 0 | 0 |
| 2968 | RTA00000424F.b.22.1 | 72971 | 1 | 0 | 0 | 0 | 0 | 0 | 0 | 0 |
| 2969 | RTA00000527F.b.18.1 | 37469 | 2 | 0 | 0 | 0 | 0 | 0 | 0 | 0 |
| 2973 | RTA00000525F.e.16.1 | 36837 | 2 | 0 | 0 | 0 | 0 | 0 | 0 | 0 |
| 2975 | RTA00000522F.d.08.1 | 74284 | 1 | 0 | 0 | 0 | 0 | 0 | 0 | 0 |
| 2978 | RTA00000527F.g.07.1 | 37488 | 2 | 0 | 0 | 0 | 0 | 0 | 0 | 0 |
| 2980 | RTA00000525F.b.05.1 | 21116 | 2 | 1 | 0 | 0 | 0 | 0 | 0 | 0 |
| 2981 | RTA00000425F.n.05.1 | 73965 | 1 | 0 | 0 | 0 | 0 | 0 | 0 | 0 |
| 2982 | RTA00000523F.d.18.1 | 64072 | 1 | 0 | 0 | 0 | 0 | 0 | 0 | 0 |
| 2983 | RTA00000525F.a.02.1 | 37454 | 2 | 0 | 0 | 0 | 0 | 0 | 0 | 0 |
| 2985 | RTA00000426F.h.09.1 | 78797 | 1 | 0 | 0 | 0 | 0 | 0 | 0 | 0 |
| 2988 | RTA00000427F.g.05.1 | 63138 | 1 | 0 | 0 | 0 | 0 | 0 | 0 | 0 |
| 2989 | RTA00000424F.m.12.1 | 77675 | 1 | 0 | 0 | 0 | 0 | 0 | 0 | 0 |
| 2995 | RTA00000427F.h.12.1 | 36894 | 2 | 0 | 0 | 0 | 0 | 0 | 0 | 0 |
| 2996 | RTA00000523F.c.15.1 | 36935 | 2 | 0 | 0 | 0 | 0 | 0 | 0 | 0 |
| 2997 | RTA00000427F.k.17.1 | 64965 | 1 | 0 | 0 | 0 | 0 | 0 | 0 | 0 |
| 2999 | RTA00000424F.c.14.3 | 76614 | 1 | 0 | 0 | 0 | 0 | 0 | 0 | 0 |
| 3000 | RTA00000522F.k.10.2 | 77619 | 1 | 0 | 0 | 0 | 0 | 0 | 0 | 0 |
| 3001 | RTA00000424F.m.22.1 | 72943 | 1 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 3002 | RTA00000527F.h.17.1 | 37799 | 2 | 0 | 0 | 0 | 0 | 0 | 0 | 0 |
| 3003 | RTA00000527F.c.22.1 | 37496 | 2 | 0 | 0 | 0 | 0 | 0 | 0 | 0 |
| 3004 | RTA00000425F.k.22.1 | 78123 | 1 | 0 | 0 | 0 | 0 | 0 | 0 | 0 |
| 3005 | RTA00000424F.m.14.1 | 77491 | 1 | 0 | 0 | 0 | 0 | 0 | 0 | 0 |
| 3006 | RTA00000522F.k.19.1 | 32625 | 1 | 1 | 0 | 0 | 0 | 0 | 0 | 0 |
| 3007 | RTA00000523F.i.18.1 | 64463 | 1 | 0 | 0 | 0 | 0 | 0 | 0 | 0 |
| 3008 | RTA00000425F.j.22.1 | 73882 | 1 | 0 | 0 | 0 | 0 | 0 | 0 | 0 |
| 3009 | RTA00000527F.g.23.1 | 37538 | 2 | 0 | 0 | 0 | 0 | 0 | 0 | 0 |
| 3010 | RTA00000426F.m.24.1 | 63943 | 1 | 0 | 0 | 0 | 0 | 0 | 0 | 0 |
| 3012 | RTA00000425F.d.21.1 | 78920 | 1 | 0 | 0 | 0 | 0 | 0 | 0 | 0 |
| 3014 | RTA00000424F.d.04.3 | 76505 | 1 | 0 | 0 | 0 | 0 | 0 | 0 | 0 |
| 3015 | RTA00000424F.d.04.1 | 76505 | 1 | 0 | 0 | 0 | 0 | 0 | 0 | 0 |
| 3016 | RTA00000427F.c.12.1 | 66995 | 1 | 0 | 0 | 0 | 0 | 0 | 0 | 0 |
| 3018 | RTA00000527F.l.13.1 | 36904 | 2 | 0 | 0 | 0 | 0 | 0 | 0 | 0 |
| 3019 | RTA00000522F.h.13.1 | 40823 | 1 | 1 | 0 | 0 | 0 | 0 | 0 | 0 |
| 3020 | RTA00000424F.l.19.1 | 75454 | 1 | 0 | 0 | 0 | 0 | 0 | 0 | 0 |
| 3023 | RTA00000427F.a.06.1 | 66550 | 1 | 0 | 0 | 0 | 0 | 0 | 0 | 0 |
| 3024 | RTA00000525F.c.19.1 | 38159 | 2 | 0 | 0 | 0 | 0 | 0 | 0 | 0 |
| 3025 | RTA00000523F.f.06.1 | 62871 | 1 | 0 | 0 | 0 | 0 | 0 | 0 | 0 |
| 3026 | RTA00000424F.h.10.1 | 72925 | 1 | 0 | 0 | 0 | 0 | 0 | 0 | 0 |
| 3027 | RTA00000522F.a.12.1 | 33515 | 1 | 1 | 0 | 0 | 0 | 0 | 0 | 0 |
| 3028 | RTA00000522F.h.01.1 | 75010 | 1 | 0 | 0 | 0 | 0 | 0 | 0 | 0 |
| 3030 | RTA00000425F.e.21.1 | 77203 | 1 | 0 | 0 | 0 | 0 | 0 | 0 | 0 |
| 3031 | RTA00000523F.f.07.1 | 62799 | 1 | 0 | 0 | 0 | 0 | 0 | 0 | 0 |
| 3033 | RTA00000424F.j.12.1 | 73827 | 1 | 0 | 0 | 0 | 0 | 0 | 0 | 0 |
| 3035 | RTA00000523F.d.12.1 | 64888 | 1 | 0 | 0 | 0 | 0 | 0 | 0 | 0 |
| 3036 | RTA00000523F.e.10.1 | 62878 | 1 | 0 | 0 | 0 | 0 | 0 | 0 | 0 |
| 3037 | RTA00000425F.f.11.1 | 79275 | 1 | 0 | 0 | 0 | 0 | 0 | 0 | 0 |
| 3038 | RTA00000426F.m.18.1 | 62974 | 1 | 0 | 0 | 0 | 0 | 0 | 0 | 0 |
| 3041 | RTA00000522F.g.15.1 | 76536 | 1 | 0 | 0 | 0 | 0 | 0 | 0 | 0 |
| 3042 | RTA00000522F.n.12.1 | 74117 | 1 | 0 | 0 | 0 | 0 | 0 | 0 | 0 |
| 3044 | RTA00000424F.d.10.3 | 73110 | 1 | 0 | 0 | 0 | 0 | 0 | 0 | 0 |
| 3048 | RTA00000527F.c.04.1 | 23090 | 3 | 0 | 0 | 0 | 0 | 0 | 0 | 0 |
| 3050 | RTA00000527F.h.21.1 | 37630 | 2 | 0 | 0 | 0 | 0 | 0 | 0 | 0 |
| 3051 | RTA00000425F.c.07.1 | 76042 | 1 | 0 | 0 | 0 | 0 | 0 | 0 | 0 |
| 3053 | RTA00000525F.c.15.1 | 7692 | 2 | 0 | 0 | 0 | 0 | 0 | 0 | 0 |
| 3054 | RTA00000424F.d.22.3 | 76189 | 1 | 0 | 0 | 0 | 0 | 0 | 0 | 0 |
| 3055 | RTA00000523F.h.12.1 | 65745 | 1 | 0 | 0 | 0 | 0 | 0 | 0 | 0 |
| 3056 | RTA00000522F.g.22.1 | 77504 | 1 | 0 | 0 | 0 | 0 | 0 | 0 | 0 |
| 3059 | RTA00000522F.j.12.2 | 74341 | 1 | 0 | 0 | 0 | 0 | 0 | 0 | 0 |
| 3060 | RTA00000523F.i.08.1 | 65099 | 1 | 0 | 0 | 0 | 0 | 0 | 0 | 0 |
| 3062 | RTA00000425F.j.20.1 | 26760 | 1 | 0 | 0 | 0 | 0 | 0 | 0 | 0 |
| 3064 | RTA00000427F.f.24.1 | 64572 | 1 | 0 | 0 | 0 | 0 | 0 | 0 | 0 |
| 3065 | RTA00000527F.a.13.1 | 37740 | 2 | 0 | 0 | 0 | 0 | 0 | 0 | 0 |
| 3069 | RTA00000424F.a.09.4 | 77833 | 1 | 0 | 0 | 0 | 0 | 0 | 0 | 0 |
| 3071 | RTA00000525F.f.07.1 | 37500 | 2 | 0 | 0 | 0 | 0 | 0 | 0 | 0 |
| 3072 | RTA00000424F.j.07.1 | 79211 | 1 | 0 | 0 | 0 | 0 | 0 | 0 | 0 |
| 3073 | RTA00000424F.m.10.1 | 34251 | 1 | 1 | 0 | 0 | 0 | 0 | 0 | 0 |
| 3075 | RTA00000522F.g.06.1 | 78221 | 1 | 0 | 0 | 0 | 0 | 0 | 0 | 0 |
| 3076 | RTA00000424F.h.03.1 | 74447 | 1 | 0 | 0 | 0 | 0 | 0 | 0 | 0 |
| 3077 | RTA00000424F.n.06.1 | 74737 | 1 | 0 | 0 | 0 | 0 | 0 | 0 | 0 |
| 3078 | RTA00000427F.c.22.1 | 63990 | 1 | 0 | 0 | 0 | 0 | 0 | 0 | 0 |
| 3079 | RTA00000424F.k.12.1 | 77666 | 1 | 0 | 0 | 0 | 0 | 0 | 0 | 0 |
| 3080 | RTA00000425F.f.02.1 | 76982 | 1 | 0 | 0 | 0 | 0 | 0 | 0 | 0 |
| 3081 | RTA00000427F.h.11.1 | 26494 | 1 | 0 | 0 | 0 | 0 | 0 | 0 | 0 |
| 3082 | RTA00000425F.j.16.1 | 75631 | 1 | 0 | 0 | 0 | 0 | 0 | 0 | 0 |
| 3084 | RTA00000427F.f.17.1 | 63803 | 1 | 0 | 0 | 0 | 0 | 0 | 0 | 0 |
| 3085 | RTA00000522F.o.18.1 | 76366 | 1 | 0 | 0 | 0 | 0 | 0 | 0 | 0 |
| 3086 | RTA00000427F.j.22.1 | 66367 | 1 | 0 | 0 | 0 | 0 | 0 | 0 | 0 |
| 3087 | RTA00000426F.p.10.1 | 65845 | 1 | 0 | 0 | 0 | 0 | 0 | 0 | 0 |
| 3088 | RTA00000522F.m.02.1 | 76834 | 1 | 0 | 0 | 0 | 0 | 0 | 0 | 0 |
| 3091 | RTA00000425F.e.15.1 | 75921 | 1 | 0 | 0 | 0 | 0 | 0 | 0 | 0 |
| 3094 | RTA00000424F.n.13.1 | 74942 | 1 | 0 | 0 | 0 | 0 | 0 | 0 | 0 |
| 3095 | RTA00000424F.g.14.1 | 74879 | 1 | 0 | 0 | 0 | 0 | 0 | 0 | 0 |
| 3096 | RTA00000426F.e.17.1 | 64089 | 1 | 0 | 0 | 0 | 0 | 0 | 0 | 0 |
| 3100 | RTA00000427F.g.19.1 | 64611 | 1 | 0 | 0 | 0 | 0 | 0 | 0 | 0 |
| 3102 | RTA00000522F.c.01.1 | 74938 | 1 | 0 | 0 | 0 | 0 | 0 | 0 | 0 |
| 3103 | RTA00000522F.g.17.1 | 76486 | 1 | 0 | 0 | 0 | 0 | 0 | 0 | 0 |
| 3104 | RTA00000523F.j.17.1 | 63610 | 1 | 0 | 0 | 0 | 0 | 0 | 0 | 0 |
| 3105 | RTA00000522F.n.14.1 | 73410 | 1 | 0 | 0 | 0 | 0 | 0 | 1 | 0 |
| 3107 | RTA00000523F.e.20.1 | 65164 | 1 | 0 | 0 | 0 | 0 | 0 | 0 | 0 |
| 3108 | RTA00000424F.c.15.3 | 73533 | 1 | 0 | 0 | 0 | 0 | 0 | 0 | 0 |
| 3109 | RTA00000426F.p.09.1 | 66665 | 1 | 0 | 0 | 0 | 0 | 0 | 0 | 0 |
| 3110 | RTA00000522F.p.09.1 | 75204 | 1 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 3111 | RTA00000426F.m.21.1 | 64915 | 1 | 0 | 0 | 0 | 0 | 0 | 0 | 0 |
| 3112 | RTA00000425F.j.21.1 | 77373 | 1 | 0 | 0 | 0 | 0 | 0 | 0 | 0 |
| 3114 | RTA00000523F.h.21.1 | 41440 | 1 | 1 | 0 | 0 | 0 | 0 | 0 | 0 |
| 3115 | RTA00000427F.h.24.1 | 65193 | 1 | 0 | 0 | 0 | 0 | 0 | 0 | 0 |
| 3116 | RTA00000425F.f.24.1 | 40841 | 1 | 1 | 0 | 0 | 0 | 0 | 0 | 0 |
| 3117 | RTA00000425F.m.03.1 | 76045 | 1 | 0 | 0 | 0 | 0 | 0 | 0 | 0 |
| 3118 | RTA00000426F.m.08.1 | 63781 | 1 | 0 | 0 | 0 | 0 | 0 | 0 | 0 |
| 3119 | RTA00000523F.d.24.1 | 64799 | 1 | 0 | 0 | 0 | 0 | 0 | 0 | 0 |
| 3120 | RTA00000523F.c.14.1 | 66015 | 1 | 0 | 0 | 0 | 0 | 0 | 0 | 0 |
| 3121 | RTA00000523F.b.20.1 | 66492 | 1 | 0 | 0 | 0 | 0 | 0 | 0 | 0 |
| 3122 | RTA00000522F.h.07.1 | 75149 | 1 | 0 | 0 | 0 | 0 | 0 | 0 | 0 |
| 3123 | RTA00000527F.g.10.1 | 37820 | 2 | 0 | 0 | 0 | 0 | 0 | 0 | 0 |
| 3126 | RTA00000427F.i.22.1 | 63199 | 1 | 0 | 0 | 0 | 0 | 0 | 0 | 0 |
| 3128 | RTA00000527F.n.07.1 | 15939 | 2 | 2 | 0 | 0 | 0 | 0 | 0 | 0 |
| 3129 | RTA00000425F.e.09.1 | 75550 | 1 | 0 | 0 | 0 | 0 | 0 | 0 | 0 |
| 3130 | RTA00000427F.h.02.1 | 63652 | 1 | 0 | 0 | 0 | 0 | 0 | 0 | 0 |
| 3131 | RTA00000426F.f.16.1 | 65613 | 1 | 0 | 0 | 0 | 0 | 0 | 0 | 0 |
| 3132 | RTA00000425F.i.21.1 | 75305 | 1 | 0 | 0 | 0 | 0 | 0 | 0 | 0 |
| 3133 | RTA00000427F.k.19.1 | 62851 | 1 | 0 | 0 | 0 | 0 | 0 | 0 | 0 |
| 3135 | RTA00000426F.g.16.1 | 41446 | 1 | 1 | 0 | 0 | 0 | 0 | 0 | 0 |
| 3136 | RTA00000527F.l.05.1 | 13016 | 4 | 0 | 0 | 1 | 1 | 0 | 0 | 0 |
| 3137 | RTA00000426F.m.02.1 | 66237 | 1 | 0 | 0 | 0 | 0 | 0 | 0 | 0 |
| 3140 | RTA00000522F.l.22.1 | 75801 | 1 | 0 | 0 | 0 | 0 | 0 | 0 | 0 |
| 3141 | RTA00000427F.h.19.1 | 63047 | 1 | 0 | 0 | 0 | 0 | 0 | 0 | 0 |
| 3143 | RTA00000522F.g.21.1 | 77310 | 1 | 0 | 0 | 0 | 0 | 0 | 0 | 0 |
| 3145 | RTA00000522F.g.20.1 | 77688 | 1 | 0 | 0 | 0 | 0 | 0 | 0 | 0 |
| 3148 | RTA00000425F.k.20.1 | 74048 | 1 | 0 | 0 | 0 | 0 | 0 | 0 | 0 |
| 3150 | RTA00000522F.b.07.1 | 78634 | 1 | 0 | 0 | 0 | 0 | 0 | 0 | 0 |
| 3151 | RTA00000426F.g.19.1 | 63672 | 1 | 0 | 0 | 0 | 0 | 0 | 0 | 0 |
| 3152 | RTA00000525F.d.19.1 | 36860 | 2 | 0 | 0 | 0 | 0 | 0 | 0 | 0 |
| 3154 | RTA00000427F.d.10.1 | 40685 | 1 | 1 | 0 | 0 | 0 | 0 | 0 | 0 |
| 3157 | RTA00000424F.a.05.4 | 77976 | 1 | 0 | 0 | 0 | 0 | 0 | 0 | 0 |
| 3159 | RTA00000424F.a.05.1 | 77976 | 1 | 0 | 0 | 0 | 0 | 0 | 0 | 0 |
| 3160 | RTA00000522F.l.15.1 | 74691 | 1 | 0 | 0 | 0 | 0 | 0 | 0 | 0 |
| 3161 | RTA00000425F.e.02.1 | 76143 | 1 | 0 | 0 | 0 | 0 | 0 | 0 | 0 |
| 3162 | RTA00000525F.c.11.1 | 37895 | 2 | 0 | 0 | 0 | 0 | 0 | 0 | 0 |
| 3164 | RTA00000522F.c.14.1 | 75449 | 1 | 0 | 0 | 0 | 0 | 0 | 0 | 0 |
| 3165 | RTA00000424F.m.08.1 | 19402 | 1 | 2 | 0 | 0 | 0 | 0 | 0 | 0 |
| 3166 | RTA00000527F.f.18.1 | 37577 | 2 | 0 | 0 | 0 | 0 | 0 | 0 | 0 |
| 3168 | RTA00000522F.a.06.1 | 73662 | 1 | 0 | 0 | 0 | 0 | 0 | 0 | 0 |
| 3171 | RTA00000522F.d.23.1 | 73868 | 1 | 0 | 0 | 0 | 0 | 0 | 0 | 0 |
| 3174 | RTA00000523F.j.10.1 | 63384 | 1 | 0 | 0 | 0 | 0 | 0 | 0 | 0 |
| 3175 | RTA00000527F.p.08.1 | 36013 | 2 | 0 | 0 | 0 | 0 | 0 | 0 | 0 |
| 3177 | RTA00000426F.f.17.1 | 66334 | 1 | 0 | 0 | 0 | 0 | 0 | 0 | 0 |
| 3178 | RTA00000523F.j.21.1 | 36925 | 2 | 0 | 0 | 0 | 0 | 0 | 0 | 0 |
| 3183 | RTA00000523F.a.01.1 | 74923 | 1 | 0 | 0 | 0 | 0 | 0 | 0 | 0 |
| 3185 | RTA00000427F.j.06.1 | 63676 | 1 | 0 | 0 | 0 | 0 | 0 | 0 | 0 |
| 3186 | RTA00000424F.m.04.1 | 79017 | 1 | 0 | 0 | 0 | 0 | 0 | 0 | 0 |
| 3187 | RTA00000523F.i.17.1 | 65779 | 1 | 0 | 0 | 0 | 0 | 0 | 0 | 0 |
| 3190 | RTA00000525F.c.18.1 | 24208 | 2 | 1 | 0 | 0 | 0 | 0 | 0 | 0 |
| 3191 | RTA00000527F.e.09.1 | 37521 | 2 | 0 | 0 | 0 | 0 | 0 | 0 | 0 |
| 3192 | RTA00000424F.j.08.1 | 73972 | 1 | 0 | 0 | 0 | 0 | 0 | 0 | 0 |
| 3194 | RTA00000527F.c.09.1 | 64859 | 1 | 0 | 0 | 0 | 0 | 0 | 0 | 0 |
| 3197 | RTA00000523F.c.03.1 | 36913 | 2 | 0 | 0 | 0 | 0 | 0 | 0 | 0 |
| 3198 | RTA00000427F.k.21.1 | 62880 | 1 | 0 | 0 | 0 | 0 | 0 | 0 | 0 |
| 3200 | RTA00000427F.d.09.1 | 66486 | 1 | 0 | 0 | 0 | 0 | 0 | 0 | 0 |
| 3201 | RTA00000426F.n.17.1 | 66572 | 1 | 0 | 0 | 0 | 0 | 0 | 0 | 0 |
| 3204 | RTA00000426F.m.03.1 | 66480 | 1 | 0 | 0 | 0 | 0 | 0 | 0 | 0 |
| 3205 | RTA00000424F.h.06.1 | 77552 | 1 | 0 | 0 | 0 | 0 | 0 | 0 | 0 |
| 3206 | RTA00000425F.d.06.1 | 77660 | 1 | 0 | 0 | 0 | 0 | 0 | 0 | 0 |
| 3207 | RTA00000427F.e.12.1 | 62813 | 1 | 0 | 0 | 0 | 0 | 0 | 0 | 0 |
| 3210 | RTA00000426F.n.23.1 | 18176 | 1 | 0 | 0 | 0 | 0 | 0 | 0 | 0 |
| 3211 | RTA00000522F.m.19.1 | 41544 | 1 | 1 | 0 | 0 | 0 | 0 | 0 | 0 |
| 3212 | RTA00000522F.a.05.1 | 32611 | 1 | 1 | 0 | 0 | 0 | 0 | 0 | 0 |
| 3213 | RTA00000427F.i.09.1 | 65916 | 1 | 0 | 0 | 0 | 0 | 0 | 0 | 0 |
| 3214 | RTA00000424F.j.09.1 | 74387 | 1 | 0 | 0 | 0 | 0 | 0 | 0 | 0 |
| 3215 | RTA00000424F.n.11.1 | 73874 | 1 | 0 | 0 | 0 | 0 | 0 | 0 | 0 |
| 3217 | RTA00000527F.e.13.1 | 37588 | 2 | 0 | 0 | 0 | 0 | 0 | 0 | 0 |
| 3219 | RTA00000425F.j.19.1 | 77925 | 1 | 0 | 0 | 0 | 0 | 0 | 0 | 0 |
| 3220 | RTA00000522F.g.12.1 | 78783 | 1 | 0 | 0 | 0 | 0 | 0 | 0 | 0 |
| 3221 | RTA00000523F.a.07.1 | 75804 | 1 | 0 | 0 | 0 | 0 | 0 | 0 | 0 |
| 3222 | RTA00000425F.e.19.1 | 73409 | 1 | 0 | 0 | 0 | 0 | 0 | 0 | 0 |
| 3223 | RTA00000425F.n.19.1 | 78324 | 1 | 0 | 0 | 0 | 0 | 0 | 0 | 0 |
| 3228 | RTA00000427F.k.07.1 | 63742 | 1 | 0 | 0 | 0 | 0 | 0 | 0 | 0 |

TABLE 35-continued

Polynucleotides Specifically Expressed in Colon

| SEQ ID NO: | Sequence Name | cluster | lib 1 clones | lib 2 clones | lib 15 clones | lib 16 clones | lib 17 clones | lib 18 clones | lib 19 clones | lib 20 clones |
|---|---|---|---|---|---|---|---|---|---|---|
| 3231 | RTA00000522F.a.17.1 | 79032 | 1 | 0 | 0 | 0 | 0 | 0 | 0 | 0 |
| 3232 | RTA00000527F.l.19.1 | 36856 | 2 | 0 | 0 | 0 | 0 | 0 | 0 | 0 |
| 3233 | RTA00000424F.i.11.1 | 41569 | 1 | 1 | 0 | 0 | 0 | 0 | 0 | 0 |
| 3235 | RTA00000424F.d.19.3 | 73180 | 1 | 0 | 0 | 0 | 0 | 0 | 0 | 0 |
| 3236 | RTA00000522F.j.09.2 | 78522 | 1 | 0 | 0 | 0 | 0 | 0 | 0 | 0 |
| 3237 | RTA00000424F.m.24.1 | 77045 | 1 | 0 | 0 | 0 | 0 | 0 | 0 | 0 |
| 3238 | RTA00000522F.j.19.2 | 76224 | 1 | 0 | 0 | 0 | 0 | 0 | 0 | 0 |
| 3242 | RTA00000527F.j.12.2 | 37503 | 2 | 0 | 0 | 0 | 0 | 0 | 0 | 0 |
| 3243 | RTA00000522F.g.11.1 | 75432 | 1 | 0 | 0 | 0 | 0 | 0 | 0 | 0 |
| 3244 | RTA00000522F.k.02.2 | 77622 | 1 | 0 | 0 | 0 | 0 | 0 | 0 | 0 |
| 3245 | RTA00000427F.e.13.1 | 66080 | 1 | 0 | 0 | 0 | 0 | 0 | 0 | 0 |
| 3246 | RTA00000426F.f.18.1 | 63271 | 1 | 0 | 0 | 0 | 0 | 0 | 0 | 0 |
| 3247 | RTA00000427F.a.12.1 | 63377 | 1 | 0 | 0 | 0 | 0 | 0 | 0 | 0 |
| 3248 | RTA00000424F.b.23.4 | 77322 | 1 | 0 | 0 | 0 | 0 | 0 | 0 | 0 |
| 3252 | RTA00000427F.f.02.1 | 36822 | 2 | 0 | 0 | 0 | 0 | 0 | 0 | 0 |
| 3254 | RTA00000424F.i.15.1 | 78043 | 1 | 0 | 0 | 0 | 0 | 0 | 0 | 0 |
| 3256 | RTA00000522F.m.03.1 | 79194 | 1 | 0 | 0 | 0 | 0 | 0 | 0 | 0 |
| 3257 | RTA00000522F.a.20.1 | 74070 | 1 | 0 | 0 | 0 | 0 | 0 | 0 | 0 |
| 3258 | RTA00000424F.b.15.4 | 74958 | 1 | 0 | 0 | 0 | 0 | 0 | 0 | 0 |
| 3259 | RTA00000527F.g.14.1 | 37532 | 2 | 0 | 0 | 0 | 0 | 0 | 0 | 0 |
| 3260 | RTA00000522F.d.06.1 | 74809 | 1 | 0 | 0 | 0 | 0 | 0 | 0 | 0 |
| 3262 | RTA00000427F.e.10.1 | 64599 | 1 | 0 | 0 | 0 | 0 | 0 | 0 | 0 |
| 3263 | RTA00000527F.c.16.1 | 22908 | 3 | 0 | 0 | 0 | 0 | 0 | 0 | 0 |
| 3265 | RTA00000523F.f.17.1 | 63984 | 1 | 0 | 0 | 0 | 0 | 0 | 0 | 0 |
| 3267 | RTA00000527F.p.24.1 | 36832 | 2 | 0 | 0 | 0 | 0 | 0 | 0 | 0 |
| 3268 | RTA00000425F.n.17.1 | 78304 | 1 | 0 | 0 | 0 | 0 | 0 | 0 | 0 |
| 3270 | RTA00000425F.e.07.1 | 75992 | 1 | 0 | 0 | 0 | 0 | 0 | 0 | 0 |
| 3272 | RTA00000523F.h.08.1 | 62893 | 1 | 0 | 0 | 0 | 0 | 0 | 0 | 0 |
| 3273 | RTA00000522F.o.10.1 | 78798 | 1 | 0 | 0 | 0 | 0 | 0 | 0 | 0 |
| 3274 | RTA00000425F.l.10.1 | 26893 | 1 | 0 | 0 | 0 | 0 | 0 | 0 | 0 |
| 3275 | RTA00000427F.f.16.1 | 64122 | 1 | 0 | 0 | 0 | 0 | 0 | 0 | 0 |
| 3278 | RTA00000425F.i.10.1 | 78736 | 1 | 0 | 0 | 0 | 0 | 0 | 0 | 0 |
| 3279 | RTA00000426F.m.12.1 | 63740 | 1 | 0 | 0 | 0 | 0 | 0 | 0 | 0 |
| 3280 | RTA00000527F.g.12.1 | 37746 | 2 | 0 | 0 | 0 | 0 | 0 | 0 | 0 |
| 3283 | RTA00000425F.i.18.1 | 42255 | 1 | 1 | 0 | 0 | 0 | 0 | 0 | 0 |
| 3285 | RTA00000424F.j.13.1 | 74485 | 1 | 0 | 0 | 0 | 0 | 0 | 0 | 0 |
| 3289 | RTA00000424F.k.10.1 | 73232 | 1 | 0 | 0 | 0 | 0 | 0 | 0 | 0 |
| 3290 | RTA00000522F.i.07.2 | 78377 | 1 | 0 | 0 | 0 | 0 | 0 | 0 | 0 |
| 3292 | RTA00000522F.b.08.1 | 26915 | 1 | 0 | 0 | 0 | 0 | 0 | 0 | 0 |
| 3293 | RTA00000522F.l.08.1 | 78781 | 1 | 0 | 0 | 0 | 0 | 0 | 0 | 0 |
| 3294 | RTA00000525F.a.14.1 | 37566 | 2 | 0 | 0 | 0 | 0 | 0 | 0 | 0 |
| 3295 | RTA00000424F.g.08.1 | 74928 | 1 | 0 | 0 | 0 | 0 | 0 | 0 | 0 |
| 3296 | RTA00000425F.l.09.1 | 75251 | 1 | 0 | 0 | 0 | 0 | 0 | 0 | 0 |
| 3297 | RTA00000522F.o.20.1 | 74853 | 1 | 0 | 0 | 0 | 0 | 0 | 0 | 0 |
| 3298 | RTA00000527F.j.04.2 | 11809 | 3 | 1 | 0 | 0 | 0 | 0 | 0 | 0 |
| 3300 | RTA00000523F.c.13.1 | 40668 | 1 | 1 | 0 | 0 | 0 | 0 | 0 | 0 |
| 3301 | RTA00000427F.i.21.1 | 65540 | 1 | 0 | 0 | 0 | 0 | 0 | 0 | 0 |
| 3303 | RTA00000522F.h.02.1 | 74947 | 1 | 0 | 0 | 0 | 0 | 0 | 0 | 0 |
| 3304 | RTA00000522F.g.10.1 | 74294 | 1 | 0 | 0 | 0 | 0 | 0 | 0 | 0 |
| 3308 | RTA00000425F.k.16.1 | 75282 | 1 | 0 | 0 | 0 | 0 | 0 | 0 | 0 |
| 3309 | RTA00000525F.b.09.1 | 23472 | 2 | 1 | 0 | 0 | 0 | 0 | 0 | 0 |
| 3310 | RTA00000522F.j.08.2 | 76613 | 1 | 0 | 0 | 0 | 0 | 0 | 0 | 0 |
| 3312 | RTA00000523F.f.19.1 | 34169 | 1 | 1 | 0 | 0 | 0 | 0 | 0 | 0 |
| 3313 | RTA00000425F.j.18.1 | 75561 | 1 | 0 | 0 | 0 | 0 | 1 | 0 | 0 |
| 3314 | RTA00000426F.m.04.1 | 36865 | 2 | 0 | 0 | 0 | 0 | 0 | 0 | 0 |
| 3315 | RTA00000527F.g.21.1 | 36028 | 2 | 0 | 0 | 0 | 0 | 0 | 0 | 0 |
| 3317 | RTA00000525F.a.22.1 | 36848 | 2 | 0 | 0 | 0 | 0 | 0 | 0 | 0 |
| 3318 | RTA00000522F.p.22.1 | 73322 | 1 | 0 | 0 | 0 | 0 | 0 | 0 | 0 |
| 3319 | RTA00000424F.d.12.2 | 74342 | 1 | 0 | 0 | 0 | 0 | 0 | 0 | 0 |
| 3320 | RTA00000424F.g.24.1 | 79156 | 1 | 0 | 0 | 0 | 0 | 0 | 0 | 0 |
| 3321 | RTA00000427F.a.10.1 | 65370 | 1 | 0 | 0 | 0 | 0 | 0 | 0 | 0 |
| 3322 | RTA00000426F.h.20.1 | 23187 | 3 | 0 | 0 | 0 | 0 | 0 | 0 | 0 |
| 3323 | RTA00000424F.d.12.3 | 74342 | 1 | 0 | 0 | 0 | 0 | 0 | 0 | 0 |
| 3324 | RTA00000425F.c.03.1 | 74643 | 1 | 0 | 0 | 0 | 0 | 0 | 0 | 0 |
| 3325 | RTA00000523F.f.16.1 | 26522 | 1 | 0 | 0 | 0 | 0 | 0 | 0 | 0 |
| 3326 | RTA00000427F.f.15.1 | 66734 | 1 | 0 | 0 | 0 | 0 | 0 | 0 | 0 |
| 3329 | RTA00000522F.p.18.1 | 76376 | 1 | 0 | 0 | 0 | 0 | 0 | 0 | 0 |
| 3337 | RTA00000522F.g.18.1 | 73226 | 1 | 0 | 0 | 0 | 0 | 0 | 0 | 0 |
| 3339 | RTA00000522F.h.05.1 | 73358 | 1 | 0 | 0 | 0 | 0 | 0 | 0 | 0 |
| 3341 | RTA00000425F.n.16.1 | 18265 | 1 | 0 | 0 | 0 | 0 | 0 | 0 | 0 |
| 3342 | RTA00000527F.l.21.1 | 36439 | 2 | 0 | 0 | 0 | 0 | 0 | 0 | 0 |
| 3345 | RTA00000424F.d.17.3 | 73958 | 1 | 0 | 0 | 0 | 0 | 0 | 0 | 0 |
| 3346 | RTA00000523F.j.02.1 | 62853 | 1 | 0 | 0 | 0 | 0 | 0 | 0 | 0 |

No clones corresponding to the colon-specific polynucleotides in the table above resent in any of Libraries 3, 4, 8, 9, 12, 13, 14, or 15. The polynucleotide provided above can be used as markers of cells of colon origin, and find particular use in reference arrays, as described above.

Example 26

Identification of Contiguous Sequences Having a Polynucleotide of the Invention

The novel polynucleotides were used to screen publicly available and proprietary databases to determine if any of the polynucleotides of SEQ ID NOS: 845-3346 would facilitate identification of a contiguous sequence, e.g., the polynucleotides would provide sequence that would result in 5' extension of another DNA sequence, resulting in production of a longer contiguous sequence composed of the provided polynucleotide and the other DNA sequence(s). Contiging was performed using the Gelmerge application (default settings) of GCG from the Univ. of Wisconsin.

Using these parameters, 146 contiged sequences were generated. These contiged sequences are provided as SEQ ID NOS:5951-6096 (see Table 17). The contiged sequences can be correlated with the sequences of SEQ ID NOS:845-3346 upon which the contiged sequences are based by, for example, identifying those sequences of SEQ ID NOS: 845-3346 and the contiged sequences of SEQ ID NOS: 5951-6096 that share the same clone name in Table 17.

The contiged sequences (SEQ ID NO: 5951-6096) thus represent longer sequences that encompass a polynucleotide sequence of the invention. The contiged sequences were then translated in all three reading frames to determine the best alignment with individual sequences using the BLAST programs as described above for SEQ ID NOS: 845-3346 and the validation sequences "SEQ ID NOS:3347-5950." Again the sequences were masked using the XBLAST program for masking low complexity as described above in Example 1 (Table 18). Several of the contiged sequences were found to encode polypeptides having characteristics of a polypeptide belonging to a known protein families (and thus represent new members of these protein families) and/or comprising a known functional domain (Table 36). Thus the invention encompasses fragments, fusions, and variants of such polynucleotides that retain biological activity associated with the protein family and/or functional domain identified herein.

TABLE 36

Profile hits using contiged sequences

| SEQ ID NO | Biological Activity (Profile) | Start | Stop | Score | Direction | Sequence Name |
|---|---|---|---|---|---|---|
| 5955 | 7tm_2 | 71 | 915 | 8090 | for | RTA00000399F.o.01.1 |
| 5964 | 7tm_2 | 101 | 919 | 8475 | rev | RTA00000341F.m.21.1 |
| 6018 | 7tm_2 | 3 | 963 | 9431 | for | RTA00000192AF.h.19.1 |
| 6041 | 7tm_2 | 214 | 1073 | 8528 | rev | RTA00000192AF.f.3.1 |
| 6052 | ANK | 546 | 629 | 4920 | for | RTA00000190AF.f.5.1 |
| 5964 | asp | 126 | 1067 | 6620 | rev | RTA00000341F.m.21.1. |
| 6085 | asp | 112 | 1094 | 6553 | for | RTA00000418F.i.06.1 |
| 6087 | asp | 347 | 1028 | 5981 | for | RTA00000339F.b.02.1 |
| 6041 | ATPases | 113 | 781 | 5690 | for | RTA00000192AF.f.3.1 |
| 6083 | ATPases | 1 | 348 | 15955 | for | RTA00000401F.m.07.1 |
| 6085 | ATPases | 110 | 823 | 6782 | for | RTA00000418F.i.06.1 |
| 6087 | ATPases | 338 | 874 | 5832 | for | RTA00000339F.b.02.1 |
| 5969 | protkinase | 59 | 685 | 5791 | for | RTA00000182AF.c.5.1 |
| 6061 | protkinase | 75 | 1035 | 5405 | for | RTA00000181AF.p.12.3 |
| 6081 | protkinase | 25 | 546 | 5107 | rev | RTA00000118A.n.5.1 |
| 6092 | protkinase | 14 | 422 | 5103 | rev | RTA00000419F.k.05.1 |
| 6096 | protkinase | 89 | 755 | 5499 | for | RTA00000404F.m.17.2 |
| 5964 | Wnt_dev_sign | 3 | 948 | 11036 | for | RTA00000341F.m.21.1 |

All stop/start sequences are provided in the forward direction.

Descriptions of the profiles for the indicated protein families and functional domains are provided in Example 3 above.

Those skilled in the art will recognize, or be able to ascertain, using not more than routine experimentation, many equivalents to the specific embodiments of the invention described herein. Such specific embodiments and equivalents are intended to be encompassed by the following claims.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

Deposit Information:

The following materials were deposited with the American Type Culture Collection: CMCC=(Chiron Master Culture Collection)

| Cell Lines Deposited with ATCC | | | |
|---|---|---|---|
| Cell Line | Deposit Date | ATCC Accession No. | CMCC Accession No. |
| KM12L4-A | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

-continued cDNA Libraries Deposited with ATCC

| cDNA Library No. | | |
|---|---|---|
| cDNA Library ES21 | cDNA Library ES22 | cDNA Library ES23 |
| | Deposit Date | |
| Jan. 22, 1999 | Jan. 22, 1999 | Jan. 22, 1999 |
| | ATCC Accession No. | |
| ATCC No. | ATCC No. | ATCC No. |

| | | | |
|---|---|---|---|
| Clone Names | M00001575D:G05 | M00001364A:E11 | M00001489B:A06 |
| | M00001460A:A03 | M00001694C:H10 | M00001585A:D06 |
| | M00001655C:E04 | M00003841D:E03 | M00001637B:E07 |
| | M00001676C:C11 | M00004176D:B12 | M00001529D:H02 |
| | M00001679D:D05 | M00001387B:E02 | M00001500C:C08 |
| | M00001546B:C05 | M00004282B:A04 | M00001483B:D03 |
| | M00001453B:E10 | M00001376B:F03 | M00001623C:H07 |
| | | M00001445D:A06 | M00003975B:F03 |
| | | M00001399C:H12 | |
| | | M00004208D:H08 | |

| cDNA Library No. | | |
|---|---|---|
| cDNA Library ES24 | cDNA Library ES25 | cDNA Library ES26 |
| | Deposit Date | |
| Jan. 22, 1999 | Jan. 22, 1999 | Jan. 22, 1999 |
| | ATCC Accession No. | |
| ATCC No. | ATCC No. | ATCC No. |

| | | | |
|---|---|---|---|
| Clone Names | M00003987D:D06 | M00001675D:B08 | M00001479C:F10 |
| | M00004073A:H12 | M00001589B:E12 | M00003842D:F08 |
| | M00004104B:F11 | M00001607D:A11 | M00003901A:C09 |
| | M00004237D:D08 | M00001636A:E07 | M00003982A:B06 |
| | M00004111D:B07 | M00001530A:B12 | M00003824A:A06 |
| | M00004138B:B11 | M00001495B:B08 | M00003845D:C03 |
| | M00001391C:C04 | M00001487C:F01 | M00003856A:B07 |
| | M00001448D:E12 | M00001644B:D06 | M00004104B:A02 |
| | M00001450A:B03 | M00003751C:A04 | M00004110C:E03 |
| | M00001451B:F01 | | |

In addition, libraries of selected clones were deposited. The details of these deposits are provided in Tables 37-40.

This deposit is provided merely as convenience to those of skill in the art, and is not an admission that a deposit is required under 35 U.S.C. §112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby.

TABLE 37

Clones Deposited on Jan. 22, 1999

| cDNA LIbrary Ref. | | |
|---|---|---|
| Library ES17 | Library ES18 | Library ES19 |
| | ATCC No | |
| 207064 | 207065 | 207066 |

| | | | |
|---|---|---|---|
| Clone Names | M00001601A:E09 | M00001594A:D06 | M00003906A:F04 |
| | M00001368A:D07 | M00001613D:H10 | M00003908A:F12 |
| | M00003917A:D02 | M00001596D:E10 | M00003914A:G09 |
| | M00001673A:A04 | M00001592C:G04 | M00003915C:H04 |
| | M00003868B:G11 | M00001599D:A09 | M00003905D:B08 |
| | M00003917C:D03 | M00001619B:A09 | M00003908C:G09 |
| | M00003791C:E09 | M00001593B:E11 | M00003914B:A11 |

TABLE 37-continued

Clones Deposited on Jan. 22, 1999

| cDNA LIbrary Ref. | | |
|---|---|---|
| Library ES17 | Library ES18 | Library ES19 |
| | ATCC No | |
| 207064 | 207065 | 207066 |

| | | |
|---|---|---|
| M00003870A:C05 | M00001605A:E06 | M00003916C:C05 |
| M00003922A:D02 | M00001608A:D03 | M00003959A:A03 |
| M00003861C:H02 | M00001616C:A02 | M00003905D:C08 |
| M00003931B:A11 | M00001617A:D06 | M00003908D:D12 |
| M00001679D:B05 | M00001595C:E01 | M00003901B:H04 |
| M00001679C:D05 | M00001616C:A11 | M00004031A:E01 |
| M00001687A:G01 | M00001608C:E11 | M00004029C:C12 |
| M00003945A:E09 | M00001610C:E06 | M00003911A:F10 |
| M00003908A:H09 | M00001612B:D11 | M00003914C:F09 |
| M00001649B:G12 | M00001618B:E05 | M00003963D:B05 |
| M00003813D:H12 | M00001621C:C10 | M00003986C:E09 |
| M00004087C:D03 | M00001647A:H08 | M00004031A:F07 |
| M00004269B:C08 | M00001631D:B10 | M00003907C:C02 |
| M00004348A:A02 | M00001608D:E09 | M00003911B:F08 |
| M00001679C:D01 | M00001641B:C10 | M00003914C:H05 |
| M00001490A:E11 | M00001641D:E02 | M00003918C:C12 |
| M00001387A:E10 | M00001630D:H10 | M00003914C:C02 |
| M00001397B:G03 | M00001585C:D10 | M00003914A:E04 |
| M00001441D:E04 | M00001560A:H10 | M00003903B:D03 |
| M00001352C:G09 | M00001573B:C06 | M00003905A:F09 |
| M00001370D:A12 | M00001660C:D11 | M00003867C:E11 |
| M00001387B:A06 | M00001641C:C05 | M00003870B:B08 |
| M00001397C:A10 | M00001578B:B05 | M00003879D:A08 |
| M00001536D:G02 | M00001587C:C10 | M00003891D:B10 |
| M00003895C:A10 | M00001590B:C07 | M00003901C:A08 |
| M00001464B:B03 | M00001554A:E04 | M00003903C:C04 |
| M00004370A:G05 | M00001570C:G06 | M00003905A:F10 |
| M00001490B:H11 | M00001576A:B09 | M00003906C:D06 |
| M00001530B:D10 | M00001582A:H01 | M00003907D:A12 |
| M00001579C:E09 | M00001582B:E12 | M00003905C:G11 |
| M00001587A:H03 | M00001615B:F07 | M00003914D:D10 |
| M00001457C:H12 | M00001571C:A04 | M00003972A:G09 |
| M00001535C:E01 | M00001573D:D10 | M00003975D:C06 |
| M00001561D:C05 | M00001576A:F11 | M00003905C:B02 |
| M00001589A:C01 | M00001579C:G05 | M00003907D:F11 |
| M00001664D:G07 | M00001582D:A02 | M00003914A:G06 |
| M00001565A:H09 | M00001589B:E07 | M00003918A:E03 |
| M00001381C:B08 | M00001575B:B02 | M00003972C:F08 |
| M00001395C:F11 | M00001578C:G06 | M00003976C:D06 |
| M00001429D:F11 | M00001591A:B08 | M00003907C:C04 |
| M00001449A:F01 | M00001607A:F11 | M00003905B:C06 |
| M00001391C:H02 | M00001579C:E06 | M00004088C:A12 |
| M00001429D:H12 | M00001661C:F11 | M00004103C:D04 |
| M00001450A:G11 | M00001650B:C10 | M00004107A:D01 |
| M00001344B:F12 | M00001654C:E04 | M00004110A:E04 |
| M00001391D:C06 | M00001656B:A08 | M00004062A:H06 |
| M00003971A:A06 | M00001662C:B02 | M00004075D:C10 |
| M00001346A:E04 | M00001656B:D05 | M00004081D:H09 |
| M00001455C:G07 | M00001661C:F10 | M00004089A:B08 |
| M00001402D:F02 | M00001663A:C11 | M00004103D:F10 |
| M00001438D:C06 | M00001669A:C10 | M00004107B:B04 |
| M00001349B:G05 | M00001651B:B12 | M00004032C:B02 |
| M00001389C:A08 | M00001653B:E06 | M00004078C:F04 |
| M00001439B:A10 | M00001659C:F02 | M00004038B:H10 |
| M00001455B:A09 | M00001661B:F03 | M00004089A:E02 |
| M00001441B:D11 | M00001663C:F10 | M00004096B:F05 |
| M00001453A:B01 | M00001669A:G12 | M00004104C:H12 |
| M00001456D:E08 | M00001674D:C10 | M00004110D:A10 |
| M00001399A:C03 | M00001651B:E06 | M00004036D:F02 |
| M00004496C:H03 | M00001651C:C05 | M00004088C:E04 |
| M00004135D:G02 | M00001657C:C07 | M00004104D:A04 |
| M00004692A:E07 | M00001662A:C12 | M00004107D:E12 |
| M00004374B:E10 | M00001663D:C06 | M00004115D:D08 |
| M00004405D:C04 | M00001590C:C05 | M00003846A:D03 |
| M00004312B:H07 | M00001483C:G06 | M00004072C:F08 |
| M00003976C:A10 | M00001653A:G07 | M00004039B:G08 |
| M00004043A:D02 | M00001625C:C10 | M00003986D:D02 |
| M00004081C:H06 | M00001626C:D12 | M00003914C:B07 |
| M00004050D:A06 | M00001634D:D02 | M00003914D:B02 |
| M00001361B:C07 | M00001641C:C06 | M00003971B:B07 |
| M00004341B:G03 | M00001642D:F02 | M00003978C:A03 |

TABLE 37-continued

Clones Deposited on Jan. 22, 1999 cDNA LIbrary Ref.

| Library ES17 | Library ES18 | Library ES19 |
|---|---|---|
| | ATCC No | |
| 207064 | 207065 | 207066 |
| M00001342B:E01 | M00001647B:E04 | M00003983B:C08 |
| M00004064D:A11 | M00001632B:E05 | M00004033D:D07 |
| M00004087A:G08 | M00001639A:C11 | M00004072D:H12 |
| M00004344B:H04 | M00001642D:G10 | M00004077B:H11 |
| M00004497A:H03 | M00001624A:G11 | M00004080A:F01 |
| M00001338C:E10 | M00001626C:G08 | M00004092C:B03 |
| M00001366D:E12 | M00001672D:D04 | M00004037B:C04 |
| M00001390D:E03 | M00001639A:H06 | M00004073C:D04 |
| M00001413B:H09 | M00001662C:A04 | M00004081A:A08 |
| M00004271B:B06 | M00001641B:B01 | M00004085B:B05 |
| M00004151D:E03 | M00001673C:A02 | M00004090C:C07 |
| M00001660B:C04 | M00001650A:A12 | M00004086D:B09 |
| M00003802D:B11 | M00001659D:D03 | M00004088D:B03 |
| M00001579C:E08 | M00001661B:B05 | M00004090C:C10 |
| M00001557D:C08 | M00001671D:E10 | M00004102C:D09 |
| M00003779B:E12 | M00001652A:A06 | M00004105C:E09 |
| M00001638A:D10 | M00001654C:D05 | M00004035A:G10 |
| M00003794A:B03 | M00001656A:B07 | M00003906A:H07 |
| M00001616C:F07 | M00001647B:C09 | M00004083B:G03 |
| M00001679A:F01 | M00001635A:C06 | M00001675B:E02 |
| M00001604C:E09 | M00001482D:A04 | M00003793C:D09 |
| M00001653B:E09 | M00001485C:B10 | M00003762B:H09 |
| M00001585A:F07 | M00001457D:A07 | M00001694C:F12 |
| M00003811D:A12 | M00001461A:E05 | M00001678D:C11 |
| M00001653C:F12 | M00001477A:G07 | M00001677B:B07 |
| M00001679D:F06 | M00001479D:H03 | M00001677B:A02 |
| M00003751D:B02 | M00001482C:D02 | M00001675B:H03 |
| M00003801A:B10 | M00001484D:G05 | M00003808B:D04 |
| M00003844C:A08 | M00001459B:D03 | M00003752B:C02 |
| M00001636C:C01 | M00001464B:C11 | M00003819D:B11 |
| M00001669C:B01 | M00001511A:A05 | M00001677D:B02 |
| M00003755A:A09 | M00001477B:C02 | M00001694C:G04 |
| M00003798D:H08 | M00001471A:D04 | M00003789C:F06 |
| M00001444C:D05 | M00001485C:H10 | M00001678C:C06 |
| M00004040B:F10 | M00001485D:E05 | M00001675B:D02 |
| M00001355A:C12 | M00001487C:G03 | M00003750C:H05 |
| M00001401A:H07 | M00001514A:B04 | M00001694A:B12 |
| M00001393B:B09 | M00001530C:G10 | M00001677B:H06 |
| M00001409D:F11 | M00001534A:G06 | M00001675C:G01 |
| M00001387B:H07 | M00001539A:C12 | M00001675B:C01 |
| M00001394C:C11 | M00001547A:F11 | M00003857B:F07 |
| M00001344A:H07 | M00001550D:A04 | M00003812B:D07 |
| M00001490C:D07 | M00001460A:F07 | M00001694B:B08 |
| M00001352C:F06 | M00001472C:A01 | M00001677B:E06 |
| M00001476B:G03 | M00001481B:A07 | M00004037A:E04 |
| M00001399C:D09 | M00001456D:F05 | M00003870A:H01 |
| M00001347C:G08 | M00001456D:G11 | M00003842C:D11 |
| M00001453D:G12 | M00001477D:F10 | M00003828B:F09 |
| M00001382A:F04 | M00001481A:G06 | M00003856C:H09 |
| M00001392D:H04 | M00001464A:B03 | M00003851A:C10 |
| M00001429C:G12 | M00001469A:G11 | M00003841C:E04 |
| M00001454A:C11 | M00001478B:D07 | M00003837C:G08 |
| M00001517B:G08 | M00001473A:C11 | M00003828B:E07 |
| M00001535A:D02 | M00001457A:G03 | M00003772C:B12 |
| M00001352A:E12 | M00001669B:G02 | M00001677D:F03 |
| M00001381B:F06 | M00001479D:G06 | M00001678B:B12 |
| M00004117A:D11 | M00001473D:B11 | M00001678D:G03 |
| M00004217C:D03 | M00001475A:C12 | M00001675C:F01 |
| M00004270A:F11 | M00001460A:G07 | M00003809A:H04 |
| M00003996A:A06 | M00001464A:D03 | M00003771D:G05 |
| M00004056B:D09 | M00001473D:G01 | M00001678A:F05 |
| M00004142A:B02 | M00001476D:C05 | M00001677B:B06 |
| M00001396D:B03 | M00001484A:A10 | M00003794A:E12 |
| M00001370D:E12 | M00001457A:F02 | M00003771B:E05 |
| M00001390C:C11 | M00001459B:A12 | M00001678A:A11 |
| M00003989A:H11 | M00001464A:E07 | M00003805B:C04 |
| M00001426A:A09 | M00001467A:B03 | M00001680B:E10 |
| M00004498D:D05 | M00001514B:B08 | M00001679B:H07 |
| M00001391B:G12 | M00001464A:B07 | M00003904D:B12 |
| M00001391D:D10 | M00001579A:C03 | M00003856C:B08 |
| M00001376B:A02 | M00001517A:G08 | M00003858D:G06 |

TABLE 37-continued

Clones Deposited on Jan. 22, 1999 cDNA LIbrary Ref.

| Library ES17 | Library ES18 | Library ES19 |
|---|---|---|
| | ATCC No | |
| 207064 | 207065 | 207066 |
| M00001405B:D07 | M00001530B:G09 | M00003870B:F04 |
| M00001368A:A03 | M00001538A:F12 | M00003871C:B05 |
| M00001392D:B11 | M00001540C:B03 | M00003875A:C04 |
| M00001494B:C01 | M00001547A:F06 | M00003901B:A09 |
| M00001352C:A05 | M00001550A:F07 | M00003901C:D03 |
| M00001408B:G06 | M00001567B:G11 | M00003904C:B06 |
| M00004252C:E03 | M00001572A:A10 | M00003901C:F09 |
| M00003901C:A03 | M00001575B:G01 | M00003904D:B10 |
| M00004071D:A10 | M00001487D:C11 | M00003850D:H11 |
| M00001377B:H01 | M00001577B:A03 | M00003902B:D06 |
| M00003939A:A02 | M00001539D:E10 | M00003879A:C01 |
| M00004250D:D10 | M00001587A:F05 | M00003877D:G05 |
| M00004290A:B03 | M00001560A:F03 | M00003881D:C12 |
| M00003911B:B04 | M00001569B:G11 | M00003903A:H09 |
| M00004128B:G01 | M00001573A:A06 | M00003905A:A06 |
| M00004142A:D08 | M00001575D:A10 | M00003875D:D09 |
| M00003977A:E04 | M00001583A:D01 | M00003879A:A06 |
| M00004236C:D10 | M00001587A:F08 | M00003823B:G05 |
| M00004388B:A08 | M00001590B:B02 | M00003763A:C01 |
| M00004409B:A11 | M00001553A:E07 | M00003903B:C02 |
| M00003965A:B11 | M00001560A:H06 | M00003905A:E07 |
| M00003988A:E10 | M00001589C:A11 | M00003867A:D12 |
| M00004138A:H09 | M00001538A:C08 | M00003857C:C09 |
| M00003933C:D06 | M00001531A:H03 | M00003829C:D10 |
| M00004193C:G11 | M00001548A:G01 | M00003839D:E02 |
| M00004039C:C01 | M00001531A:H07 | M00003841C:F03 |
| M00003924B:D04 | M00001542A:E04 | M00003903D:C06 |
| M00004375C:D01 | M00001487A:F10 | M00003852D:E08 |
| | M00001503C:G05 | M00003845D:A09 |
| | M00001511A:G08 | M00003824A:G10 |
| | M00001539A:H12 | M00003841C:F06 |
| | M00001542A:F06 | M00003848A:C09 |
| | M00001549A:F01 | M00003857C:F11 |
| | M00001514A:A12 | M00003816C:C01 |
| | M00001516A:D05 | M00003843A:E08 |
| | M00001546C:C07 | M00003850A:F06 |
| | M00001549A:H11 | M00003813B:A11 |
| | M00001538A:D03 | M00003855C:F10 |
| | M00001544A:C09 | M00003850B:B05 |
| | M00001546B:F12 | M00003841C:F06 |
| | M00001550A:D09 | M00003858B:G05 |
| | M00001487B:F02 | M00003854D:A12 |
| | M00001513A:G07 | M00003857C:G01 |
| | M00001530A:F12 | M00003816C:E09 |
| | M00001538A:D12 | M00003813A:G04 |
| | M00001587A:G06 | M00003850D:A05 |
| | M00001551A:D04 | |
| | M00001485B:C03 | |

TABLE 38

Clones Deposited on Jan. 22, 1999 cDNA Ref No.;

| cDNA Library Ref ES20 ATCC No. 207067 | cDNA Ref No. ES27 ATCC No. 207074 | cDNA Library Ref ATCC No. 207075 |
|---|---|---|
| Clone Names in Library | | |
| M00004891D:A07 | M00001623B:G07 | M00001550D:H02 |
| M00004118B:C11 | M00001619D:G05 | M00001549C:D02 |
| M00004105A:B10 | M00001616C:C09 | M00001549A:A09 |
| M00004099A:F11 | M00001615C:F03 | M00001548A:B11 |
| M00004037C:D07 | M00001614D:D09 | M00001546C:G10 |
| M00004033D:C05 | M00001608B:A03 | M00001544C:C06 |
| M00003983D:A09 | M00001607D:F07 | M00003820B:C05 |
| M00004029B:H08 | M00001623D:C10 | M00001543A:H12 |
| M00004927A:A02 | M00001599B:E09 | M00001540C:B10 |

TABLE 38-continued

Clones Deposited on Jan. 22, 1999 cDNA Ref No.;

| cDNA Library Ref ES20 ATCC No. 207067 | cDNA Ref No. ES27 ATCC No. 207074 | cDNA Library Ref ATCC No. 207075 |
|---|---|---|
| M00003983C:F10 | M00001632C:C09 | M00001552B:G05 |
| M00003980B:C06 | M00001605C:D12 | M00001543C:F01 |
| M00004033D:B07 | M00001625D:C07 | M00001552D:G08 |
| M00004034C:E08 | M00001629B:E06 | M00001554B:B07 |
| M00005100B:H07 | M00001594A:B12 | M00001555A:B01 |
| M00005136A:D10 | M00001632C:A02 | M00001557A:F01 |
| M00005173D:H02 | M00001567C:H12 | M00001558A:E11 |
| M00004891D:C11 | M00001635C:A03 | M00001561C:E11 |
| M00004101A:F07 | M00001636C:H09 | M00001571D:B11 |
| M00003982B:B06 | M00001638A:E07 | M00001563B:D11 |
| M00004108C:E01 | M00001639A:F10 | M00001569C:B06 |
| M00005136D:B07 | M00001656C:G08 | M00001539B:H06 |
| M00004118D:A11 | M00001632A:F12 | M00001571B:E03 |
| M00005102C:C01 | M00001557A:D02 | M00001561D:C11 |
| M00005177C:A01 | M00001529B:C04 | M00001487C:D06 |
| M00004927C:H11 | M00001534B:C12 | M00001454B:D08 |
| M00005174D:B02 | M00001535D:C01 | M00003737D:E10 |
| M00004027A:D06 | M00001536D:A12 | M00001573C:D03 |
| M00005217A:G10 | M00001540B:C09 | M00001454D:E05 |
| M00003984A:B06 | M00001540D:D02 | M00001455D:F09 |
| M00003851C:D07 | M00001541C:B07 | M00001457C:C11 |
| M00003959C:G06 | M00001546B:B02 | M00001459C:C09 |
| M00005100B:G11 | M00001575B:C09 | M00001460A:E01 |
| M00005213C:G01 | M00001554B:C07 | M00001460C:H02 |
| M00003982B:H07 | M00001578D:C04 | M00001456A:H02 |
| M00004029C:B03 | M00001557C:H07 | M00001477B:F04 |
| M00004033D:G06 | M00001558B:D08 | M00003845D:B04 |
| M00004091B:H09 | M00001560D:A03 | M00001488A:E01 |
| M00003959D:A04 | M00001561C:F06 | M00001492D:A11 |
| M00004030D:B06 | M00001564D:C09 | M00001496C:G10 |
| M00004034C:C06 | M00003748B:F02 | M00001499A:A05 |
| M00004030C:D12 | M00001570D:A03 | M00001500A:B02 |
| M00003982C:H10 | M00001660C:B12 | M00001500D:E10 |
| M00003971C:F09 | M00001577B:H02 | M00001513D:A03 |
| M00004031B:A06 | M00001548A:A08 | M00001528A:C11 |
| M00003966B:D02 | M00003868B:D12 | M00001528C:H04 |
| M00004028B:G08 | M00001718D:F07 | M00001531B:E09 |
| M00004031C:H10 | M00003829C:A11 | M00001463A:F06 |
| M00004076D:B09 | M00003832B:E01 | M00003755A:B03 |
| M00004092D:B11 | M00003842B:D09 | M00001653B:G07 |
| M00003981C:F05 | M00003845A:H12 | M00001654D:G11 |
| M00004031D:F05 | M00003847B:G03 | M00001656B:A07 |
| M00004097B:D03 | M00003847C:E09 | M00001664B:D06 |
| M00003986D:G07 | M00003853D:G08 | M00001664C:H10 |
| M00004033B:C02 | M00003828A:E04 | M00001680B:C01 |
| M00004037B:A04 | M00003867C:H09 | M00001681A:F03 |
| M00004092C:B12 | M00003822A:F02 | M00001684B:G03 |
| M00005140D:G09 | M00003868C:H10 | M00001771A:A07 |
| M00004897D:G05 | M00003871A:A05 | M00003774C:D02 |
| M00004960D:B12 | M00003879C:G10 | M00003754D:D02 |
| M00005134C:G04 | M00003880C:F10 | M00001640B:F03 |
| M00005139A:F01 | M00003881D:D06 | M00003763B:H01 |
| M00005176A:C12 | M00003884D:G07 | M00003812C:A05 |
| M00005178A:A07 | M00003887A:A06 | M00003803C:D09 |
| M00005212A:A02 | M00003889A:D10 | M00003801B:B10 |
| M00005229D:H07 | M00003889D:B09 | M00003798D:E03 |
| M00004115C:H04 | M00003858D:F12 | M00003773B:G01 |
| M00004687A:C03 | M00003774B:B08 | M00003771A:G10 |
| M00004900C:E11 | M00001680D:D02 | M00001452A:E07 |
| M00004695B:E04 | M00001528A:F09 | M00004029B:F11 |
| M00005134D:A06 | M00003748A:B07 | M00003751B:A05 |
| M00004103B:B07 | M00001655A:F06 | M00001609B:A11 |
| M00005177A:B06 | M00003750A:D01 | M00001573D:F10 |
| M00005178A:A08 | M00003761D:E02 | M00001579C:B11 |
| M00004104D:B05 | M00003763D:E10 | M00001579C:H10 |
| M00004117B:G01 | M00003768A:E02 | M00001579D:G07 |
| M00004900D:B10 | M00003829B:G03 | M00001583B:E10 |
| M00005134D:H03 | M00003772A:D07 | M00001586D:E02 |
| M00005173C:A02 | M00001661B:C08 | M00001587D:A10 |
| M00005177A:H09 | M00003778A:D08 | M00001589A:D12 |
| M00005178B:H01 | M00003799A:D09 | M00001590C:H08 |
| M00005216C:B09 | M00003800A:C09 | M00001651B:A11 |

| cDNA Library Ref ES20 ATCC No. 207067 | cDNA Ref No. ES27 ATCC No. 207074 | cDNA Library Ref ATCC No. 207075 |
|---|---|---|
| M00003826A:E11 | M00003804A:H04 | M00001597A:E12 |
| M00001596A:G06 | M00003806D:G05 | M00001649C:B10 |
| M00005100B:D02 | M00003808C:B05 | M00001614A:E06 |
| M00005137A:E01 | M00003811A:E03 | M00001615C:D02 |
| M00004119A:A06 | M00003815D:H09 | M00001621D:D03 |
| M00004891D:E07 | M00003818B:G12 | M00001623D:G03 |
| M00004958B:D01 | M00003769B:D03 | M00001624A:F09 |
| M00005102C:F09 | M00001390A:A09 | M00001624C:A06 |
| M00005136D:C01 | M00001432A:E06 | M00001630B:A11 |
| M00005174D:H02 | M00001381A:D02 | M00001634B:C10 |
| M00005177C:B04 | M00001383A:G04 | M00001639D:B07 |
| M00005218B:D09 | M00001384C:E03 | M00001573D:F04 |
| M00004102C:F03 | M00001384C:F12 | M00001595B:A09 |
| M00004114B:D09 | M00001384D:H07 | M00004156B:A12 |
| M00004119D:A07 | M00001385B:F10 | M00004319D:G09 |
| M00004895C:G05 | M00001385C:H11 | M00004096A:G02 |
| M00004235A:A12 | M00001386A:C02 | M00004101C:G08 |
| M00005134B:E01 | M00001372A:F07 | M00004102A:H02 |
| M00004115C:G03 | M00001389D:G11 | M00004108A:A09 |
| M00005175B:H04 | M00001371D:G01 | M00004111D:D11 |
| M00005214B:D11 | M00001392C:D10 | M00004115D:C08 |
| M00004102D:B05 | M00001392D:H06 | M00004118B:E08 |
| M00004115A:B12 | M00001397B:B09 | M00004121C:F06 |
| M00004119D:H06 | M00001398A:G03 | M00004131B:H09 |
| M00004897D:F03 | M00001400A:F06 | M00004141D:A09 |
| M00004960B:A09 | M00001410B:G05 | M00004090A:F09 |
| M00005134C:E11 | M00001413A:F02 | M00004146A:C08 |
| M00005138B:D12 | M00001415B:E09 | M00004078B:A11 |
| M00005176A:A05 | M00001425A:C11 | M00004176B:E08 |
| M00005214C:A09 | M00001386A:D11 | M00004188C:A09 |
| M00004102C:D01 | M00001354C:B06 | M00004233C:H09 |
| M00004960B:A08 | M00001339D:G02 | M00004241D:F11 |
| M00001476B:A09 | M00001660A:C12 | M00004246C:A09 |
| M00005217B:F12 | M00001572A:B06 | M00004247C:C12 |
| M00005233A:G08 | M00001528A:A01 | M00004248B:E08 |
| M00005236B:F10 | M00001343D:C04 | M00004257C:H06 |
| M00005259B:C01 | M00001347B:E01 | M00004260D:C12 |
| M00005254B:B08 | M00001349C:C05 | M00004295B:D02 |
| M00005259B:B05 | M00001350A:D06 | M00004040D:F01 |
| M00001575A:D06 | M00001352C:C05 | M00004142C:E10 |
| M00005259D:H08 | M00001380C:E05 | M00003853D:D03 |
| M00003813C:D08 | M00001354B:B10 | M00003860D:H07 |
| M00001530D:E06 | M00001380C:F02 | M00003878B:E04 |
| M00004891B:B12 | M00001354C:C10 | M00003879A:G05 |
| M00001596B:H09 | M00001355B:G11 | M00003880B:C08 |
| M00004300C:H09 | M00001356D:F06 | M00003881A:D09 |
| M00001486D:D12 | M00001360B:E11 | M00003881C:G09 |
| M00001585D:F03 | M00001361C:H11 | M00003901B:A05 |
| M00001596B:D09 | M00001362C:A10 | M00003904D:D10 |
| M00001570D:E06 | M00001363C:H02 | M00003905C:G10 |
| M00001582C:E01 | M00001366D:G02 | M00003906B:F12 |
| M00001586C:E06 | M00001369A:H12 | M00003909A:H04 |
| M00001593B:D10 | M00001352C:D02 | M00004091B:D11 |
| M00001595C:H11 | M00001485D:B10 | M00003963A:E03 |
| M00001596B:H05 | M00001457B:E03 | M00004353C:H07 |
| M00001576A:C11 | M00001457C:C12 | M00003919A:A10 |
| M00001596C:F09 | M00001458C:E01 | M00003938A:B04 |
| M00001567A:H05 | M00001462B:A10 | M00003939C:F04 |
| M00001585D:D11 | M00001464D:F06 | M00003946D:C11 |
| M00004688A:A02 | M00001467B:H05 | M00003979A:F03 |
| M00004927A:E06 | M00001468B:H06 | M00003985C:F01 |
| M00005229D:H09 | M00001505C:H01 | M00003997B:G07 |
| M00004117B:A12 | M00001470A:H01 | M00003860D:A01 |
| M00004187D:G09 | M00001457A:B07 | M00004035A:A04 |
| M00005173B:F01 | M00001479B:A01 | M00004042D:H02 |
| M00005218A:A05 | M00001469D:D02 | M00004073B:B01 |
| M00004118A:H08 | M00001487A:A05 | M00003946A:H10 |
| M00005134A:D11 | M00001352C:H02 | M00001423D:A09 |
| M00005176B:C09 | M00001488D:C10 | M00004314B:G07 |
| M00005230D:F06 | M00001490C:C12 | M00001405D:D11 |
| M00005234D:B04 | M00001493B:D09 | M00001408A:H04 |
|  | M00001504D:D11 | M00001408D:D04 |

TABLE 38-continued

Clones Deposited on Jan. 22, 1999 cDNA Ref No.;

| cDNA Library Ref ES20 ATCC No. 207067 | cDNA Ref No. ES27 ATCC No. 207074 | cDNA Library Ref ATCC No. 207075 |
|---|---|---|
| M00005101C:E09 | M00001376B:C06 | M00001411D:F05 |
| M00004206A:E02 | M00001506B:D09 | M00001412A:E04 |
| M00001570C:A05 | M00001511B:C06 | M00001413A:F03 |
| M00005231A:H04 | M00001476B:F10 | M00001417B:C04 |
| M00005235A:A03 | M00001450D:D04 | M00001417D:A04 |
| M00004118B:B04 | M00001433A:G07 | M00001418B:F07 |
| M00005136D:D06 | M00001470C:B10 | M00001419D:C10 |
| M00005231C:B01 | M00001437D:C04 | M00001402B:F12 |
| M00004153B:B03 | M00001447C:C01 | M00001423A:G05 |
| M00004897C:D06 | M00001448B:F06 | M00001401C:H03 |
| M00005136D:G06 | M00001449D:A06 | M00001423D:D12 |
| M00005212B:A02 | M00001433B:H11 | M00001424B:H04 |
| M00005232A:C10 | M00001451D:C10 | M00001428B:A09 |
| M00004692A:H10 | M00001452A:C07 | M00001430A:A02 |
| M00005101C:B09 | M00001453C:A11 | M00001432D:F05 |
| M00004144A:F04 | M00001456B:C09 | M00001438B:B09 |
| M00003852B:D11 | M00001454B:G03 | M00001445B:E04 |
| M00001660D:E05 | M00001454B:G07 | M00001445C:A08 |
| M00003808A:F09 | M00001454C:C08 | M00001446C:D09 |
| M00001656A:D10 | M00001454C:F02 | M00001448A:G09 |
| M00001671A:H06 | M00001454D:D06 | M00001449C:H12 |
| M00003809C:H07 | M00001456B:F10 | M00001422C:F12 |
| M00003853C:C06 | M00001455D:A09 | M00001352C:H10 |
| M00003860A:A08 | M00001455D:A11 | M00004375A:H01 |
| M00003822B:D08 | M00001448D:F09 | M00004380B:A05 |
| M00003845A:E12 | | M00004444B:D11 |
| M00003854C:C02 | | M00001341A:F12 |
| M00003860B:G09 | | M00001338B:E02 |
| M00003822B:G01 | | M00001344A:G07 |
| M00001670A:C11 | | M00001345A:G11 |
| M00003852A:B03 | | M00001345B:E10 |
| M00003829D:A11 | | M00001345C:B01 |
| M00003854C:F01 | | M00001346B:B07 |
| M00003856B:C04 | | M00001405B:E09 |
| M00003905A:H11 | | M00001352B:F04 |
| M00001530A:F11 | | M00001451C:E01 |
| M00003840B:E07 | | M00001361A:H07 |
| M00003905B:G03 | | M00001362B:H06 |
| M00003840B:E08 | | M00001372C:G12 |
| M00003855A:C12 | | M00001375B:G12 |
| M00003905B:H05 | | M00001376A:C05 |
| M00003826B:B04 | | M00001376B:A08 |
| M00003851C:B06 | | M00001377C:E12 |
| M00003853B:C08 | | M00001382B:F12 |
| M00003829A:F03 | | M00001385A:F12 |
| M00001638C:G01 | | M00001394A:E04 |
| M00003845D:B02 | | M00001395A:C09 |
| M00001653B:G07 | | M00001396A:H03 |
| M00001578B:A02 | | M00001350B:G11 |
| M00001590B:H10 | | |
| M00001595C:A09 | | |
| M00001596A:E07 | | |
| M00001607A:B06 | | |
| M00001607A:D10 | | |
| M00001652C:B09 | | |
| M00001671B:F02 | | |
| M00001632C:D08 | | |
| M00001638C:H07 | | |
| M00001652D:B09 | | |
| M00001614C:E11 | | |
| M00001633B:B11 | | |
| M00001651C:A04 | | |
| M00001639D:G12 | | |
| M00001671C:F11 | | |
| M00001638A:B04 | | |
| M00001637C:H12 | | |
| M00001669B:H06 | | |
| M00001639D:F02 | | |
| M00001590A:C08 | | |
| M00001636A:C02 | | |

TABLE 38-continued

Clones Deposited on Jan. 22, 1999 cDNA Ref No.;

| cDNA Library Ref ES20 ATCC No. 207067 | cDNA Ref No. ES27 ATCC No. 207074 | cDNA Library Ref ATCC No. 207075 |
|---|---|---|
| M00001614A:A04 | | |
| M00001639D:G06 | | |

TABLE 39

Library Deposited on Jan. 22, 1999 cDNA Ref No.;

| | cDNA Library Ref ES29 ATCC No. 207076 | cDNA Library Ref ES30 ATCC No. 207077 |
|---|---|---|
| Clone Names in Library | M00001449D:B01 | M00001594D:B08 |
| | M00001476D:F03 | M00001593A:B07 |
| | M00001456C:B12 | M00001594A:C01 |
| | M00001469B:B01 | M00001594A:D08 |
| | M00001471B:B04 | M00001594A:G09 |
| | M00001472A:D08 | M00001595C:B05 |
| | M00001473A:A07 | M00001594B:F12 |
| | M00001473C:D09 | M00001596D:E03 |
| | M00001475B:C04 | M00001594D:C03 |
| | M00001475C:G11 | M00001592C:F11 |
| | M00001476A:D11 | M00001590D:G07 |
| | M00001476B:D10 | M00001595D:A04 |
| | M00001468A:C05 | M00001595D:G03 |
| | M00001476C:C11 | M00001601A:A06 |
| | M00001467A:H07 | M00001590C:F10 |
| | M00001477B:E02 | M00001589B:B08 |
| | M00001478B:H08 | M00001589C:E06 |
| | M00001479C:E01 | M00001611B:A05 |
| | M00001480A:D03 | M00001601A:E02 |
| | M00001480C:A05 | M00001587A:D01 |
| | M00001481A:H08 | M00001591B:B12 |
| | M00001481B:D09 | M00001590B:G08 |
| | M00001482A:H05 | M00001592C:E05 |
| | M00001482D:H11 | M00001591B:B06 |
| | M00001483C:G09 | M00001591D:C07 |
| | M00001485C:A05 | M00001591D:F06 |
| | M00001476B:F08 | M00001592A:E02 |
| | M00001460A:E11 | M00001592A:H05 |
| | M00001456C:C11 | M00001592B:A04 |
| | M00001457A:C05 | M00001587A:B10 |
| | M00001457A:G12 | M00001609D:G10 |
| | M00001458A:A11 | M00005231D:B09 |
| | M00001458C:D10 | M00001614B:E08 |
| | M00001458D:A01 | M00005217C:C01 |
| | M00001458D:A02 | M00001587A:B01 |
| | M00001458D:C11 | M00001613D:B03 |
| | M00001458D:D01 | M00001613A:F03 |
| | M00001459B:C11 | M00001611C:H11 |
| | M00001468A:H10 | M00001611C:C12 |
| | M00001460A:C10 | M00001611B:E06 |
| | M00001485B:F05 | M00001611B:A09 |
| | M00001460A:H11 | M00001610D:D05 |
| | M00001461A:F05 | M00001610B:C07 |
| | M00001462A:D03 | M00001610C:E07 |
| | M00001464A:B02 | M00001610A:E09 |
| | M00001464A:E10 | M00001601A:E12 |
| | M00001465A:B12 | M00001609B:C09 |
| | M00001465A:C12 | M00001608D:D11 |
| | M00001465A:E10 | M00001608B:A09 |
| | M00001465A:G06 | M00001607D:F06 |
| | M00001466A:F08 | M00001607B:C05 |
| | M00001467A:C10 | M00001606A:H09 |
| | M00001460A:B12 | M00001605A:H03 |
| | M00001545A:B12 | M00001605A:E09 |
| | M00001535A:D10 | M00001605A:A06 |

TABLE 39-continued

Library Deposited on Jan. 22, 1999 cDNA Ref No.;

| cDNA Library Ref ES29 | cDNA Library Ref ES30 |
|---|---|
| ATCC No. 207076 | ATCC No. 207077 |
| M00001536A:F11 | M00001604A:C11 |
| M00001537A:H05 | M00001604A:C07 |
| M00001539A:E01 | M00001604A:B08 |
| M00001539A:H02 | M00001604A:A09 |
| M00001539B:G07 | M00001610A:H05 |
| M00001539D:B10 | M00005214B:A06 |
| M00001540D:E02 | M00005228A:A09 |
| M00001541B:E05 | M00001567A:B09 |
| M00001542A:G12 | M00001561A:D01 |
| M00001485B:D09 | M00001559A:C08 |
| M00001545A:B10 | M00001559A:A11 |
| M00001533A:G05 | M00001558A:G09 |
| M00001545A:F02 | M00001555A:B12 |
| M00001545A:G05 | M00001554A:A08 |
| M00001546A:D08 | M00001552A:H10 |
| M00001548A:H04 | M00001552A:F06 |
| M00001550A:E07 | M00005231C:B07 |
| M00001551A:A11 | M00005218D:G10 |
| M00001551A:D06 | M00001570A:H01 |
| M00001551A:H06 | M00005214D:D10 |
| M00001551D:H07 | M00001570C:G03 |
| M00001552A:E10 | M00005213C:A01 |
| M00001450A:B08 | M00005212D:F08 |
| M00001544A:F05 | M00005212A:D10 |
| M00001512A:G05 | M00005211C:E09 |
| M00001483B:D04 | M00005211A:E09 |
| M00001485B:H03 | M00005210D:C09 |
| M00001485C:C08 | M00005179D:B03 |
| M00001486B:D07 | M00005179B:H02 |
| M00001486B:E12 | M00005177D:F09 |
| M00001487B:A11 | M00005177C:G04 |
| M00001487B:E10 | M00005177B:H02 |
| M00001507A:A11 | M00001614D:B08 |
| M00001507A:B02 | M00001615A:D06 |
| M00001507A:C05 | M00005216B:D02 |
| M00001507A:E04 | M00001579C:A01 |
| M00001534A:D03 | M00001585B:C03 |
| M00001511A:G01 | M00001585B:A06 |
| M00001533D:A08 | M00001584D:H02 |
| M00001513A:F05 | M00001584A:G03 |
| M00001514A:G03 | M00001583D:B08 |
| M00001516A:D02 | M00001583B:F02 |
| M00001516A:F06 | M00001583A:F07 |
| M00001517A:B11 | M00001583A:A05 |
| M00001529D:C05 | M00001582D:F02 |
| M00001530A:A09 | M00001582D:B01 |
| M00001530A:E10 | M00001582A:A03 |
| M00001532A:C01 | M00001579D:H09 |
| M00001532D:A06 | M00001567D:B03 |
| M00001485B:D10 | M00001579C:H06 |
| M00001511A:A02 | M00001585B:F01 |
| M00004249D:B08 | M00001579B:F04 |
| M00004185D:E04 | M00001579A:E03 |
| M00004188D:G08 | M00001578C:F05 |
| M00004197C:F03 | M00001577D:H06 |
| M00004198B:D02 | M00001577B:F10 |
| M00004204D:C03 | M00001576C:G05 |
| M00004208B:F05 | M00001575D:D12 |
| M00004208D:B10 | M00001575D:B10 |
| M00004210B:B05 | M00001575D:A02 |
| M00001362D:H01 | M00001573B:G08 |
| M00004216D:D03 | M00001573A:E01 |
| M00004167D:H03 | M00001572A:B05 |
| M00004275C:B03 | M00001571D:F05 |
| M00004285C:A08 | M00001579D:F04 |
| M00004316A:G09 | M00001636A:F08 |
| M00004465B:D04 | M00001643B:E05 |
| M00004493B:D09 | M00001642C:G02 |
| M00001347B:H04 | M00001642A:F03 |
| M00001351C:B06 | M00001641D:C04 |
| M00001360A:G10 | M00001641C:H07 |
| M00004216D:C03 | M00001641C:F01 |
| M00004076D:D04 | M00001641C:D02 |
| M00001484C:A04 | M00001641B:F12 |
| M00001456B:G01 | M00001634A:B04 |
| M00003972D:C09 | M00001636B:G11 |
| M00003974C:E04 | M00001649C:D05 |
| M00003979A:E11 | M00001636A:C03 |
| M00003983C:F03 | M00001635D:D05 |
| M00003989B:F11 | M00001635D:C12 |
| M00004031D:B05 | M00001635B:H02 |
| M00004177C:A01 | M00001635B:H01 |
| M00004076B:G03 | M00001634D:G11 |
| M00004167D:A07 | M00001634D:D04 |
| M00004078A:A06 | M00001634A:H05 |
| M00004085A:B02 | M00001641A:A11 |
| M00004107B:A06 | M00001638B:E12 |
| M00004111C:E11 | M00001640A:H02 |
| M00004130D:H01 | M00001636D:F09 |
| M00004157D:B03 | M00001637A:A03 |
| M00004159C:F09 | M00001637A:A06 |
| M00004162C:A07 | M00001637A:E10 |
| M00004135B:G01 | M00001637A:F10 |
| M00004040A:G12 | M00001637C:C06 |
| M00001453B:H12 | M00001644A:H01 |
| M00001448A:E11 | M00001638B:E03 |
| M00001448B:F09 | M00001649A:E11 |
| M00001448B:H05 | M00001638B:F10 |
| M00001448C:E11 | M00001639A:C03 |
| M00001448C:F10 | M00001639A:G07 |
| M00001448D:F12 | M00001639B:H01 |
| M00001449B:B03 | M00001639B:H05 |
| M00001449C:C05 | M00001639C:A09 |
| M00001449D:G10 | M00001639C:C02 |
| M00001448A:B12 | M00001649C:E11 |
| M00001453A:D08 | M00001649C:H10 |
| M00001451B:A04 | M00001637C:E03 |
| M00001454A:F11 | M00001617A:A08 |
| M00001454A:G03 | M00001622A:H12 |
| M00001455A:F04 | M00001621C:H12 |
| M00001455B:E07 | M00001621B:G05 |
| M00001455D:A06 | M00001620D:H02 |
| M00001364B:B06 | M00001620D:G11 |
| M00004117A:G01 | M00001619D:D10 |
| M00001455D:D11 | M00001619C:C07 |
| M00001456B:A06 | M00001619A:E05 |
| M00001451A:C10 | M00001623A:F04 |
| M00001395A:E03 | M00001618A:A03 |
| M00001366D:C06 | M00001618B:D09 |
| M00001365A:H10 | M00001617A:A01 |
| M00001366D:C12 | M00001616D:C11 |
| M00001373D:B03 | M00001615C:G05 |
| M00001453B:F08 | M00001615C:A11 |
| M00001444D:C01 | M00001615B:G07 |
| M00001375B:C06 | M00001633D:H06 |
| M00001392C:D05 | M00001639C:A10 |
| M00001395A:A12 | M00001615B:A09 |
| M00001395A:H02 | M00001615B:G01 |
| M00001397D:G08 | M00001618A:F10 |
| M00001434A:B10 | M00001632C:H07 |
| M00001416A:D09 | M00001633D:D12 |
| M00001433C:F10 | M00001633D:D09 |
| M00001416A:H02 | M00001618A:F08 |
| M00001428D:B10 | M00001633D:G09 |
| M00001428B:D01 | M00001624A:A03 |
| M00001426D:D12 | M00001633C:F09 |
| M00001400C:D02 | M00001633C:H05 |
| M00001427B:D01 | M00001633C:B09 |
| | M00001633A:E06 |
| | M00001633C:H11 |
| | M00001632C:B10 |

TABLE 39-continued

Library Deposited on Jan. 22, 1999

| cDNA Library Ref ES29 ATCC No. 207076 | cDNA Library Ref ES30 ATCC No. 207077 |
|---|---|
| | M00001625D:G10 |
| | M00001631D:G05 |
| | M00001629C:E07 |
| | M00001629B:B08 |
| | M00001626C:E04 |
| | M00001626C:C11 |
| | M00001632A:B10 |
| | M00001624B:B10 |
| | M00001633C:A05 |
| | M00001625C:G05 |

TABLE 40

Clones Deposited on Jan. 22, 1999

| cDNA Ref No.; ATCC Accession No. | cDNA Library Ref ES31 ATCC No. 207078 | cDNA Ref No. ES32 ATCC No. 207079 | cDNA Library Ref ES33 ATCC No. 207080 |
|---|---|---|---|
| Clone Names in Library | M00003843A:E04 | M00003906A:F12 | M00005254D:A10 |
| | M00003842C:G03 | M00003906B:H06 | M00005260B:E11 |
| | M00003842A:A03 | M00003906C:C05 | M00005260A:F04 |
| | M00003841D:A04 | M00003907A:F01 | M00005260A:A12 |
| | M00003841B:E06 | M00003907B:C03 | M00005259B:D12 |
| | M00003841C:H11 | M00003907B:D05 | M00005257D:H11 |
| | M00003844A:A11 | M00003918A:D08 | M00005257D:G07 |
| | M00003841C:F01 | M00003918A:F09 | M00005257D:A06 |
| | M00003841C:H08 | M00003918C:H10 | M00005257C:G01 |
| | M00003841C:D07 | M00003924A:D08 | M00005257A:H11 |
| | M00003844D:A07 | M00003958B:E11 | M00005236B:H10 |
| | M00003845D:G08 | M00003958B:H08 | M00005236B:G03 |
| | M00003852C:B06 | M00003960A:G07 | M00005257C:E05 |
| | M00003854B:A07 | M00003971B:A10 | M00001608C:D02 |
| | M00003854B:D04 | M00003972D:H02 | M00001608C:G04 |
| | M00003859D:C05 | M00003973C:C03 | M00001608D:F11 |
| | M00003860B:F11 | M00003974B:B11 | M00001609C:A12 |
| | M00003867B:G07 | M00003974D:F02 | M00001609C:G05 |
| | M00003867B:G08 | M00003974D:H04 | M00001610C:B07 |
| | M00003841B:E03 | M00003975C:F07 | M00001612D:D12 |
| | M00003822D:B10 | M00003977C:A06 | M00001612D:F06 |
| | M00003867D:A06 | M00003977C:B03 | M00001613A:D02 |
| | M00003868B:G06 | M00003977D:A03 | M00001614A:B10 |
| | M00003867B:D10 | M00003977D:A06 | M00001614C:G07 |
| | M00003831C:G05 | M00003977D:D04 | M00001615C:E07 |
| | M00003901C:B01 | M00003978D:G04 | M00001625C:F10 |
| | M00003868C:C07 | M00003980A:F04 | M00001626D:A02 |
| | M00003820A:A08 | M00003980B:C11 | M00001629A:H09 |
| | M00003820B:D07 | M00003981C:B04 | M00001629D:B10 |
| | M00003820B:D10 | M00003982A:B12 | M00001629D:D10 |
| | M00003822D:C06 | M00003982C:G04 | M00001630C:F09 |
| | M00003823B:F07 | M00003984D:B08 | M00001631A:D03 |
| | M00003824C:D07 | M00003985B:G04 | M00001631A:F06 |
| | M00003825B:B10 | M00003985D:E10 | M00001631A:F12 |
| | M00003825B:B11 | M00003986B:A08 | M00001631B:H04 |
| | M00003828A:D05 | M00003986C:D09 | M00001633A:F11 |
| | M00003822D:D04 | M00003986D:C08 | M00001633A:G10 |
| | M00003830C:A03 | M00003987B:E12 | M00001633B:A12 |
| | M00003840D:H10 | M00003987B:F08 | M00001633B:E03 |
| | M00003832A:A09 | M00003987C:G03 | M00001633C:A08 |
| | M00003833B:B03 | M00003988D:A08 | M00001633C:E12 |
| | M00003833B:C12 | M00003989C:D03 | M00001635B:B02 |
| | M00003834B:G04 | M00003989C:G05 | M00001636A:H12 |
| | M00003835A:A09 | M00003989D:F12 | M00001638A:C08 |
| | M00003835B:H11 | M00004029B:F01 | M00001638B:C08 |
| | M00003835D:G06 | M00004029C:C05 | M00001639D:C12 |
| | M00003837C:E05 | M00004029C:G10 | M00001640A:F05 |
| | M00003837C:F10 | M00004030D:F11 | M00001642D:G08 |
| | M00003839A:D07 | M00004034A:A01 | M00001647D:G07 |
| | M00003839D:E11 | M00004034C:G02 | M00001649A:E10 |
| | M00003829C:H05 | M00004034D:E09 | M00001650D:D10 |
| | M00003901B:C03 | M00004035B:H09 | M00001650D:F11 |
| | M00003878C:F06 | M00004036D:B04 | M00001651C:D11 |
| | M00003878C:G08 | M00004036D:B09 | M00001651C:G12 |
| | M00003879A:A02 | M00004038A:F02 | M00001652B:D06 |

TABLE 40-continued

Clones Deposited on Jan. 22, 1999

| cDNA Ref No.; ATCC Accession No. | cDNA Library Ref ES31 ATCC No. 207078 | cDNA Ref No. ES32 ATCC No. 207079 | cDNA Library Ref ES33 ATCC No. 207080 |
|---|---|---|---|
| | M00003879A:B08 | M00004038D:G06 | M00001652D:G02 |
| | M00003879A:C11 | M00004039A:C03 | M00001652D:G06 |
| | M00003879A:D02 | M00004039A:H11 | M00001653A:A05 |
| | M00003879B:G02 | M00004039B:A05 | M00001653D:H07 |
| | M00003880B:D11 | M00004039B:E12 | M00001654A:E08 |
| | M00003880C:E11 | M00004040C:A01 | M00001654B:A01 |
| | M00003880C:H03 | M00004051D:E01 | M00001654C:D10 |
| | M00003901B:F10 | M00004072D:F09 | M00001654C:G07 |
| | M00003890B:C08 | M00004073A:D10 | M00001654C:G09 |
| | M00003877C:A11 | M00004075B:G09 | M00001655C:C07 |
| | M00003819D:B01 | M00004076A:D12 | M00001655D:E08 |
| | M00003901B:G11 | M00004076D:H07 | M00001655D:H11 |
| | M00001692A:G06 | M00004078A:C11 | M00001656A:H12 |
| | M00003903C:C05 | M00004078A:E05 | M00001656C:C04 |
| | M00003903C:E12 | M00004078A:F07 | M00001656D:C04 |
| | M00003903D:C12 | M00004078B:C11 | M00001657C:C11 |
| | M00003903D:D10 | M00004078B:F12 | M00001657D:A10 |
| | M00003903D:H11 | M00004079D:G08 | M00001659D:A09 |
| | M00003904A:C04 | M00004081A:E02 | M00001661D:D05 |
| | M00003904B:C03 | M00004081A:G01 | M00001664B:E08 |
| | M00003904C:A08 | M00004081C:A10 | M00001664B:F06 |
| | M00003881B:F10 | M00004083A:E08 | M00001669B:C12 |
| | M00003871D:G06 | M00004083B:C01 | M00001669C:B09 |
| | M00003868D:D09 | M00004086D:G08 | M00001670A:F09 |
| | M00003868D:D11 | M00004087B:A12 | M00001678C:F09 |
| | M00003870C:A01 | M00004087C:A01 | M00001693A:H06 |
| | M00003870C:A10 | M00004088C:F01 | M00003805D:E06 |
| | M00003870C:E10 | M00004088D:A11 | M00003806C:A06 |
| | M00003871A:A02 | M00004088D:B05 | M00003809B:A03 |
| | M00003871A:B09 | M00004088D:B10 | M00003810A:A02 |
| | M00003871A:C11 | M00004090B:B04 | M00003810B:B11 |
| | M00003871A:G09 | M00004090B:H06 | M00003810C:B06 |
| | M00003871C:E04 | M00004092B:E05 | M00003810D:H09 |
| | M00003871C:F12 | M00004093C:C02 | M00003811C:C02 |
| | M00003878C:D08 | M00004096D:H03 | M00003813B:F02 |
| | M00003871D:E11 | M00004099D:F01 | M00003813C:H08 |
| | M00003877C:G12 | M00004100C:C07 | M00003813D:B12 |
| | M00003875A:A07 | M00004103B:E09 | M00003813D:C02 |
| | M00003875A:B01 | M00004105C:B05 | M00003813D:G06 |
| | M00003875B:F12 | M00004105C:C08 | M00003814B:C01 |
| | M00003875C:A01 | M00004107A:A12 | M00003817C:A10 |
| | M00003875C:A09 | M00004107B:D07 | M00003817C:G06 |
| | M00003875C:G02 | M00004108B:B02 | M00003817D:D12 |
| | M00003876B:C05 | M00004108D:E07 | M00003821A:H09 |
| | M00003876C:D02 | M00004108D:G04 | M00003822B:G12 |
| | M00003876C:F02 | M00004110A:A10 | M00003822C:A07 |
| | M00003877B:H10 | M00004110B:A07 | M00003823C:B01 |
| | M00003868D:B09 | M00004118B:A03 | M00003823C:C04 |
| | M00003871D:A10 | M00004118B:F01 | M00003824A:G11 |
| | M00001669D:D06 | M00004118D:B05 | M00003824B:C09 |
| | M00001661A:B11 | M00004119A:C09 | M00003824C:A10 |
| | M00001661B:F06 | M00004136D:B02 | M00003824D:D08 |
| | M00001662A:C07 | M00004137A:D06 | M00003825B:F10 |
| | M00001662A:G01 | M00004139C:A12 | M00003825D:F01 |
| | M00001662B:F06 | M00004149C:B02 | M00003826C:F05 |
| | M00001663C:F12 | M00004159C:G12 | M00003829A:B08 |
| | M00001664A:F08 | M00004169D:B11 | M00003829C:E08 |
| | M00001664D:F04 | M00004187D:H06 | M00003829D:D12 |
| | M00001661A:E06 | M00004228C:H03 | M00003829D:F03 |
| | M00001669A:B02 | M00004244C:G07 | M00003830D:B11 |
| | M00001669B:B12 | M00004358D:C02 | M00003830D:H11 |
| | M00001669C:C08 | M00004690A:G08 | M00003833D:H08 |
| | M00001675A:G10 | M00004891B:D01 | M00003833D:H10 |
| | M00001669D:C03 | M00004891C:D04 | M00003840A:C10 |
| | M00001660B:E03 | M00004895B:E12 | M00003840B:F05 |
| | M00001669D:F05 | M00004895B:G04 | M00003840C:C02 |
| | M00001670B:G12 | M00004895D:G07 | M00003845C:D04 |
| | M00001671A:A10 | M00004898C:F03 | M00003845D:A04 |
| | M00001671B:G05 | M00004899D:G06 | M00003846B:C05 |
| | M00001671C:C11 | M00004959D:H12 | M00003846C:F08 |
| | M00001672D:E08 | M00004960A:B08 | M00003848B:E07 |
| | M00001673A:G08 | M00004960C:E10 | M00003848D:G02 |
| | M00001673B:B07 | M00005100A:B02 | M00003850C:G09 |
| | M00001673B:F07 | M00005100A:C01 | M00003851A:A06 |
| | M00001673D:D06 | M00005101C:E12 | M00003851B:D03 |

TABLE 40-continued

Clones Deposited on Jan. 22, 1999

| cDNA Ref No.; ATCC Accession No. | cDNA Library Ref ES31 ATCC No. 207078 | cDNA Ref No. ES32 ATCC No. 207079 | cDNA Library Ref ES33 ATCC No. 207080 |
|---|---|---|---|
| | M00001673D:F10 | M00005102C:D03 | M00003851B:E01 |
| | M00001674A:G07 | M00005134B:E08 | M00003851C:F09 |
| | M00001692D:B01 | M00005139A:H03 | M00003851D:H11 |
| | M00001669C:D09 | M00005140C:B10 | M00003852B:G04 |
| | M00001655C:E01 | M00005140D:C06 | M00003852C:F07 |
| | M00001649D:A08 | M00005178D:H04 | M00003853B:C10 |
| | M00001650A:C11 | M00005210A:E06 | M00003854C:C09 |
| | M00001651A:H11 | M00005212B:E01 | M00003855A:A01 |
| | M00001652A:A01 | M00005212C:C03 | M00003855A:F01 |
| | M00001652B:G10 | M00005212C:D02 | M00003855B:B09 |
| | M00001652D:E05 | M00005212C:H02 | M00003856A:G04 |
| | M00001652D:E09 | M00005212D:D09 | M00003856B:A12 |
| | M00001653B:C06 | M00005212D:H01 | M00003857A:E12 |
| | M00001653B:G10 | M00005216A:D09 | M00003857A:H10 |
| | M00001653C:D10 | M00005216A:H01 | M00003857C:E05 |
| | M00001654D:A03 | M00005217B:A06 | M00003858B:G02 |
| | M00001654D:E12 | M00005218A:F09 | M00003860D:E06 |
| | M00001654D:F11 | M00005228A:B03 | M00003905C:F12 |
| | M00001660C:B06 | M00005228C:C05 | M00003911A:D12 |
| | M00001658D:G12 | M00005229B:G12 | M00003966B:A04 |
| | M00001675C:A04 | M00005229B:H04 | M00003966C:A12 |
| | M00001660B:D03 | M00005229B:H06 | M00003966C:F03 |
| | M00001660B:A09 | M00005229D:H03 | M00003973D:F08 |
| | M00001659D:C09 | M00005230B:H09 | M00003974D:E01 |
| | M00001659D:B05 | M00005232A:H12 | M00003974D:H07 |
| | M00001654D:F12 | M00005233B:D04 | M00003976B:E06 |
| | M00001659A:D12 | M00005233D:H07 | M00003976B:H07 |
| | M00001655A:B11 | M00005235B:F10 | M00003978A:E01 |
| | M00001658B:A07 | M00005236A:E04 | M00003978A:E09 |
| | M00001658A:G09 | M00005236A:G10 | M00003978C:A12 |
| | M00001657D:A04 | M00005236B:A12 | M00003980C:E12 |
| | M00001657B:B04 | M00001448B:A07 | M00003980C:F12 |
| | M00001656B:E01 | M00001448B:G07 | M00003981A:A07 |
| | M00001660B:E04 | M00001448D:E11 | M00003981B:B12 |
| | M00001659C:F10 | M00001455A:D10 | M00003982A:G03 |
| | M00003808C:A05 | M00001455A:E11 | M00003982B:C10 |
| | M00001694D:C12 | M00001476D:F12 | M00003982B:H10 |
| | M00003746C:E02 | M00001478A:F12 | M00003983A:D02 |
| | M00003779D:E08 | M00001482C:F09 | M00003983A:F06 |
| | M00003792A:B10 | M00001485C:D07 | M00003983A:G02 |
| | M00003793D:A11 | M00001485C:G06 | M00003983D:E08 |
| | M00003794D:G03 | M00001485D:A05 | M00003983D:H02 |
| | M00003797A:C11 | M00001487C:A11 | M00003985A:C01 |
| | M00003797A:D06 | M00001487C:G09 | M00003986C:G11 |
| | M00003797A:G03 | M00001530A:B02 | M00003986D:H12 |
| | M00003800B:F03 | M00001530A:H05 | M00004027A:A08 |
| | M00003805A:F02 | M00001530D:A11 | M00004028A:B10 |
| | M00003806B:C09 | M00001539B:B10 | M00004028A:G03 |
| | M00001674A:G11 | M00001567A:C04 | M00004029B:A01 |
| | M00003806D:D11 | M00001567A:C11 | M00004029B:A06 |
| | M00001693D:E08 | M00001567C:B08 | M00004029B:G10 |
| | M00003808D:D08 | M00001567C:E07 | M00004029C:F02 |
| | M00003809A:C01 | M00001570C:B02 | M00004029C:F05 |
| | M00003809A:F01 | M00001570D:E05 | M00004030B:A12 |
| | M00003809B:B02 | M00001570D:E07 | M00004030B:D08 |
| | M00003809B:E10 | M00001573B:A06 | M00004030C:A08 |
| | M00003813A:B02 | M00001573B:H12 | M00004030C:C02 |
| | M00003813A:D08 | M00001575A:D05 | M00004034C:F05 |
| | M00003813B:E09 | M00001575B:C01 | M00004035B:F05 |
| | M00003814B:C12 | M00001576C:H02 | M00004036A:A11 |
| | M00003814B:F12 | M00001577A:A03 | M00004037C:D04 |
| | M00003815C:C06 | M00001578B:A06 | M00004038A:E05 |
| | M00003815C:D12 | M00001579D:F02 | M00004038B:D01 |
| | M00003817B:C04 | M00001582C:C04 | M00004039C:E02 |
| | M00003806B:G05 | M00001582C:G02 | M00004039D:B10 |
| | M00001679A:D10 | M00001584A:A07 | M00004040A:A07 |
| | M00001675C:C03 | M00001584A:B06 | M00004040A:B04 |
| | M00001675C:D12 | M00001584D:C11 | M00004040A:C08 |
| | M00001675D:E10 | M00001585D:B12 | M00004040B:C05 |
| | M00001676B:B09 | M00001586C:H07 | M00004040B:F07 |
| | M00001676B:E01 | M00001589D:A01 | M00004069A:E12 |
| | M00001676C:A04 | M00001590D:B04 | M00004069C:C08 |
| | M00001676C:E07 | M00001592B:B02 | M00004077A:G12 |
| | M00001676D:A02 | M00001592D:H02 | M00004085B:G01 |
| | M00001676D:B02 | M00001594C:E05 | M00004087A:B05 |

TABLE 40-continued

| Clones Deposited on Jan. 22, 1999 | | | |
|---|---|---|---|
| cDNA Ref No.; ATCC Accession No. | cDNA Library Ref ES31 ATCC No. 207078 | cDNA Ref No. ES32 ATCC No. 207079 | cDNA Library Ref ES33 ATCC No. 207080 |
| | M00001677A:G11 | M00001594C:H03 | M00004090D:F12 |
| | M00001677B:A12 | M00001594D:G11 | M00004092C:D08 |
| | M00001677B:B04 | M00001595A:C07 | M00004097C:E03 |
| | M00001677D:B01 | M00001595A:D12 | M00004097C:H08 |
| | M00001678D:B11 | M00001595A:E07 | M00004097D:B05 |
| | M00001681C:A08 | M00001595B:G07 | |
| | M00003819B:G01 | M00001595B:G10 | |
| | M00001693C:E09 | M00001595B:H11 | |
| | M00001693C:C12 | M00001595C:A01 | |
| | M00001692B:E01 | M00001595C:A05 | |
| | M00001692A:B06 | M00001595C:B12 | |
| | M00001678B:H01 | M00001595C:E05 | |
| | M00001681D:C12 | M00001595C:E09 | |
| | M00001694A:E03 | M00001595D:C11 | |
| | M00001680B:D02 | M00001596A:A02 | |
| | M00001680A:B02 | M00001596A:D01 | |
| | M00001679D:F02 | M00001596C:G05 | |
| | M00001679D:B02 | M00001607A:A01 | |
| | M00001679A:G06 | | |

Retrieval of Individual Clones from Deposit of Pooled Clones

Where the ATCC deposit is composed of a pool of cDNA clones, the deposit was prepared by first transfecting each of the clones into separate bacterial cells. The clones were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

Example 27

Source of Biological Materials and Overview of Novel Polynucleotides Expressed by the Biological Materials cDNA libraries were constructed from either human colon cancer cell line Km12L4-A (Morikawa, et al., *Cancer Research* (1988) 48:6863), KM12C (Morikawa et al. *Cancer Res.* (1988) 48:1943-1948), or MDA-MB-231 (Brinkley et al. *Cancer Res.* (1980) 40:3118-3129) was used to construct a cDNA library from mRNA isolated from the cells. Sequences expressed by these cell lines were isolated and analyzed; most sequences were about 275-300 nucleotides in length. The KM12L4-A cell line is derived from the KM12C cell line. The KM12C cell line, which is poorly metastatic (low metastatic) was established in culture from a Dukes' stage $B_2$ surgical specimen (Morikawa et al. *Cancer Res.* (1988) 48:6863). The KML4-A is a highly metastatic subline derived from KM12C (Yeatman et al. *Nucl. Acids. Res.* (1995) 23:4007; Bao-Ling et al. *Proc. Annu. Meet. Am. Assoc. Cancer. Res.* (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res.* (1995) 1:19; Yeatman et al., (1995) supra; Yeatman et al. *Clin. Exp. Metastasis* (1996) 14:246). The MDA-MB-231 cell line was originally isolated from pleural effusions (Cailleau, *J. Natl. Cancer. Inst.* (1974) 53:661), is of high metastatic potential, and forms poorly differentiated adenocarcinoma grade II in nude mice consistent with breast carcinoma.

The sequences of the isolated polynucleotides were first masked to eliminate low complexity sequences using the XBLAST masking program (Claverie "Effective Large-Scale Sequence Similarity Searches," In: *Computer Methods for Macromolecular Sequence Analysis*, Doolittle, ed., *Meth. Enzymol.* 266:212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem.* (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. Masking resulted in the elimination of 43 sequences. The remaining sequences were then used in a BLASTN vs. GenBank search; sequences that exhibited greater than 70% overlap, 99% identity, and a p value of less than $1 \times 10^{-40}$ were discarded. Sequences from this search also were discarded if the inclusive parameters were met, but the sequence was ribosomal or vector-derived.

The resulting sequences from the previous search were classified into three groups (1, 2 and 3 below) and searched in a BLASTX vs. NRP (non-redundant proteins) database search: (1) unknown (no hits in the GenBank search), (2) weak similarity (greater than 45% identity and p value of less than $1 \times 10^{-5}$), and (3) high similarity (greater than 60% overlap, greater than 80% identity, and p value less than $1 \times 10^{-5}$).

Sequences having greater than 70% overlap, greater than 99% identity, and p value of less than $1 \times 10^{-40}$ were discarded.

The remaining sequences were classified as unknown (no hits), weak similarity, and high similarity (parameters as above). Two searches were performed on these sequences. First, a BLAST vs. EST database search was performed and sequences with greater than 99% overlap, greater than 99% similarity and a p value of less than $1 \times 10^{-40}$ were discarded. Sequences with a p value of less than $1 \times 10^{-65}$ when compared to a database sequence of human origin were also excluded. Second, a BLASTN vs. Patent GeneSeq database was performed and sequences having greater than 99% identity, p value less than $1 \times 10^{-40}$, and greater than 99% overlap were discarded.

The remaining sequences were subjected to screening using other rules and redundancies in the dataset. Sequences with a p value of less than $1 \times 10^{-111}$ in relation to a database sequence of human origin were specifically excluded. The final result provided the 1,565 sequences listed as SEQ ID NOS:6097-7661 in the accompanying Sequence Listing and summarized in Table 41A (inserted prior to claims). Each identified polynucleotide represents sequence from at least a partial mRNA transcript.

Table 41A provides: 1) the SEQ ID NO assigned to each sequence for use in the present specification; 2) the filing date of the U.S. priority application in which the sequence was first filed; 3) the attorney docket number assigned to the priority application (for internal use); 4) the SEQ ID NO assigned to the sequence in the priority application; 5) the sequence name used as an internal identifier of the sequence; and 6) the name assigned to the clone from which the sequence was isolated. Because the provided polynucleotides represent partial mRNA transcripts, two or more polynucleotides of the invention may represent different regions of the same mRNA transcript and the same gene. Thus, if two or more SEQ ID NOS: are identified as belonging to the same clone, then either sequence can be used to obtain the full-length mRNA or gene.

In order to confirm the sequences of SEQ ID NOS: 6097-7661, the clones were retrieved from a library using a robotic retrieval system, and the inserts of the retrieved clones re-sequenced. These "validation" sequences are provided as SEQ ID NOS:7662-8706 in the Sequence Listing, and a summary of the "validation" sequences provided in Table 41B (inserted prior to claims). Table 41B provides: 1) the SEQ ID NO assigned to each sequence for use in the present specification; 2) the sequence name assigned to the "validation" sequence obtained; 3) whether the "validation" sequence contains sequence that overlaps with an original sequence of SEQ ID NOS: 6097-7661 (Validation Overlap (VO)), or whether the "validation" sequence does not substantially overlap with an original sequence of SEQ ID NOS: 6097-7661 (indicated by Validation Non-Overlap (VNO)); and 4) where the sequence is indicated as VO, the name of the clone that contains the indicated "validation" sequence. "Validation" sequences are indicated as "VO" where the "validation" sequence overlaps with an original sequence (e.g., one of SEQ ID NOS: 6097-7661), and/or the "validation" sequence belongs to the same cluster as the original sequence using the clustering technique described above. Because the inserts of the clones are generally longer than the original sequence and the validation sequence, it is possible that a "validation" sequence can be obtained from the same clone as an original sequence but yet not share any of the sequence of the original. Such validation sequences will, however, belong to the same cluster as the original sequence using the clustering technique described above. VO "validation" sequences are contained within the same clone as the original sequence (one of SEQ ID NOS: 6097-7661). "Validation" sequences that provided overlapping sequence are indicating by "VO" can be correlated with the original sequences they validate by referring to Table 41A. Sequences indicated as VNO are treated as newly isolated sequences and may or may not be related to the sequences of SEQ ID NOS: 6097-7661. Because the "validation" sequences are often longer than the original polynucleotide sequences and thus provide additional sequence information. All validation sequences can be obtained either from an indicated clone (e.g., for VO sequences) or from a cDNA library described herein (e.g., using primers designed from the sequence provided in the sequence listing).

Example 28

Results of Public Database Search to Identify Function of Gene Products

SEQ ID NOS: 7662-8706 were translated in all three reading frames, and the nucleotide sequences and translated amino acid sequences used as query sequences to search for homologous sequences in either the GenBank (nucleotide sequences) or Non-Redundant Protein (amino acid sequences) databases. Query and individual sequences were aligned using the BLAST 2.0 programs, available over the world wide web of the NCBI. (see also Altschul, et al. *Nucleic Acids Res.* (1997) 25:3389-3402). The sequences were masked to various extents to prevent searching of repetitive sequences or poly-A sequences, using the XBLAST program for masking low complexity as described above.

Tables 41A and 41B (inserted before the claims) provide the alignment summaries having a p value of $1 \times 10^{-2}$ or less indicating substantial homology between the sequences of the present invention and those of the indicated public databases. Table 41A provides the SEQ ID NO of the query sequence, the accession number of the GenBank database entry of the homologous sequence, and the p value of the alignment. Table 41A provides the SEQ ID NO of the query sequence, the accession number of the Non-Redundant Protein database entry of the homologous sequence, and the p value of the alignment. The alignments provided in Tables 41A and 41B are the best available alignment to a DNA or amino acid sequence at a time just prior to filing of the present specification. The activity of the polypeptide encoded by the SEQ ID NOS listed in Tables 41A and 41B can be extrapolated to be substantially the same or substantially similar to the activity of the reported nearest neighbor or closely related sequence. The accession number of the nearest neighbor is reported, providing a publicly available reference to the activities and functions exhibited by the nearest neighbor. The public information regarding the activities and functions of each of the nearest neighbor sequences is incorporated by reference in this application. Also incorporated by reference is all publicly available information regarding the sequence, as well as the putative and actual activities and functions of the nearest neighbor sequences listed in Table 41 and their related sequences. The search program and database used for the alignment, as well as the calculation of the p value are also indicated.

Full length sequences or fragments of the polynucleotide sequences of the nearest neighbors can be used as probes and primers to identify and isolate the full length sequence of the corresponding polynucleotide. The nearest neighbors can indicate a tissue or cell type to be used to construct a library for the full-length sequences of the corresponding polynucleotides.

TABLE 41A

| | Nearest Neighbor (BlastN vs. Genbank) | | |
|---|---|---|---|
| SEQ ID | ACC'N | DESCRIP. | P VALUE |
| 6667 | L17043 | *Homo sapiens* pregnancy-specific beta-1-glycoprotein-11 gene. | 1.00E−12 |
| 6674 | M18864 | Rat bone protein I (BP-I) mRNA, partial cds. | 7.00E−30 |
| 6705 | L13838 | Human genomic sequence from chromosome 13, clone ch13lambdacDNA17–18. | 4.00E−36 |
| 6714 | U09646 | Human carnitine palmitoyltransferase II precursor | 1.00E−34 |
| 6723 | U72621 | Human LOT1 mRNA, complete cds | 1.00E−43 |
| 6725 | M20910 | Human 7S L gene, complete. | 1.00E−35 |
| 6732 | Z48950 | *H. sapiens* hH3.3B gene for histone H3.3 | 4.00E−36 |
| 6735 | X00247 | Human translocated c-myc gene in Raji Burkitt lymphoma cells | 3.00E−44 |
| 6739 | D80007 | Human mRNA for KIAA0185 gene, partial cds | 7.00E−52 |
| 6742 | U14967 | Human ribosomal protein L21 mRNA, complete cds. | 2.00E−42 |
| 6745 | M13934 | Human ribosomal protein S14 gene, complete cds. | 4.00E−45 |
| 6748 | NM_003902.1 | *Homo sapiens* far upstream element binding protein (FUBP) mRNA > :: gb|U05040|HSU05040 Human FUSE binding protein mRNA, complete cds. | 1.00E−54 |
| 6753 | L41142 | *Homo sapiens* signal transducer and activator of transcription (STAT5) mRNA, complete cds. | 2.00E−62 |
| 6761 | Z12112 | pWE15A cosmid vector DNA | 2.00E−52 |
| 6763 | Z54386 | *H. sapiens* CpG island DNA genomic MseI fragment, clone 10g3, forward read cpg10g3.ft1a | 7.00E−48 |
| 6764 | X80333 | *M. musculus* rab18 mRNA | 2.00E−52 |
| 6765 | X52126 | Human alternatively spliced c-myb mRNA | 1.00E−64 |
| 6767 | L26247 | *Homo sapiens* suilisol mRNA, complete cds. | 3.00E−54 |
| 6772 | NM_001736.1 | *Homo sapiens* complement component 5 receptor 1 C5a anaphylatoxin receptor mRNA, complete cds. | 4.00E−56 |
| 6773 | Z50798 | *G. gallus* mRNA for p52 | 4.00E−55 |
| 6775 | AB002368 | Human mRNA for KIAA0370 gene, partial cds | 2.00E−58 |
| 6777 | M26697 | Human nucleolar protein (B23) mRNA, complete cds. | 4.00E−48 |
| 6779 | D42087 | Human mRNA for KIAA0118 gene, partial cds | 4.00E−56 |
| 6789 | D50734 | Rat mRNA of antizyme inhibitor, complete cds | 2.00E−50 |
| 6793 | X02344 | *Homo sapiens* beta 2 gene | 1.00E−67 |
| 6794 | NM_001067.1 | *Homo sapiens* topoisomerase (DNA) II alpha topoisomerase II (top2) mRNA, complete cds. | 7.00E−63 |
| 6797 | U36309 | *Gallus gallus* rhoGap protein mRNA, complete cds | 3.00E−62 |
| 6799 | NM_002842.1 | *Homo sapiens* protein tyrosine phosphatase, receptor type, H (PTPRH) mRNA > :: dbj|D15049|HUMSAP1C Human mRNA for protein tyrosine phosphatase | 2.00E−81 |
| 6803 | U47322 | Cloning vector DNA, complete sequence. | 1.00E−63 |
| 6810 | NM_001190.1 | *Homo sapiens* branched chain aminotransferase 2, mitochondrial (BCAT2) mRNA > :: gb|U68418|HSU68418 Human branched chain aminotransferase precursor (BCATm) mRNA, nuclear gene encoding mitochondrial protein, complete cds | 4.00E−67 |
| 6814 | S62077 | HP1Hs alpha = 25 kda chromosomal autoantigen [human, mRNA, 876 nt] | 5.00E−68 |
| 6815 | U34991 | Human endogenous retrovirus clone c18.4, HERV-H/HERV-E hybrid multiply spliced protease/integrase mRNA, complete cds, and envelope protein mRNA, partial cds | 2.00E−61 |
| 6818 | U18671 | Human Stat2 gene, complete cds. | 4.00E−77 |
| 6819 | L18964 | Human protein kinase C iota isoform (PRKCI) mRNA, complete cds. | 4.00E−68 |
| 6820 | D29956 | Human mRNA for KIAA0055 gene, complete cds | 6.00E−70 |
| 6821 | M77140 | *H. sapiens* pro-galanin mRNA, 3' end. | 2.00E−72 |
| 6824 | U51432 | *Homo sapiens* nuclear protein Skip mRNA, complete cds | 1.00E−75 |
| 6825 | M84334 | *Macacca mulatta* hnRNP A1-gamma isoform mRNA, complete cds. | 5.00E−50 |
| 6826 | NM_002592.1 | *Homo sapiens* proliferating cell nuclear antigen (PCNA) mRNA > :: gb|M15796|HUMCYL Human cyclin protein gene, complete cds. | 1.00E−74 |
| 6827 | M88458 | Human ELP-1 mRNA sequence. | 4.00E−76 |
| 6828 | U44940 | *Mus musculus* quaking type I (QKI) mRNA, complete cds | 2.00E−69 |
| 6829 | D17577 | Mouse mRNA for kinesin-like protein (Kif1b), complete cds | 2.00E−71 |
| 6830 | U18920 | Human chromosome 17q12–21 mRNA, clone pOV-3, partial cds. | 2.00E−72 |
| 6832 | M21188 | Human insulin-degrading enzyme (IDE) mRNA, complete cds. | 7.00E−82 |
| 6833 | U49058 | *Rattus norvegicus* CTD-binding SR-like protein rA4 mRNA, partial cds | 1.00E−67 |

TABLE 41A-continued

Nearest Neighbor (BlastN vs. Genbank)

| SEQ ID | ACC'N | DESCRIP. | P VALUE |
|---|---|---|---|
| 6835 | D10630 | *Mus musculus* mRNA for zinc finger protein, complete cds, clone: CTfin51 | 4.00E−76 |
| 6836 | U29156 | *Mus musculus* eps15R mRNA, complete cds. | 3.00E−84 |
| 6837 | Y08135 | *M. musculus* mRNA for ASM-like phosphodiesterase 3a | 1.00E−86 |
| 6838 | U90567 | *Gallus gallus* glutamine rich protein mRNA, partial cds | 5.00E−58 |
| 6839 | U58280 | *Mus musculus* second largest subunit of RNA polymerase I (RPA2) mRNA, complete cds | 4.00E−77 |
| 6840 | S79539 | Pat-12 = Pat-12 product [mice, embryonic stem ES cells, mRNA, 2781 nt] | 9.00E−84 |
| 6841 | D30666 | Rat mRNA for brain acyl-CoA synthetase II, complete cds | 2.00E−89 |
| 6842 | U29156 | *Mus musculus* eps15R mRNA, complete cds. | 2.00E−92 |
| 6844 | U36909 | *Bos taurus* Rho-associated kinase mRNA, complete cds | e−104 |
| 6845 | L36315 | *Mus musculus* (clone pMLZ-1) zinc finger protein | e−105 |
| 6846 | X80169 | *M. musculus* mRNA for 200 kD protein | e−106 |
| 6847 | X83577 | *M. musculus* mRNA for K-glypican | e−107 |
| 7156 | Z95437 | Human DNA sequence from cosmid A1 on chromosome 6 contains ESTs. HERV like retroviral sequence | 8.00E−21 |
| 7208 | X69907 | *H. sapiens* gene for mitochondrial ATP synthase c subunit (P1 form) | 6.00E−07 |
| 7221 | M19390 | Bovine interstitial retinol binding protein | 8.00E−31 |
| 7252 | U19247 | *Homo sapiens* interferon-gamma receptor alpha chain gene, exon 7 and complete cds | 7.00E−41 |
| 7266 | U20239 | *Mus musculus* fibrosin mRNA, partial cds | 5.00E−38 |
| 7267 | D26361 | Human mRNA for KIAA0042 gene, complete cds | 2.00E−41 |
| 7291 | NM_000694.1 | *Homo sapiens* aldehyde dehydrogenase 7 (ALDH7) mRNA > :: gb|U10868|HSU10868 Human aldehyde dehydrogenase ALDH7 mRNA, complete cds. | 1.00E−37 |
| 7292 | U84404 | Human E6-associated protein E6-AP/ubiquitin-protein ligase (UBE3A) mRNA, alternatively spliced, complete cds | 1.00E−46 |
| 7299 | U51714 | Human GPI protein p137 mRNA, partial sequence, 3'-UTR. | 9.00E−53 |
| 7300 | U58884 | *Mus musculus* SH3-containing protein SH3P7 mRNA, complete cds. similar to Human Drebrin | 2.00E−49 |
| 7306 | X79067 | *H. sapiens* ERF-1 mRNA 3' end | 2.00E−72 |
| 7308 | U00946 | Human clone A9A2BRB5 (CAC)n/(GTG)n repeat-containing mRNA | 3.00E−54 |
| 7313 | D11078 | *Homo sapiens* RGH2 gene, retrovirus-like element | 6.00E−49 |
| 7315 | U05989 | *Rattus norvegicus* clone par-4 induced by effectors of apoptosis mRNA, complete cds. | 3.00E−64 |
| 7316 | U13185 | Cloning vector pbetagal-Enhancer, complete sequence. | 3.00E−52 |
| 7318 | D87443 | Human mRNA for KIAA0254 gene, complete cds | 8.00E−63 |
| 7321 | U19867 | Cloning vector pSPL3, exon splicing vector, complete sequence, HIV envelope protein gp 160 and beta-lactamase, complete cds. | 7.00E−72 |
| 7323 | U04817 | Human protein kinase PITSLRE alpha 2-3 mRNA, complete cds. | 4.00E−57 |
| 7326 | U03687 | *Photinus pyralis* modified luciferase gene, complete cds, and pUC18 derived vector. | 3.00E−62 |
| 7327 | U27196 | *Gallus gallus* zinc finger protein (Fzf-1) mRNA, complete cds. | 1.00E−66 |
| 7331 | X53586 | Human mRNA for integrin alpha 6 | 2.00E−71 |
| 7332 | J05016 | Human (clone pA3) protein disulfide isomerase related protein (ERp72) mRNA, complete cds. | 3.00E−67 |
| 7333 | M86752 | Human transformation-sensitive protein (IEF SSP 3521) mRNA, complete cds. | 1.00E−66 |
| 7335 | L19437 | Human transaldolase mRNA containing transposable element, complete cds | 5.00E−70 |
| 7337 | X90857 | *H. sapiens* mRNA for-14 gene, containing globin regulatory element | 1.00E−74 |
| 7338 | NM_003980.1 | *Homo sapiens* microtubule associated protein 7 mRNA | 9.00E−76 |
| 7341 | U17901 | *Rattus norvegicus* phospholipase A-2-activating protein (plap) mRNA, complete cds. | 3.00E−75 |
| 7342 | S80632 | threonine, tyrosine phosphatase [human, brain, mRNA Partial, 1236 nt] | 2.00E−69 |
| 7343 | M76541 | Human DNA-binding protein (NF-E1) mRNA, complete cds. | 2.00E−80 |

TABLE 41A-continued

Nearest Neighbor (BlastN vs. Genbank)

| SEQ ID | ACC'N | DESCRIP. | P VALUE |
|---|---|---|---|
| 7344 | S55305 | 14-3-3 protein gamma subtype = putative protein kinase C regulatory protein [rats, brain, mRNA, 3410 nt] > :: dbj|D17447|D17447 *Rattus norvegicus* mRNA for 14-3-3 protein gamma-subtype, complete cds | 7.00E−93 |
| 7345 | NM_002350.1 | *Homo sapiens* v-yes-1 Yamaguchi sarcoma viral related oncogene homolog (LYN) mRNA > :: gb|M16038|HUMLYN Human lyn mRNA encoding a tyrosine kinase. | 3.00E−86 |
| 7346 | Y10725 | *M. musculus* mRNA for protein kinase KIS | 4.00E−68 |
| 7347 | U89931 | Cloning vector pTRE, complete sequence | 3.00E−65 |
| 7348 | Z46386 | Bovine herpesvirus type 4 DNA for nonconserved region F (DN599 like strain) | 3.00E−73 |
| 7349 | L77599 | *Homo sapiens* (clone SEL214) 17q YAC (303G8) RNA. | 2.00E−69 |
| 7351 | Y10746 | *H. sapiens* mRNA for protein containing MBD 1 | 2.00E−79 |
| 7352 | L77599 | *Homo sapiens* (clone SEL214) 17q YAC (303G8) RNA. | 2.00E−71 |
| 7353 | Z57619 | *H. sapiens* CpG island DNA genomic Mse1 fragment, clone 187a6, forward read cpg187a6.ft1b | 7.00E−72 |
| 7354 | U48807 | Human MAP kinase phosphatase (MKP-2) mRNA, complete cds | 3.00E−76 |
| 7356 | M27444 | *Bos taurus* (clone pTKD7) dopamine and cyclic AMP-regulated neuronal phosphoprotein (DARPP-32) mRNA, complete cds. | 4.00E−76 |
| 7357 | U37150 | *Bos taurus* peptide methionine sulfoxide reductase (msrA) mRNA, complete cds | 5.00E−78 |
| 7358 | U02435 | Cloning vector pSVbeta, complete sequence | 1.00E−77 |
| 7359 | U09662 | Cloning vector pSEAP-Enhancer, complete sequence | 4.00E−79 |
| 7360 | M99566 | sCos cloning vector SfiI containing bacteriophage promoters and flanking restriction sites in sCos vectors. | 1.00E−79 |
| 7362 | Z12112 | pWE15A cosmid vector DNA | 4.00E−80 |
| 7363 | U55387 | *Cricetulus griseus* SL15 mRNA, complete cds | 2.00E−82 |
| 7365 | L14684 | *Rattus norvegicus* nuclear-encoded mitochondrial elongation factor G mRNA, complete cds. | 2.00E−91 |
| 7366 | U49057 | *Rattus norvegicus* CTD-binding SR-like protein rA9 mRNA, complete cds | 7.00E−93 |
| 7367 | U57368 | *Mus musculus* EGF repeat transmembrane protein mRNA, complete cds. | 4.00E−97 |
| 7368 | AF000938 | *Mus musculus* RNA polymerase I largest subunit | 8.00E−94 |
| 7370 | X80169 | *M. musculus* mRNA for 200 kD protein | e−102 |
| 7371 | U09874 | *Mus musculus* SKD3 mRNA, complete cds. | e−105 |
| 7372 | D78020 | Rat mRNA for NFI-A4, partial cds | e−108 |
| 7611 | Z73360 | Human DNA sequence from cosmid 92M18, BRCA2 gene region chromosome 13q12–13 | 9.00E−22 |
| 7618 | X62078 | *H. sapiens* mRNA for GM2 activator protein | 7.00E−72 |
| 7619 | X85750 | *H. sapiens* mRNA for transcript associated with monocyte to macrophage differentiation | 2.00E−50 |
| 7621 | X03473 | Human gene for histone H1(0) | 1.00E−67 |
| 7631 | X64411 | *R. norvegicus* mRNA for 100 kDa protein | 1.00E−54 |
| 7634 | X13345 | Human gene for plasminogen activator inhibitor 1 | 2.00E−59 |
| 7638 | D86971 | Human mRNA for KIAA0217 gene, partial cds | 7.00E−83 |
| 7639 | NM_001859.1 | *Homo sapiens* solute carrier family 31 gb|U83460|HSU83460 Human high-affinity copper uptake protein (hCTR1) mRNA, complete cds | 7.00E−72 |
| 7640 | X68194 | *H. sapiens* h-Sp1 mRNA | 5.00E−57 |
| 7641 | AB002326 | Human mRNA for KIAA0328 gene, partial cds | 3.00E−74 |
| 7644 | D31762 | Human mRNA for KIAA0057 gene, complete cds | 3.00E−85 |
| 7646 | X58472 | Mouse KIN17 mRNA for kin17 protein | 2.00E−57 |
| 7647 | U13185 | Cloning vector pbetagal-Enhancer, complete sequence. | 2.00E−79 |
| 7648 | U55939 | Expression vector pVP-Nco, complete sequence. | 1.00E−76 |
| 7649 | D87671 | *Rattus norvegicus* mRNA for TIP120, complete cds | 1.00E−87 |
| 7650 | U25691 | *Mus musculus* lymphocyte specific helicase mRNA, complete cds | 4.00E−86 |
| 7651 | U55939 | Expression vector pVP-Nco, complete sequence. | 5.00E−79 |
| 7652 | Z12112 | pWE15A cosmid vector DNA | 2.00E−79 |
| 7653 | U13185 | Cloning vector pbetagal-Enhancer, complete sequence. | 2.00E−79 |
| 7654 | U13185 | Cloning vector pbetagal-Enhancer, complete sequence. | 6.00E−80 |
| 7655 | Z12112 | pWE15A cosmid vector DNA | 6.00E−80 |
| 7656 | U09661 | Cloning vector pSEAP-Control, complete sequence | 6.00E−80 |
| 7657 | U36909 | *Bos taurus* Rho-associated kinase mRNA, complete cds | 2.00E−90 |

TABLE 41A-continued

Nearest Neighbor (BlastN vs. Genbank)

| SEQ ID | ACC'N | DESCRIP. | P VALUE |
|---|---|---|---|
| 7658 | L36610 | *Mus musculus* protein synthesis initiation factor 4A (eIF-4A) gene, exons 5, 6, 7, 8, and 9. | 2.00E−71 |
| 7659 | S79463 | M-Sema F = a factor in neural network development | 1.00E−85 |
| 7660 | U35312 | *Mus musculus* nuclear receptor co-repressor mRNA, complete cds | 1.00E−98 |
| 7667 | L32977 | *Homo sapiens* (clone f17252) ubiquinol cytochrome c reductase Rieske iron-sulphur protein (UQCRFS1) gene, exon 2 | 0 |
| 7672 | S78454 | *Mus musculus* metal response element DNA-binding protein M96 mRNA, complete cds | 0 |
| 7682 | M88458 | Human ELP-1 mRNA sequence. | 0 |
| 7718 | S77512 | LAMB2 = laminin beta 2 chain [human, placenta, mRNA, 5642 nt] | e−131 |
| 7720 | X53305 | *H. sapiens* mRNA for stathmin | 0 |
| 7721 | J03591 | Human ADP/ATP translocase mRNA, 3' end, clone pHAT3. | 0 |
| 7726 | L18964 | Human protein kinase C iota isoform (PRKCI) mRNA, complete cds. | 2E−67 |
| 7736 | D29956 | Human mRNA for KIAA0055 gene, complete cds | 0 |
| 7745 | M26697 | Human nucleolar protein (B23) mRNA, complete cds. | e−149 |
| 7765 | U47322 | Cloning vector DNA, complete sequence. | 4E−65 |
| 7785 | NM_002079.1 | *Homo sapiens* glutamic-oxaloacetic transaminase 1, soluble (aspartate aminotransferase 1) aspartate aminotransferase mRNA, complete cds. | 0 |
| 7789 | U55939 | Expression vector pVP-Nco, complete sequence. | 2E−70 |
| 7790 | D80007 | Human mRNA for KIAA0185 gene, partial cds | 0 |
| 7791 | NM_001904.1 | *Homo sapiens* catenin (cadherin-associated protein), beta 1 (88 kD) (CTNNB1) mRNA > :: emb\|X87838\|HSRNABECA *H. sapiens* mRNA for beta-catenin | e−108 |
| 7797 | U19867 | Cloning vector pSPL3, exon splicing vector, complete sequence, HIV envelope protein gp160 and beta-lactamase, complete cds. | 1E−44 |
| 7798 | M31061 | Human ornithine decarboxylase gene, complete cds. | 0 |
| 7817 | Z96177 | *H. sapiens* telomeric DNA sequence, clone 10QTEL040, read 10QTELOO040.seq | 2E−70 |
| 7818 | NM_001904.1 | *Homo sapiens* catenin (cadherin-associated protein), beta 1 (88 kD) (CTNNB1) mRNA > :: emb\|X87838\|HSRNABECA *H. sapiens* mRNA for beta-catenin | e−176 |
| 7854 | X83577 | *M. musculus* mRNA for K-glypican | 0 |
| 7857 | S79539 | Pat-12 = Pat-12 product [mice, embryonic stem ES cells, mRNA, 2781 nt] | e−176 |
| 7869 | L38951 | *Homo sapiens* importin beta subunit mRNA, complete cds | 1E−78 |
| 7872 | NM_003902.1 | *Homo sapiens* far upstream element binding protein (FUBP) mRNA > :: gb\|U05040\|HSU05040 Human FUSE binding protein mRNA, complete cds. | 0 |
| 7887 | L08783 | BlueScribe M13 Plus cloning vector. | 0 |
| 7905 | U86751 | Human nucleolar fibrillar center protein (ASE-1) mRNA, complete cds | 8E−95 |
| 7913 | M21188 | Human insulin-degrading enzyme (IDE) mRNA, complete cds. | e−134 |
| 7927 | NM_001614.1 | *Homo sapiens* actin, gamma 1 (ACTG1) mRNA > :: emb\|X04098\|HSACTCGR Human mRNA for cytoskeletal gamma-actin | 0.00E+00 |
| 7932 | U12404 | Human Csa-19 mRNA, complete cds. | 0 |
| 7933 | X79236 | *H. sapiens* rps26 gene | e−145 |
| 7934 | NM_003313.1 | *Homo sapiens* tissue specific transplantation antigen P35B (TSTA3) mRNA > :: gb\|U58766\|HSU58766 Human FX protein mRNA, complete cds | 0 |
| 7935 | M27436 | Human tissue factor gene, complete cds, with a Alu repetitive sequence in the 3' untranslated region. > :: gb\|I05724\| Sequence 12 from Patent EP 0278776 | e−121 |
| 7945 | X79067 | *H. sapiens* ERF-1 mRNA 3' end | 0 |
| 7946 | NM_003017.1 | *Homo sapiens* splicing factor, arginine/serine-rich 3 (SFRS3) mRNA > :: gb\|L10838\|HUMSRP20 *Homo sapiens* SR protein family, pre-mRNA splicing factor (SRp20) mRNA, complete cds. | e−135 |
| 7953 | U48807 | Human MAP kinase phosphatase (MKP-2) mRNA, complete cds | 0.00E+00 |
| 7954 | U48807 | Human MAP kinase phosphatase (MKP-2) mRNA, complete cds | 0.00E+00 |
| 7969 | U04817 | Human protein kinase PITSLRE alpha 2–3 mRNA, complete cds. | 8.00E−53 |

TABLE 41A-continued

Nearest Neighbor (BlastN vs. Genbank)

| SEQ ID | ACC'N | DESCRIP. | P VALUE |
|---|---|---|---|
| 7972 | U18297 | Human MST1 (MST1) mRNA, complete cds. | 0.00E+00 |
| 7973 | NM_001859.1 | *Homo sapiens* solute carrier family 31 gb|U83460|HSU83460 Human high-affinity copper uptake protein (hCTR1) mRNA, complete cds | 0 |
| 7985 | X70272 | single stranded replicative centromeric *Saccharomyces cerevisiae/E. coli* shuttle vector | 3.00E−76 |
| 7993 | L26050 | Human mitochondrial 2,4-dienoyl-CoA reductase mRNA, complete cds. | 0.00E+00 |
| 7995 | X06747 | Human hnRNP core protein A1 | e−157 |
| 7997 | M64571 | Human microtubule-associated protein 4 mRNA, complete cds. | 0.00E+00 |
| 8004 | X65322.1 | Cloning vector pCAT-Basic | 9.00E−53 |
| 8009 | NM_002654.1 | *Homo sapiens* pyruvate kinase, muscle (PKM2) mRNA > :: gb|M23725|HUMPKM2L Human M2-type pyruvate kinase mRNA, complete cds. | e−159 |
| 8012 | U49352 | Human liver 2,4-dienoyl-CoA reductase mRNA, complete cds | 2.00E−71 |
| 8022 | D31889 | Human mRNA for KIAA0072 gene, partial cds > :: gb|G27027|G27027 human STS SHGC-31585. | e−167 |
| 8037 | U43944 | Human breast cancer cytosolic NADP(+)-dependent malic enzyme mRNA, partial cds | 1.00E−89 |
| 8067 | U83659 | Human multidrug resistance-associated protein homolog (MRP3) mRNA, partial cds | 3.00E−85 |
| 8092 | M33519 | Human HLA-B-associated transcript 3 (BAT3) mRNA, complete cds. | 3.00E−84 |
| 8093 | U55387 | *Cricetulus griseus* SL15 mRNA, complete cds | e−150 |
| 8114 | L36315 | *Mus musculus* (clone pMLZ-1) zinc finger protein | e−162 |
| 8121 | NM_003902.1 | *Homo sapiens* far upstream element binding protein (FUBP) mRNA > :: gb|U05040|HSU05040 Human FUSE binding protein mRNA, complete cds. | e−175 |
| 8128 | X56932 | *H. sapiens* mRNA for 23 kD highly basic protein | 0.00E+00 |
| 8135 | X98654 | *H. sapiens* mRNA for DRES9 protein | 9.00E−97 |
| 8146 | S62077 | HP1Hs alpha = 25 kda chromosomal autoantigen [human, mRNA, 876 nt] | 4.00E−68 |
| 8153 | M23619 | Human HMG-I protein isoform mRNA (HMGI gene), clone 6A. | e−117 |
| 8173 | NM_003217.1 | *Homo sapiens* testis enhanced gene transcript | 4E−99 |
| 8188 | U18671 | Human Stat2 gene, complete cds. | 0.00E+00 |
| 8192 | D43636 | Human mRNA for KIAA0096 gene, partial cds | 0 |
| 8194 | NM_002734.1 | *Homo sapiens* protein kinase, cAMP-dependent, regulatory, type I, alpha (tissue specific extinguisher 1) (PRKAR1A) mRNA > :: gb|M33336|HUMCAMPPK Human cAMP-dependent protein kinase type I-alpha subunit | 0 |
| 8195 | U72621 | Human LOT1 mRNA, complete cds | 0.00E+00 |
| 8208 | NM_003902.1 | *Homo sapiens* far upstream element binding protein (FUBP) mRNA > :: gb|U05040|HSU05040 Human FUSE binding protein mRNA, complete cds. | 0.00E+00 |
| 8214 | L41142 | *Homo sapiens* signal transducer and activator of transcription (STAT5) mRNA, complete cds. | 0.00E+00 |
| 8215 | Z48950 | *H. sapiens* hH3.3B gene for histone H3.3 | 0.00E+00 |
| 8249 | L09260 | Human (chromosome 3p25) membrane protein mRNA. | e−100 |
| 8254 | X65304.1 | Cloning vector pGEM-3Z | e−173 |
| 8259 | NM_003358.1 | *Homo sapiens* UDP-glucose ceramide glucosyltransferase (UGCG) mRNA > :: dbj|D50840|HUMCGA *Homo sapiens* mRNA for ceramide glucosyltransferase, complete cds > :: dbj|E12454|E12454 cDNA encoding human ceramide glucosyltransferase | e−141 |
| 8275 | M95605 | *Bos taurus* S-adenosylmethionine decarboxylase | e−175 |
| 8276 | M12623 | Human non-histone chromosomal protein HMG-17 mRNA, complete cds. | 0.00E+00 |
| 8277 | U79143 | Human phosphoinositide 3'-hydroxykinase p110-alpha subunit mRNA, complete cds | 0.00E+00 |
| 8288 | K01906 | Human fetal liver c-myc proto-oncogene, exon 3 and flanks. | e−165 |
| 8290 | X74870 | *H. sapiens* gene for RNA pol II largest subunit, exons 23–29 | e−161 |
| 8331 | L16991 | Human thymidylate kinase (CDC8) mRNA, complete cds. | 0.00E+00 |
| 8353 | L08783 | BlueScribe M13 Plus cloning vector. | 0.00E+00 |
| 8372 | NM_002245.1 | *Homo sapiens* potassium inwardly-rectifying channel, subfamily K, member 1 (KCNK1) mRNA > :: | 0 |

TABLE 41A-continued

Nearest Neighbor (BlastN vs. Genbank)

| SEQ ID | ACC'N | DESCRIP. | P VALUE |
|---|---|---|---|
| | | gb|U33632|HSU33632 Human two P-domain K+ channel TWIK-1 mRNA, complete cds. | |
| 8374 | D50734 | Rat mRNA of antizyme inhibitor, complete cds | e−157 |
| 8375 | U26401 | Human galactokinase (galK) mRNA, complete cds. > | 0.00E+00 |
| 8381 | U49058 | *Rattus norvegicus* CTD-binding SR-like protein rA4 mRNA, partial cds | e−138 |
| 8383 | X65306.1 | Cloning vector pGEM-3Zf(+) | e−116 |
| 8395 | NM_001172.1 | *Homo sapiens* arginase, type II (ARG2) mRNA > :: gb|U82256|HSU82256 *Homo sapiens* arginase type II mRNA, complete cds | e−127 |
| 8405 | M25160 | Human Na, K-ATPase beta subunit (ATP1B) gene, exons 3 through 6. | 0.00E+00 |
| 8411 | Y08736 | *H. sapiens* vegf gene, 3'UTR | 1.00E−78 |
| 8416 | U13737 | Human cysteine protease CPP32 isoform alpha mRNA, complete cds. | 0.00E+00 |
| 8419 | Y08135 | *M. musculus* mRNA for ASM-like phosphodiesterase 3a | e−148 |
| 8420 | Y08135 | *M. musculus* mRNA for ASM-like phosphodiesterase 3a | 0 |
| 8424 | NM_001677.1 | *Homo sapiens* ATPase, Na+/K+ transporting, beta 1 polypeptide (ATP1B1) mRNA > :: emb|X03747|HSATPBR Human mRNA for Na/K-ATPase beta subunit | 1E−77 |
| 8433 | Y08135 | *M. musculus* mRNA for ASM-like phosphodiesterase 3a | e−168 |
| 8460 | U54778 | Human 14-3-3 epsilon mRNA, complete cds | 1E−67 |
| 8461 | Y08135 | *M. musculus* mRNA for ASM-like phosphodiesterase 3a | 0 |
| 8464 | NM_001172.1 | *Homo sapiens* arginase, type II (ARG2) mRNA > :: gb|U82256|HSU82256 *Homo sapiens* arginase type II mRNA, complete cds | e−127 |
| 8481 | AB002293 | Human mRNA for KIAA0295 gene, partial cds | 0 |
| 8490 | M21188 | Human insulin-degrading enzyme (IDE) mRNA, complete cds. | 2E−81 |
| 8521 | D87466 | Human mRNA for KIAA0276 gene, partial cds | 1E−97 |
| 8525 | U58884 | *Mus musculus* SH3-containing protein SH3P7 mRNA, complete cds. similar to Human Drebrin | 4E−96 |
| 8537 | AB005216 | *Homo sapiens* mRNA for Nck, Ash and phospholipase C gamma-binding protein NAP4, partial cds | 0 |
| 8538 | NM_001960.1 | *Homo sapiens* eukaryotic translation elongation factor 1 delta (guanine nucleotide exchange protein) (EEF1D) mRNA > :: emb|Z21507|HSEF1DELA *H. sapiens* EF-1delta gene encoding human elongation factor-1-delta | 0.00E+00 |
| 8540 | M92449 | Human LTR mRNA, 3' end of coding region and 3' flank. | e−143 |
| 8548 | NM_003350.1 | *Homo sapiens* ubiquitin-conjugating enzyme E2 variant 2 (UBE2V2) mRNA > :: emb|X98091|HSVITDITR *H. sapiens* mRNA for protein induced by vitamin D | 0 |
| 8552 | U44975 | *Homo sapiens* DNA-binding protein CPBP (CPBP) mRNA, partial cds | 5.00E−69 |
| 8555 | Z84510 | *H. sapiens* flow-sorted chromosome 6 HindIII fragment, SC6pA28B7 | 4.00E−66 |
| 8559 | Z48042 | *H. sapiens* mRNA encoding GPI-anchored protein p137 | e−172 |
| 8593 | U32986 | Human xeroderma pigmentosum group E UV-damaged DNA binding factor mRNA, complete cds. | 0 |
| 8611 | NM_003419.1 | *Homo sapiens* zinc finger protein 10 (KOX 1) for zinc finger protein | e−129 |
| 8616 | Y00711 | Human mRNA for lactate dehydrogenase B (LDH-B) | 0.00E+00 |
| 8622 | Y10725 | *M. musculus* mRNA for protein kinase KIS | 0.00E+00 |
| 8639 | X62078 | *H. sapiens* mRNA for GM2 activator protein | e−164 |
| 8644 | NM_001009.1 | *Homo sapiens* ribosomal protein S5 (RPS5) mRNA complete cds. | 0.00E+00 |
| 8652 | U97188 | *Homo sapiens* putative RNA binding protein KOC | 1E−86 |
| 8671 | NM_002852.1 | *Homo sapiens* pentaxin-related gene, rapidly induced by IL-1 beta (PTX3) mRNA > :: emb|X63613|HSPTX3R *H. sapiens* mRNA for pentaxin (PTX3) | 0.00E+00 |
| 8674 | X67155 | *H. sapiens* mRNA for mitotic kinesin-like protein-1 | 0.00E+00 |
| 8684 | M54968 | Human K-ras oncogene protein mRNA, complete cds> | e−123 |
| 8687 | D88687 | *Homo sapiens* mRNA for KM-102-derived reductase-like factor, complete cds | 0 |

TABLE 41A-continued

| | | Nearest Neighbor (BlastN vs. Genbank) | |
|---|---|---|---|
| SEQ ID | ACC'N | DESCRIP. | P VALUE |
| 8689 | NM_001436.1 | *Homo sapiens* fibrillarin (FBL) mRNA > :: gb|M59849|HUMFIBAA Human fibrillarin (Hfib1) mRNA, complete cds. | e−103 |
| 8691 | AB002326 | Human mRNA for KIAA0328 gene, partial cds | 0.00E+00 |
| 8694 | M11948 | Human promyelocytic leukemia cell mRNA, clones pHH58 and pHH81. | 9.00E−84 |

TABLE 41B

| | | Nearest Neighbor (BlastX vs. Non-Redundant Proteins) | |
|---|---|---|---|
| SEQ ID | ACC'N | DESCRIP. | P VALUE |
| 6133 | 4239895 | (AB016816) MASL1 [*Homo sapiens*] | 9.00E−54 |
| 6162 | 4514653 | (AB024057) vascular Rab-GAP/TBC-containing protein [*Homo sapiens*] | 6.00E−55 |
| 6174 | 4454524 | (AC004841) similar to insulin receptor substrate BAP2; similar to PID: g4126477 [*Homo sapiens*] | 6.00E−22 |
| 6175 | 4545264 | (AF118240) peroxisomal biogenesis factor 16 [*Homo sapiens*] | 1.00E−45 |
| 6208 | 3413938 | (AB007963) KIAA0494 protein [*Homo sapiens*] | 3.00E−44 |
| 6218 | 4239895 | (AB016816) MASL1 [*Homo sapiens*] | 1.00E−47 |
| 6235 | 4502371 | breast cancer antiestrogen resistance 3 >gi|3237306 (U92715) breast cancer antiestrogen resistance 3 protein [*Homo sapiens*] | 2.00E−44 |
| 6250 | 4586880 | (AB017114) AD 3 [*Homo sapiens*] | 4.00E−48 |
| 6253 | 3327170 | (AB014578) KIAA0678 protein [*Homo sapiens*] | 2.00E−51 |
| 6264 | 3153241 | (AF053004) class I cytokine receptor [*Homo sapiens*] | 2.00E−17 |
| 6267 | 4138233 | (AJ007780) parp-2 gene [*Mus musculus*] | 2.00E−32 |
| 6270 | 3287173 | (AJ006266) AND-1 protein [*Homo sapiens*] | 2.00E−42 |
| 6283 | 4507145 | UNKNOWN >gi|3873216 (AF065485) sorting nexin 4 [*Homo sapiens*] | 8.00E−46 |
| 6303 | 4153860 | (AC005074) similar to U47321 (PID: g1245146) [*Homo sapiens*] | 4.00E−15 |
| 6320 | 3236430 | (AF067379) ubiquitin-protein ligase E3-alpha [*Mus musculus*] | 3.00E−35 |
| 6349 | 3043696 | (AB011158) KIAA0586 protein [*Homo sapiens*] | 1.00E−44 |
| 6356 | 4519623 | (AB017616) homologous to the yeast YGR163 gene [*Mus musculus*] | 2.00E−54 |
| 6376 | 4455035 | (AF116238) pseudouridine synthase 1 [*Homo sapiens*] | 4.00E−48 |
| 6400 | 3075377 | (AC004602) F23487_2 [*Homo sapiens*] | 2.00E−21 |
| 6402 | 4505611 | poly(A)-specific ribonuclease | 7.00E−41 |
| 6469 | 1825606 | (U88169) similar to molybdoterin biosynthesis MOEB proteins [*Caenorhabditis elegans*] | 2.00E−37 |
| 6478 | 4586287 | (AB004794) DUF140 [*Xenopus laevis*] | 7.00E−45 |
| 6492 | 3941342 | (AF043250) mitochondrial outer membrane protein [*Homo sapiens*] >gi|3941347 (AF043253) mitochondrial outer membrane protein [*Homo sapiens*] >gi|4105703|gb|AAD02504| | 5.00E−40 |
| 6510 | 4586844 | (AB015633) type II membrane protein | 2.00E−46 |
| 6518 | 3327078 | (AB014532) KIAA0632 protein [*Homo sapiens*] | 6.00E−36 |
| 6529 | 3327230 | (AB014608) KIAA0708 protein [*Homo sapiens*] | 5.00E−52 |
| 6568 | 3372677 | (AF061749) tumorous imaginal discs protein Tid56 homolog | 7.00E−35 |
| 6598 | 4050034 | (AF098482) transcriptional coactivator p52 [*Homo sapiens*] | 1.00E−36 |
| 6600 | 4406632 | (AF131801) Unknown [*Homo sapiens*] | 3.00E−21 |
| 6608 | 3114828 | (AJ005897) JM5 [*Homo sapiens*] | 3.00E−44 |
| 6626 | 3766209 | (AF071777) IRE1 [*Mus musculus*] | 2.00E−29 |
| 6657 | 3043644 | (AB011132) KIAA0560 protein [*Homo sapiens*] | 3.00E−43 |
| 6668 | 3088575 | (AF059531) protein arginine N-methyltransferase 3 [*Homo sapiens*] | 4.00E−46 |
| 6674 | 4505891 | UNKNOWN >gi|3153235 (AF046889) lysyl hydroxylase isoform 3 [*Homo sapiens*] >gi|3551836 | 3.00E−30 |
| 6686 | 3114828 | (AJ005897) JM5 [*Homo sapiens*] | 1.00E−24 |
| 6688 | 3242214 | (AJ006778) DRIM protein [*Homo sapiens*] | 2.00E−36 |
| 6694 | 4200236 | (AL035308) hypothetical protein [*Homo sapiens*] | 8.00E−09 |
| 6696 | 3413892 | (AB007934) KIAA0465 protein [*Homo sapiens*] | 2.00E−51 |
| 6731 | 3043626 | (AB011123) KIAA0551 protein [*Homo sapiens*] | 3.00E−31 |

TABLE 41B-continued

| | | Nearest Neighbor (BlastX vs. Non-Redundant Proteins) | |
|---|---|---|---|
| SEQ ID | ACC'N | DESCRIP. | P VALUE |
| 6739 | 2498864 | RRP5 PROTEIN HOMOLOG (KIAA0185) hypothetical protein YM9959.11C of *S. cerevisiae*. [*Homo sapiens*] | 3.00E−13 |
| 6766 | 3402197 | (AJ010014) M96A protein [*Homo sapiens*] | 1.00E−21 |
| 6773 | 2217964 | (Z50798) p52 [*Gallus gallus*] | 7.00E−14 |
| 6782 | 3043626 | (AB011123) KIAA0551 protein [*Homo sapiens*] | 1.00E−40 |
| 6793 | 135470 | TUBULIN BETA-5 CHAIN *sapiens*] | 3.00E−21 |
| 6797 | 3327056 | (AB014521) KIAA0621 protein [*Homo sapiens*] | 2.00E−29 |
| 6800 | 4506787 | UNKNOWN GTPASE-ACTIVATING-LIKE PROTEIN IQGAP1 (P195) (KIAA0051) protein - human >gi|473931|dbj|BAA06123| (D29640) KIAA0051 [*Homo sapiens*] >gi|536844 (L33075) ras GTPase-activating-like protein [*Homo sapiens*] | 4.00E−41 |
| 6805 | 1350762 | 60S RIBOSOMAL PROTEIN L6 *sapiens*] | 2.00E−22 |
| 6809 | 2687400 | (AF035824) vesicle soluble NSF attachment protein receptor [*Homo sapiens*] | 1.00E−23 |
| 6826 | 2914385 | Chain C, Human Pcna >gi|2914387|pdb|1AXC|E Chain E, Human Pcna | 2.00E−27 |
| 6827 | 284076 | ERD-2-like protein, ELP-1 - human | 1.00E−26 |
| 6829 | 2497524 | KINESIN-LIKE PROTEIN KIF1B mouse >gi|407339|dbj|BAA04503| (D17577) Kif1b [*Mus musculus*] | 9.00E−33 |
| 6831 | 3327056 | (AB014521) KIAA0621 protein [*Homo sapiens*] | 1.00E−13 |
| 6832 | 279567 | insulinase (EC 3.4.99.45) - human | 2.00E−26 |
| 6834 | 487416 | (L20302) actin filament protein [*Gallus gallus*] | 3.00E−45 |
| 6835 | 1731428 | ZINC FINGER PROTEIN ZFP-38 | 7.00E−35 |
| 6836 | 968973 | (U29156) involved in signaling by the epidermal growth factor receptor; Method: conceptual translation supplied by author. [*Mus musculus*] | 1.00E−22 |
| 6837 | 1552350 | (Y08135) acid sphingomyelinase-like phosphodiesterase [*Mus musculus*] | 2.00E−35 |
| 6838 | 3327098 | (AB014542) KIAA0642 protein [*Homo sapiens*] | 3.00E−15 |
| 6839 | 3914801 | DNA-DIRECTED RNA POLYMERASE I 135 KD POLYPEPTIDE (RNA POLYMERASE I SUBUNIT 2) (RPA135) (RNA POLYMERASE I 127 KD SUBUNIT) >gi|2739048 (AF025424) RNA polymerase I 127 kDa subunit [*Rattus norvegicus*] | 2.00E−45 |
| 6841 | 4165018 | (D89053) Acyl-CoA synthetase 3 [*Homo sapiens*] | 2.00E−53 |
| 6842 | 968973 | (U29156) involved in signaling by the epidermal growth factor receptor; Method: conceptual translation supplied by author. [*Mus musculus*] | 3.00E−40 |
| 6843 | 4519883 | (AB017970) dipeptidyl peptidase III | 4.00E−50 |
| 6844 | 3327052 | (AB014519) KIAA0619 protein [*Homo sapiens*] | 7.00E−30 |
| 6845 | 538413 | (L36315) zinc finger protein [*Mus musculus*] | 6.00E−55 |
| 6846 | 1717793 | PROTEIN TSG24 (MEIOTIC CHECK POINT REGULATOR) >gi|1083553|pir||A55117 tsg24 protein - mouse | 1.00E−50 |
| 6847 | 3420277 | (AF064826) glypican 4 [*Homo sapiens*] | 3.00E−54 |
| 6904 | 4580645 | (AF118855) trans-prenyltransferase [*Mus musculus*] | 2.00E−48 |
| 6925 | 3882171 | (AB018268) KIAA0725 protein [*Homo sapiens*] | 3.00E−24 |
| 6929 | 4104976 | (AF043117) ubiquitin-fusion degradation protein 2 [*Homo sapiens*] | 2.00E−41 |
| 6937 | 3242214 | (AJ006778) DRIM protein [*Homo sapiens*] | 4.00E−34 |
| 7010 | 4191810 | (AB006532) DNA helicase [*Homo sapiens*] | 5.00E−41 |
| 7055 | 3043714 | (AB011167) KIAA0595 protein [*Homo sapiens*] | 5.00E−20 |
| 7078 | 4379097 | (Y17999) Dyrk1 B protein kinase [*Homo sapiens*] | 3.00E−21 |
| 7124 | 3043712 | (AB011166) KIAA0594 protein [*Homo sapiens*] | 2.00E−49 |
| 7175 | 4240227 | (AB020676) KIAA0869 protein [*Homo sapiens*] | 4.00E−35 |
| 7187 | 4235226 | (AF061025) leucine zipper-EF-hand containing transmembrane protein 1 [*Homo sapiens*] | 6.00E−34 |
| 7230 | 3426268 | (AF044201) neural membrane protein 35; NMP35 [*Rattus norvegicus*] | 1.00E−29 |
| 7248 | 4507367 | threonyl-tRNA synthetase SYNTHETASE, CYTOPLASMIC (THREONINE--TRNA LIGASE) (THRRS) 6.1.1.3) - human >gi|1464742 (M63180) threonyl-tRNA synthetase [*Homo sapiens*] | 3.00E−26 |
| 7249 | 2072294 | (U95097) mitotic phosphoprotein 43 [*Xenopus laevis*] | 1.00E−19 |
| 7259 | 543222 | glutamine (Q)-rich factor 1, QRF-1 - mouse factor 1, QRF-1 [mice, B-cell leukemia, BCL1, Peptide Partial, 84 aa] | 1.00E−39 |
| 7260 | 3335569 | (AF072759) fatty acid transport protein 4; FATP4 [*Mus musculus*] | 7.00E−39 |
| 7264 | 2996194 | (AF053232) SIK similar protein [*Mus musculus*] | 1.00E−31 |
| 7268 | 2935597 | (AC004262) R29368__2 [*Homo sapiens*] | 6.00E−49 |
| 7297 | 2645205 | (U63648) p160 myb-binding protein [*Mus musculus*] | 1.00E−21 |

TABLE 41B-continued

| | | Nearest Neighbor (BlastX vs. Non-Redundant Proteins) | |
|---|---|---|---|
| SEQ ID | ACC'N | DESCRIP. | P VALUE |
| 7300 | 1407655 | (U58884) SH3P7 [*Mus musculus*] | 8.00E−21 |
| 7310 | 2134381 | polybromo 1 protein - chicken | 8.00E−29 |
| 7315 | 4505613 | PRKC, apoptosis, WT1, regulator par-4 [*Homo sapiens*] | 6.00E−34 |
| 7325 | 3757892 | (AF079765) enhancer of polycomb [*Mus musculus*] | 3.00E−41 |
| 7327 | 2134436 | zinc finger protein - chicken (fragment) | 4.00E−37 |
| 7328 | 2393722 | (U90313) glutathione-S-transferase homolog [*Homo sapiens*] | 6.00E−34 |
| 7330 | 459002 | (U00036) R151.6 gene product [*Caenorhabditis elegans*] | 7.00E−10 |
| 7332 | 119530 | PROTEIN DISULFIDE ISOMERASE-RELATED PROTEIN PRECURSOR (ERP72) >gi|87320|pir||A23723 protein disulfide-isomerase (EC 5.3.4.1) ERp72 precursor - human protein [*Homo sapiens*] | 3.00E−23 |
| 7335 | 2073541 | (L19437) transaldolase [*Homo sapiens*] >gi|2612879 | 2.00E−24 |
| 7337 | 984125 | (X90857) - 14 [*Homo sapiens*] | 2.00E−23 |
| 7341 | 4106818 | (AF083395) phospholipase A2-activating protein [*Homo sapiens*] | 4.00E−36 |
| 7343 | 4507955 | YY1 transcription factor REPRESSOR PROTEIN YY1 (YIN AND YANG 1) (YY-1) (DELTA TRANSCRIPTION FACTOR) (NF-E1) >gi|38011|emb|CAA78455| | 4.00E−27 |
| 7346 | 1698779 | (U70372) PAM COOH-terminal interactor protein 2 [*Rattus norvegicus*] | 6.00E−35 |
| 7348 | 4204684 | (AF102542) beta-1,6-N-acetylglucosaminyltransferase core 2/core 4 beta-1,6-N-acetylglucosaminyltransferase; core 2/4-GnT [*Homo sapiens*] | 9.00E−43 |
| 7351 | 2239126 | (Y10746) methyl-CpG binding protein [*Homo sapiens*] | 4.00E−16 |
| 7355 | 1747519 | (U76759) nuclear protein NIP45 [*Mus musculus*] | 2.00E−29 |
| 7356 | 545790 | DARPP-32 = dopamine and cAMP-regulated phosphoprotein [human, brain, Peptide, 204 aa] | 1.00E−29 |
| 7357 | 1709689 | PEPTIDE METHIONINE SULFOXIDE REDUCTASE (PEPTIDE MET(O) REDUCTASE) >gi|1205993 *taurus*] | 1.00E−37 |
| 7361 | 2736151 | (AF021935) myotonic dystrophy kinase-related Cdc42-binding kinase [*Rattus norvegicus*] | 1.00E−41 |
| 7363 | 3329392 | (AF038961) SL15 protein [*Homo sapiens*] | 8.00E−36 |
| 7364 | 4097712 | (U67322) HBV associated factor [*Homo sapiens*] | 7.00E−56 |
| 7365 | 585084 | ELONGATION FACTOR G, MITOCHONDRIAL PRECURSOR (MEF-G) >gi|543383|pir||S40780 translation elongation factor G, mitochondrial - rat >gi|310102 | 7.00E−49 |
| 7366 | 1438534 | (U49057) rA9 [*Rattus norvegicus*] | 3.00E−45 |
| 7367 | 1336628 | (U57368) EGF repeat transmembrane protein [*Mus musculus*] | 7.00E−47 |
| 7368 | 3914802 | DNA-DIRECTED RNA POLYMERASE I LARGEST SUBUNIT (RNA POLYMERASE I 194 KD SUBUNIT) (RPA194) | 1.00E−37 |
| 7369 | 3387977 | (AF070598) ABC transporter [*Homo sapiens*] | 5.00E−50 |
| 7370 | 1717793 | PROTEIN TSG24 (MEIOTIC CHECK POINT REGULATOR) >gi|1083553|pir||A55117 tsg24 protein - mouse | 2.00E−48 |
| 7371 | 2493735 | SKD3 PROTEIN SKD3 [*Mus musculus*] | 7.00E−43 |
| 7372 | 1041038 | (D78020) NFI-A4 [*Rattus norvegicus*] | 3.00E−26 |
| 7380 | 4455118 | (AF125158) zinc finger DNA binding protein 99 | 9.00E−41 |
| 7418 | 4049922 | (AF072810) transcription factor WSTF [*Homo sapiens*] | 4.00E−48 |
| 7434 | 4586287 | (AB004794) DUF140 [*Xenopus laevis*] | 3.00E−45 |
| 7441 | 3435244 | (AF083322) centriole associated protein CEP110 [*Homo sapiens*] | 2.00E−40 |
| 7466 | 3413886 | (AB007931) KIAA0462 protein [*Homo sapiens*] | 2.00E−35 |
| 7558 | 3882311 | (AB018338) KIAA0795 protein [*Homo sapiens*] | 4.00E−47 |
| 7593 | 4240167 | (AB020646) KIAA0839 protein [*Homo sapiens*] | 2.00E−46 |
| 7613 | 4191610 | (AF117107) IGF-II mRNA-binding protein 2 [*Homo sapiens*] | 3.00E−49 |
| 7615 | 3135669 | (AF064084) prenylcysteine carboxyl methyltransferase | 1.00E−39 |
| 7625 | 3043548 | (AB011084) KIAA0512 protein [*Homo sapiens*] | 2.00E−47 |
| 7627 | 3093476 | (AF008915) EVI-5 homolog [*Homo sapiens*] | 6.00E−19 |
| 7628 | 3834629 | (AF094519) diaphanous-related formin; p134 mDia2 [*Mus musculus*] | 1.00E−32 |

TABLE 41B-continued

Nearest Neighbor (BlastX vs. Non-Redundant Proteins)

| SEQ ID | ACC'N | DESCRIP. | P VALUE |
|---|---|---|---|
| 7629 | 3193226 | (AF068706) gamma2-adaptin [Homo sapiens] | 1.00E−46 |
| 7630 | 3851584 | (AF092563) chromosome-associated protein-E [Homo sapiens] | 4.00E−48 |
| 7631 | 4101695 | (AF006010) progestin induced protein [Homo sapiens] | 5.00E−30 |
| 7646 | 3850704 | (AJ005273) Kin17 [Homo sapiens] | 9.00E−24 |
| 7649 | 4240147 | (AB020636) KIAA0829 protein [Homo sapiens] | 9.00E−41 |
| 7650 | 2137490 | lymphocyte specific helicase - mouse musculus] | 5.00E−35 |
| 7657 | 3327052 | (AB014519) KIAA0619 protein [Homo sapiens] | 1.00E−41 |
| 7659 | 2137494 | M-sema F protein precursor - mouse F [mice, neonatal brain, Peptide, 834 aa] [Mus sp.] | 7.00E−34 |
| 7660 | 2137603 | nuclear receptor co-repressor N-CoR - mouse musculus] >gi|1583865|prf||2121436A thyroid hormone receptor co-repressor [Mus musculus] | 9.00E−41 |
| 7661 | 2674107 | (AF023451) guanine nucleotide-exchange protein [Bos taurus] | 3.00E−48 |
| 7683 | 3659505 | (AC005084) similar to mouse mCASK-A; similar to e1288039 | 1.00E−57 |
| 7745 | 114762 | NUCLEOPHOSMIN (NPM) (NUCLEOLAR PHOSPHOPROTEIN B23) (NUMATRIN) (NUCLEOLAR PROTEIN NO38) sapiens] | 6.00E−35 |
| 7747 | 3327056 | (AB014521) KIAA0621 protein [Homo sapiens] | 8.00E−40 |
| 7784 | 4545264 | (AF118240) peroxisomal biogenesis factor 16 [Homo sapiens] | 2.00E−65 |
| 7790 | 2498864 | RRP5 PROTEIN HOMOLOG (KIAA0185) hypothetical protein YM9959.11C of S. cerevisiae. [Homo sapiens] | 7.00E−77 |
| 7854 | 3420277 | (AF064826) glypican 4 [Homo sapiens] | 4.00E−76 |
| 7864 | 3088575 | (AF059531) protein arginine N-methyltransferase 3 [Homo sapiens] | 7.00E−97 |
| 7867 | 4050034 | (AF098482) transcriptional coactivator p52 [Homo sapiens] | 2.00E−58 |
| 7907 | 4506357 | UNKNOWN; PZR >gi|3851145 sapiens] | 2.00E−60 |
| 7926 | 3387977 | (AF070598) ABC transporter [Homo sapiens] | e−113 |
| 7932 | 1709974 | 60S RIBOSOMAL PROTEIN L10A protein L10a [Rattus norvegicus] Ribosomal Protein RPL10A) [Homo sapiens] | e−111 |
| 7934 | 4507709 | tissue specific transplantation antigen P35B >gi|1381179 (U58766) FX [Homo sapiens] | 9.00E−90 |
| 7972 | 1117791 | (U18297) MST1 [Homo sapiens] | 4E−85 |
| 7973 | 4507015 | copper transporter 1 | 3.00E−72 |
| 7993 | 4503301 | 2,4-dienoyl CoA reductase REDUCTASE, MITOCHONDRIAL PRECURSOR (2,4-DIENOYL-COA REDUCTASE (NADPH)) (4-ENOYL-COA REDUCTASE (NADPH)) precursor, mitochondrial - human >gi|602703 (L26050) 2,4-dienoyl-CoA reductase [Homo sapiens] >gi|2673979 precursor [Homo sapiens] >gi|4126313 (AF049895) 2,4-dienoyl-CoA reductase [Homo sapiens] | 6E−94 |
| 7997 | 126743 | MICROTUBULE-ASSOCIATED PROTEIN 4 human >gi|187383 (M64571) microtubule-associated protein 4 [Homo sapiens] | 6E−84 |
| 8010 | 4505987 | PTPRF interacting protein, binding protein 1 (liprin beta 1) >gi|3309539 (AF034802) liprin-beta1 [Homo sapiens] | 4E−89 |
| 8016 | 3043644 | (AB011132) KIAA0560 protein [Homo sapiens] | e−108 |
| 8040 | 3413892 | (AB007934) KIAA0465 protein [Homo sapiens] | 7.00E−87 |
| 8052 | 4185796 | (AF103796) placenta-specific ATP-binding cassette transporter [Homo sapiens] | 2E−68 |
| 8069 | 4507145 | UNKNOWN >gi|3873216 (AF065485) sorting nexin 4 [Homo sapiens] | 1.00E−73 |
| 8104 | 1083566 | zinc finger protein/transactivator Zfp-38 - mouse >gi|55477|emb|CAA45280|(X63747) Zfp-38 [Mus musculus] | 2E−64 |
| 8114 | 1806134 | (Z67747) zinc finger protein [Mus musculus] | 7.00E−78 |
| 8128 | 730451 | 60S RIBOSOMAL PROTEIN L13A (23 KD HIGHLY BASIC PROTEIN) >gi|345897|pir||S29539 basic protein, 23 K - human >gi|23691|emb|CAA40254|(X56932) 23 kD highly basic protein [Homo sapiens] | 4.00E−87 |
| 8381 | 4102967 | (AF023142) pre-mRNA splicing SR protein rA4 [Homo sapiens] | 1.00E−33 |
| 8413 | 3108093 | (AF061258) LIM protein [Homo sapiens] | 6.00E−82 |
| 8414 | 3170887 | (AF061555) ubiquitin-protein ligase E3-alpha [Mus musculus] | e−104 |
| 8420 | 1552350 | (Y08135) acid sphingomyelinase-like phosphodiesterase [Mus musculus] | 6.00E−91 |

TABLE 41B-continued

Nearest Neighbor (BlastX vs. Non-Redundant Proteins)

| SEQ ID | ACC'N | DESCRIP. | P VALUE |
|---|---|---|---|
| 8461 | 1552350 | (Y08135) acid sphingomyelinase-like phosphodiesterase [*Mus musculus*] | e−106 |
| 8462 | 3242214 | (AJ006778) DRIM protein [*Homo sapiens*] | e−114 |
| 8483 | 4514653 | (AB024057) vascular Rab-GAP/TBC-containing protein [*Homo sapiens*] | e−121 |
| 8537 | 2443367 | (AB005216) Nck, Ash and phospholipase C gamma-binding protein NAP4 [*Homo sapiens*] | e−120 |
| 8571 | 119110 | EBNA-1 NUCLEAR PROTEIN herpesvirus 4 (strain B95-8) >gi|1334880|emb|CAA24816.1|gene. [Human herpesvirus 4] | 2.00E−38 |
| 8575 | 121640 | GLYCINE-RICH CELL WALL STRUCTURAL PROTEIN PRECURSOR >gi|72320|pir||KNMU glycine-rich cell wall protein precursor - *Arabidopsis thaliana* | 8.00E−31 |
| 8591 | 1362077 | glycin-rich protein - cowpea (fragment) | 2E−40 |
| 8615 | 121640 | GLYCINE-RICH CELL WALL STRUCTURAL PROTEIN PRECURSOR >gi|72320|pir||KNMU glycine-rich cell wall protein precursor - *Arabidopsis thaliana* | 9.00E−27 |
| 8642 | 2674107 | (AF023451) guanine nucleotide-exchange protein [*Bos taurus*] | 5E−89 |
| 8644 | 3717978 | (Y12431) 5S ribosomal protein [*Mus musculus*] | 5E−94 |
| 8652 | 4191610 | (AF117107) IGF-II mRNA-binding protein 2 [*Homo sapiens*] | e−111 |
| 8674 | 2119281 | CHO1 antigen - Chinese hamster | e−101 |
| 8675 | 3435244 | (AF083322) centriole associated protein CEP110 [*Homo sapiens*] | 2E−70 |
| 8687 | 1843434 | (D88687) KM-102-derived reductase-like factor [*Homo sapiens*] | 4.00E−91 |
| 8700 | 3834629 | (AF094519) diaphanous-related formin; p134 mDia2 [*Mus musculus*] | 1E−49 |

Example 29

Members of Protein Families

SEQ ID NOS: 7662-8706 were used to conduct a profile search as described in the specification above. Several of the polynucleotides of the invention were found to encode polypeptides having characteristics of a polypeptide belonging to a known protein family (and thus represent new members of these protein families) and/or comprising a known functional domain (Table 42A, inserted prior to claims). Table 42A provides the SEQ ID NO: of the query sequence, a brief description of the profile hit, the position of the query sequence within the individual sequence (indicated as "start" and "stop"), and the orientation (Direction) of the query sequence with respect to the individual sequence, where forward (for) indicates that the alignment is in the same direction (left to right) as the sequence provided in the Sequence Listing and reverse (rev) indicates that the alignment is with a sequence complementary to the sequence provided in the Sequence Listing.

TABLE 42A

Profile Hits

| SEQ ID NO: | Description | Start | Stop | Dir |
|---|---|---|---|---|
| 8063 | 14_3_3 proteins | 166 | 845 | for |
| 8462 | 3'5'-cyclic nucleotide phosphodiesterases | 64 | 573 | for |
| 7675 | 4 transmembrane integral membrane proteins | 300 | 924 | rev |
| 8074 | 4 transmembrane integral membrane proteins | 340 | 941 | rev |
| 7748 | 7 transmembrane receptor (rhodopsin family) | 109 | 647 | rev |
| 8023 | 7 transmembrane receptor (rhodopsin family) | 84 | 947 | rev |
| 8164 | 7 transmembrane receptor (rhodopsin family) | 305 | 975 | for |
| 7694 | 7 transmembrane receptor (Secretin family) | 50 | 1269 | for |
| 7815 | 7 transmembrane receptor (Secretin family) | 63 | 1160 | rev |
| 8007 | 7 transmembrane receptor (Secretin family) | 38 | 869 | rev |
| 8023 | 7 transmembrane receptor (Secretin family) | 237 | 930 | rev |
| 8164 | 7 transmembrane receptor (Secretin family) | 188 | 975 | for |
| 8437 | 7 transmembrane receptor (Secretin family) | 377 | 1524 | rev |
| 7767 | ATPases Associated with Various Cellular Activities | 136 | 718 | for |
| 7768 | ATPases Associated with Various Cellular Activities | 271 | 765 | for |
| 7784 | ATPases Associated with Various Cellular Activities | 206 | 709 | rev |
| 7892 | ATPases Associated with Various Cellular Activities | 139 | 783 | for |
| 7926 | ATPases Associated with Various Cellular Activities | 265 | 713 | for |
| 7968 | ATPases Associated with Various Cellular Activities | 152 | 616 | rev |

TABLE 42A-continued

Profile Hits

| SEQ ID NO: | Description | Start | Stop | Dir |
|---|---|---|---|---|
| 8009 | ATPases Associated with Various Cellular Activities | 12 | 510 | for |
| 8018 | ATPases Associated with Various Cellular Activities | 125 | 658 | for |
| 8060 | ATPases Associated with Various Cellular Activities | 97 | 752 | for |
| 8093 | ATPases Associated with Various Cellular Activities | 185 | 664 | for |
| 8128 | ATPases Associated with Various Cellular Activities | 69 | 485 | for |
| 8266 | ATPases Associated with Various Cellular Activities | 73 | 550 | for |
| 8273 | ATPases Associated with Various Cellular Activities | 340 | 928 | for |
| 8386 | ATPases Associated with Various Cellular Activities | 872 | 1390 | rev |
| 8439 | ATPases Associated with Various Cellular Activities | 122 | 635 | for |
| 8454 | ATPases Associated with Various Cellular Activities | 84 | 492 | rev |
| 8486 | ATPases Associated with Various Cellular Activities | 31 | 434 | rev |
| 8510 | ATPases Associated with Various Cellular Activities | 953 | 1358 | rev |
| 8557 | ATPases Associated with Various Cellular Activities | 192 | 690 | rev |
| 8572 | ATPases Associated with Various Cellular Activities | 51 | 593 | for |
| 8578 | ATPases Associated with Various Cellular Activities | 135 | 615 | rev |
| 8674 | ATPases Associated with Various Cellular Activities | 0 | 673 | for |
| 7719 | Basic region plus leucine zipper transcription factors | 81 | 277 | for |
| 7811 | C2 domain (prot. kinase C like) | 403 | 582 | for |
| 8522 | C2 domain (prot. kinase C like) | 493 | 637 | for |
| 8334 | Cysteine proteases | 359 | 984 | rev |
| 7726 | DEAD and DEAH box helicases | 34 | 690 | rev |
| 7961 | DEAD and DEAH box helicases | 43 | 753 | for |
| 8613 | DEAD and DEAH box helicases | 426 | 719 | for |
| 7810 | Dual specificity phosphatase, catalytic domain | 365 | 696 | rev |
| 7824 | Dual specificity phosphatase, catalytic domain | 243 | 597 | for |
| 8183 | Dual specificity phosphatase, catalytic domain | 786 | 1566 | for |
| 7691 | EF-hand | 556 | 630 | for |
| 7767 | Eukaryotic aspartyl proteases | 116 | 763 | for |
| 7874 | Eukaryotic aspartyl proteases | 92 | 1008 | rev |
| 7999 | Eukaryotic aspartyl proteases | 73 | 603 | rev |
| 8041 | Eukaryotic aspartyl proteases | 147 | 694 | rev |
| 8059 | Eukaryotic aspartyl proteases | 38 | 740 | rev |
| 8087 | Eukaryotic aspartyl proteases | 404 | 1113 | rev |
| 8226 | Eukaryotic aspartyl proteases | 237 | 829 | rev |
| 8234 | Eukaryotic aspartyl proteases | 117 | 729 | rev |
| 8289 | Eukaryotic aspartyl proteases | 217 | 1397 | rev |
| 8386 | Eukaryotic aspartyl proteases | 413 | 1366 | rev |
| 8387 | Eukaryotic aspartyl proteases | 8 | 710 | rev |
| 8444 | Eukaryotic aspartyl proteases | 291 | 1146 | rev |
| 8526 | Eukaryotic aspartyl proteases | 216 | 1158 | rev |
| 8592 | Eukaryotic aspartyl proteases | 228 | 659 | for |
| 8619 | Eukaryotic aspartyl proteases | 276 | 1291 | rev |
| 8685 | Eukaryotic aspartyl proteases | 525 | 1431 | for |
| 8064 | Fibronectin type II domain | 455 | 565 | rev |
| 7875 | G-protein alpha subunit | 24 | 583 | rev |
| 7717 | Helicases conserved C-terminal domain | 160 | 309 | for |
| 7748 | Helicases conserved C-terminal domain | 363 | 560 | rev |
| 8288 | Helix-loop-helix DNA binding domain | 224 | 382 | for |
| 8277 | kinase domain of tors | 474 | 713 | for |
| 7921 | mkk like kinases | 17 | 626 | rev |
| 7972 | mkk like kinases | 35 | 719 | for |
| 8135 | mkk like kinases | 114 | 527 | for |
| 8622 | mkk like kinases | 9 | 463 | for |
| 7878 | Neurotransmitter-gated ion-channel | 267 | 1411 | for |
| 8018 | Neurotransmitter-gated ion-channel | 367 | 1168 | for |
| 8164 | Neurotransmitter-gated ion-channel | 222 | 1024 | for |
| 8198 | Neurotransmitter-gated ion-channel | 352 | 1273 | for |
| 8250 | Neurotransmitter-gated ion-channel | 377 | 1159 | for |
| 8634 | Neurotransmitter-gated ion-channel | 112 | 1120 | for |
| 7717 | protein kinase | 153 | 743 | for |
| 7726 | protein kinase | 123 | 904 | for |
| 7801 | protein kinase | 471 | 1072 | for |
| 7802 | protein kinase | 190 | 609 | for |
| 7806 | protein kinase | 235 | 641 | for |
| 7840 | protein kinase | 8 | 711 | rev |
| 7863 | protein kinase | 90 | 537 | for |
| 7872 | protein kinase | 200 | 524 | rev |
| 7878 | protein kinase | 706 | 1331 | for |
| 7918 | protein kinase | 24 | 666 | for |
| 7921 | protein kinase | 56 | 593 | rev |
| 7940 | protein kinase | 263 | 824 | for |
| 7946 | protein kinase | 217 | 779 | for |
| 7972 | protein kinase | 290 | 711 | for |
| 8073 | protein kinase | 38 | 776 | for |
| 8147 | protein kinase | 14 | 657 | for |
| 8208 | protein kinase | 202 | 644 | rev |
| 8265 | protein kinase | 1 | 656 | for |
| 8301 | protein kinase | 57 | 689 | for |
| 8338 | protein kinase | 33 | 646 | for |
| 8387 | protein kinase | 630 | 1148 | rev |
| 8550 | protein kinase | 49 | 761 | rev |
| 8622 | protein kinase | 0 | 463 | for |
| 8654 | protein kinase | 77 | 590 | for |
| 7815 | Protein Tyrosine Phosphatase | 82 | 482 | rev |
| 7865 | Protein Tyrosine Phosphatase | 71 | 461 | rev |
| 8158 | Protein Tyrosine Phosphatase | 270 | 704 | for |
| 8293 | Protein Tyrosine Phosphatase | 359 | 851 | for |
| 8371 | Protein Tyrosine Phosphatase | 56 | 680 | for |
| 7946 | RNA recognition motif. (aka RRM, RBD, or RNP domain) | 165 | 365 | for |
| 8290 | RNA recognition motif. (aka RRM, RBD, or RNP domain) | 37 | 174 | for |
| 8537 | SH2 Domain | 201 | 362 | for |
| 7714 | Thioredoxins | 253 | 554 | for |
| 7675 | Trypsin | 252 | 1007 | rev |
| 8386 | Trypsin | 350 | 1164 | rev |
| 8437 | Trypsin | 447 | 1211 | rev |
| 8517 | Trypsin | 14 | 765 | rev |
| 8526 | Trypsin | 700 | 1556 | rev |
| 8534 | Trypsin | 47 | 670 | rev |
| 8377 | WD domain, G-beta repeats | 70 | 161 | for |
| 7675 | wnt family of developmental signaling proteins | 282 | 1017 | rev |
| 7749 | wnt family of developmental signaling proteins | 154 | 978 | rev |
| 7874 | wnt family of developmental signaling proteins | 38 | 858 | rev |
| 7922 | wnt family of developmental signaling proteins | 574 | 1318 | rev |
| 7971 | wnt family of developmental signaling proteins | 578 | 1313 | rev |
| 8000 | wnt family of developmental signaling proteins | 205 | 1068 | rev |
| 8088 | wnt family of developmental signaling proteins | 2 | 824 | rev |
| 8100 | wnt family of developmental signaling proteins | 621 | 1420 | rev |
| 8225 | wnt family of developmental signaling proteins | 394 | 1343 | rev |
| 8241 | wnt family of developmental signaling proteins | 162 | 1027 | rev |
| 8300 | wnt family of developmental signaling proteins | 274 | 1405 | rev |
| 8334 | wnt family of developmental signaling proteins | 560 | 1195 | rev |
| 8386 | wnt family of developmental signaling proteins | 250 | 1273 | rev |

TABLE 42A-continued

Profile Hits

| SEQ ID NO: | Description | Start | Stop | Dir |
|---|---|---|---|---|
| 8387 | wnt family of developmental signaling proteins | 523 | 1409 | rev |
| 8390 | wnt family of developmental signaling proteins | 297 | 1237 | rev |
| 8437 | wnt family of developmental signaling proteins | 51 | 1002 | rev |
| 8439 | wnt family of developmental signaling proteins | 28 | 1180 | rev |
| 8444 | wnt family of developmental signaling proteins | 638 | 1614 | rev |
| 8469 | wnt family of developmental signaling proteins | 30 | 1078 | rev |
| 8505 | wnt family of developmental signaling proteins | 4 | 1074 | rev |
| 8506 | wnt family of developmental signaling proteins | 208 | 1107 | rev |
| 8510 | wnt family of developmental signaling proteins | 242 | 1068 | rev |
| 8517 | wnt family of developmental signaling proteins | 159 | 1057 | rev |
| 8526 | wnt family of developmental signaling proteins | 844 | 1691 | rev |
| 8532 | wnt family of developmental signaling proteins | 107 | 784 | rev |
| 8534 | wnt family of developmental signaling proteins | 127 | 1226 | rev |
| 8559 | wnt family of developmental signaling proteins | 5 | 704 | rev |
| 8569 | wnt family of developmental signaling proteins | 328 | 1193 | rev |
| 8607 | wnt family of developmental signaling proteins | 341 | 1222 | rev |
| 8619 | wnt family of developmental signaling proteins | 820 | 1617 | rev |
| 8624 | wnt family of developmental signaling proteins | 461 | 1283 | rev |
| 7831 | Zinc finger, C2H2 type | 495 | 557 | for |
| 8038 | Zinc finger, C2H2 type | 500 | 562 | for |
| 8114 | Zinc finger, C2H2 type | 279 | 341 | for |
| 8350 | Zinc finger, C2H2 type | 148 | 210 | for |
| 8611 | Zinc finger, C2H2 type | 422 | 484 | for |

TABLE 42B

Profile Hits for Contigs

| SEQ ID NO: | Description | Start | Stop | Dir |
|---|---|---|---|---|
| 8737 | ATPases Associated with Various Cellular Activities | 118 | 661 | for |
| 8751 | ATPases Associated with Various Cellular Activities | 135 | 536 | for |
| 8781 | ATPases Associated with Various Cellular Activities | 142 | 574 | for |
| 8744 | DEAD and DEAH box helicases | 66 | 931 | rev |
| 8782 | Helicases conserved C-terminal domain | 51 | 242 | for |
| 8757 | Neurotransmitter-gated ion-channel | 169 | 738 | rev |
| 8736 | Protein phosphatase 2A regulatory subunit PR55 | 275 | 1510 | for |
| 8751 | Protein phosphatase 2A regulatory subunit PR55 | 55 | 1087 | for |
| 8766 | Protein phosphatase 2A regulatory subunit PR55 | 13 | 1183 | for |
| 8780 | Protein phosphatase 2A regulatory subunit PR55 | 511 | 1861 | rev |
| 8775 | Protein Tyrosine Phosphatase | 292 | 768 | for |
| 8764 | Thioredoxins | 182 | 475 | for |

Some polynucleotides exhibited multiple profile hits where the query sequence contains overlapping profile regions, and/or where the sequence contains two different functional domains. Each of the profile hits of Table 42A are described in more detail below. The acronyms for the profiles (provided in parentheses) are those used to identify the profile in the Pfam and Prosite databases. The Pfam database can be accessed through many URLS. The Prosite database can be accessed at the Expasy website. The public information available on the Pfam and Prosite databases regarding the various profiles, including but not limited to the activities, function, and consensus sequences of various proteins families and protein domains, is incorporated herein by reference.

14-3-3 Family (14_3_3). Some SEQ ID NOS corresponds to a sequence encoding a 14-3-3 protein family member. The 14-3-3 protein family includes a group of closely related acidic homodimeric proteins of about 30 kD first identified as very abundant in mammalian brain tissues and located preferentially in neurons (Aitken et al. Trends Biochem. Sci. (1995) 20:95-97; Morrison Science (1994) 266: 56-57; and Xiao et al. Nature (1995) 376:188-191). The 14-3-3 proteins have multiple biological activities, including a key role in signal transduction pathways and the cell cycle. 14-3-3 proteins interact with kinases (e.g., PKC or Raf-1), and can also function as protein-kinase dependent activators of tyrosine and tryptophan hydroxylases. The 14-3-3 protein sequences are extremely well conserved, and include two highly conserved regions: the first is a peptide of 11 residues located in the N-terminal section; the second, a 20 amino acid region located in the C-terminal section.

3'5'-Cyclin Nucleotide Phosphodiesterases (PDEase). Some SEQ ID NOS represent a polynucleotide encoding a novel 3'5'-cyclic nucleotide phosphodiesterase. PDEases catalyze the hydrolysis of cAMP or cGMP to the corresponding nucleoside 5' monophosphates (Charbonneau et al, Proc. Natl. Acad. Sci. U.S.A. (1986) 83:9308). There are at least seven different subfamilies of PDEases (Beavo et al., Trends Pharmacol. Sci. (1990) 11:150; see internet web site at weber.u.washington.edu/.about.pde/: 1) Type 1, calmodulin/calcium-dependent PDEases; 2) Type 2, cGMP-stimulated PDEases; 3) Type 3, cGMP-inhibited PDEases; 4) Type 4, cAMP-specific PDEases; 5) Type 5, cGMP-specific PDEases; 6) Type 6, rhodopsin-sensitive cGMP-specific PDEases; and 7) Type 7, High affinity cAMP-specific PDEases. All PDEase forms share a conserved domain of about 270 residues.

Four Transmembrane Integral Membrane Proteins (transmembrane4). Some SEQ ID NOS correspond to a sequence encoding a member of the four transmembrane segments integral membrane protein family (tm4 family). The tm4 family of proteins includes a number of evolutionarily-related eukaryotic cell surface antigens (Levy et al., J. Biol. Chem., (1991) 266:14597; Tomlinson et al., Eur. J. Immunol. (1993) 23:136; Barclay et al. The leucocyte antigen factbooks. (1993) Academic Press, London/San Diego). The tm4 family members are type III membrane proteins, which are integral membrane proteins containing an N-terminal membrane-anchoring domain that functions both as a translocation signal and as a membrane anchor. The family members also contain three additional transmembrane regions, at least seven conserved cysteines residues, and are of approximately the same size (218 to 284 residues). The consensus pattern spans a conserved region including two cysteines located in a short cytoplasmic loop between two transmembrane domains:

Seven Transmembrane Integral Membrane Proteins—Rhodopsin Family (7tm_1). Some SEQ ID NOS correspond to a sequence encoding a member of the seven transmembrane (7tm) receptor rhodopsin family. G-protein coupled receptors of the (7tm) rhodopsin family include hormones, neurotransmitters, and light receptors that transduce extracellular signals by interaction with guanine nucleotide-binding (G) proteins (Strosberg *Eur. J. Biochem.* (1991) 196:1, Kerlavage *Curr. Opin. Struct. Biol.* (1991) 1:394, Probst, et al., *DNA Cell Biol.* (1992) 11:1, Savarese, et al., Biochem. J. (1992) 283:1)

Seven Transmembrane Integral Membrane Proteins—Secretin Family (7tm_2). Some SEQ ID NOS correspond to a sequence encoding a member of the seven transmembrane receptor (7tm) secretin family (Jueppner et al. *Science* (1991) 254:1024; Hamann et al. *Genomics* (1996) 32:144). The N-terminal extracellular domain of these receptors contains five conserved cysteines residues involved in disulfide bonds, with a consensus pattern in the region that spans the first three cysteines. One of the most highly conserved regions spans the C-terminal part of the last transmembrane region and the beginning of the adjacent intracellular region and is used as a second signature pattern.

ATPases Associated with Various Cellular Activities (ATPases). Several of the polynucleotides of the invention correspond to a sequence that encodes a member of a family of ATPases Associated with diverse cellular Activities (AAA). The AAA protein family is composed of a large number of ATPases that share a conserved region of about 220 amino acids containing an ATP-binding site (Froehlich et al., *J. Cell Biol.* (1991) 114:443; Erdmann et al. *Cell* (1991) 64:499; Peters et al., *EMBO J.* (1990) 9:1757; Kunau et al., *Biochimie* (1993) 75:209-224; Confalonieri et al., *BioEssays* (1995) 17:639). The AAA domain, which can be present in one or two copies, acts as an ATP-dependent protein clamp (Confalonieri et al. (1995) *BioEssays* 17:639) and contains a highly conserved region located in the central part of the domain.

Basic Region Plus Leucine Zipper Transcription Factors (BZIP). One SEQ ID NO represents a polynucleotide encoding a novel member of the family of basic region plus leucine zipper transcription factors. The bZIP superfamily (Hurst, *Protein Prof.* (1995) 2:105; and Ellenberger, *Curr. Opin. Struct. Biol.* (1994) 4:12) of eukaryotic DNA-binding transcription factors encompasses proteins that contain a basic region mediating sequence-specific DNA-binding followed by a leucine zipper required for dimerization.

C2 domain (C2). Some SEQ ID NOS correspond to a sequence encoding a C2 domain, which is involved in calcium-dependent phospholipid binding (Davletov *J. Biol. Chem.* (1993) 268:26386-26390) or, in proteins that do not bind calcium, the domain may facilitate binding to inositol-1,3,4,5-tetraphosphate (Fukuda et al. *J. Biol. Chem.* (1994) 269:29206-29211; Sutton et al. *Cell* (1995) 80:929-938).

Cysteine proteases (Cys-protease). One SEQ ID NO represents a polynucleotide encoding a protein having a eukaryotic thiol (cysteine) protease active site. Cysteine proteases (Dufour *Biochimie* (1988) 70:1335) are a family of proteolytic enzymes that contain an active site cysteine. Catalysis proceeds through a thioester intermediate and is facilitated by a nearby histidine side chain; an asparagine completes the essential catalytic triad.

DEAD and DEAR box families ATP-dependent helicases (Dead_box_helic). Some SEQ ID NOS represent polynucleotides encoding a novel member of the DEAD and DEAR box families (Schmid et al., Mol. Microbiol. (1992) 6:283; Linder et al., Nature (1989) 337:121; Wassarman, et al., Nature (1991) 349:463). All members of these families are involved in ATP-dependent, nucleic-acid unwinding. All DEAD box family members share a number of conserved sequence motifs, some of which are specific to the DEAD family, with others shared by other ATP-binding proteins or by proteins belonging to the helicases 'superfamily' (Hodgman Nature (1988) 333:22 and Nature (1988) 333:578 (Errata); see worldwide web site at expasy.ch/www/linder/HELICASES-_TEXT.html). One of these motifs, called the 'D-E-A-D-box', represents a special version of the B motif of ATP-binding proteins. Proteins that have His instead of the second Asp and are 'D-E-A-H-box' proteins (Wassarman et al., Nature (1991) 349:463; Harosh, et al., Nucleic Acids Res. (1991) 19:6331; Koonin, et al., J. Gen. Virol. (1992) 73:989; see worldwide web site at expasy.ch/www/linder/HELICASES_TEXT.html).

Dual specificity phosphatase (DSPc). Dual specificity phosphatases (DSPs) are Ser/Thr and Tyr protein phosphatases that comprise a tertiary fold highly similar to that of tyrosine-specific phosphatases, except for a "recognition" region connecting helix alpha1 to strand beta1. This tertiary fold may determine differences in substrate specific between VH-1 related dual specificity phosphatase (VHR), the protein tyrosine phosphatases (PTPs), and other DSPs. Phosphatases are important in the control of cell growth, proliferation, differentiation and transformation.

EF Hand (EFhand). One SEQ ID NO corresponds to a polynucleotide encoding a member of the EF-hand protein family, a calcium binding domain shared by many calcium-binding proteins belonging to the same evolutionary family (Kawasaki et al., *Protein. Prof.* (1995) 2:305-490). The domain is a twelve residue loop flanked on both sides by a twelve residue alpha-helical domain, with a calcium ion coordinated in a pentagonal bipyramidal configuration. The six residues involved in the binding are in positions 1, 3, 5, 7, 9 and 12; these residues are denoted by X, Y, Z, -Y, -X and -Z. The invariant Glu or Asp at position 12 provides two oxygens for liganding Ca (bidentate ligand).

Eukaryotic Aspartyl Proteases (asp). Several of the polynucleotides of the invention correspond to a sequence encoding a novel eukaryotic aspartyl protease. Aspartyl proteases, known as acid proteases, (EC 3.4.23.-) are a widely distributed family of proteolytic enzymes (Foltmann., *Essays Biochem.* (1981) 17:52; Davies, *Annu. Rev. Biophys. Chem.* (1990) 19:189; Rao, et al., *Biochemistry* (1991) 30:4663) known to exist in vertebrates, fungi, plants, retroviruses and some plant viruses. Aspartate proteases of eukaryotes are monomeric enzymes which consist of two domains. Each domain contains an active site centered on a catalytic aspartyl residue.

Fibronectin Type II collagen-binding domain (FntypeII). One SEQ ID NO corresponds to a polynucleotide encoding a polypeptide having a type II fibronectin collagen binding domain. Fibronectin is a plasma protein that binds cell surfaces and various compounds including collagen, fibrin, heparin, DNA, and actin. The major part of the sequence of fibronectin consists of the repetition of three types of domains, called type I, II, and III (Skorstengaard et al., *Eur. J. Biochem.* (1986) 161:441). The type II domain, which is duplicated in fibronectin, is approximately forty residues long, contains four conserved cysteines involved in disulfide bonds and is part of the collagen-binding region of fibronectin.

G-Protein Alpha Subunit (G-alpha). One SEQ ID NO corresponds to a gene encoding a member of the G-protein alpha subunit family. G-proteins are a family of membrane-associated proteins that couple extracellularly-activated integral-membrane receptors to intracellular effectors, such as ion channels and enzymes that vary the concentration of second messenger molecules. G-proteins are composed of 3 subunits (alpha, beta and gamma) which, in the resting state, associate as a trimer at the inner face of the plasma membrane. The alpha subunit, which binds GTP and exhibits GTPase activity, is about 350-400 amino acids in length with a molecular weight in the range of 40-45 kDa. Seventeen distinct types of alpha subunit have been identified in mammals, and fall into 4 main groups on the basis of both sequence similarity and function: alpha-s, alpha-q, alpha-i and alpha-12 (Simon et al., *Science* (1993) 252:802). They are often N-terminally acylated, usually with myristate and/or palmitoylate, and these fatty acid modifications can be important for membrane association and high-affinity interactions with other proteins.

Helicases conserved C-terminal domain (helicase_C). Some SEQ ID NOS represent polynucleotides encoding novel members of the DEAD/H helicase family. The DEAD and DEAH families are described above.

Helix-Loop-Helix (HLH) DNA Binding Domain (HLH). One SEQ ID NO corresponds to a sequence encoding an HLH domain. The HLH domain, which normally spans about 40 to 50 amino acids, is present in a number of eukaryotic transcription factors. The HLH domain is formed of two amphipathic helices joined by a variable length linker region that forms a loop that mediates protein dimerization (Murre et al. *Cell* (1989) 56:777-783). Basic HLH proteins (bHLH), which have an extra basic region of about 15 amino acid residues adjacent the HLH domain and specifically bind to DNA, include two groups: class A (ubiquitous) and class B (tissue-specific). bHLH family members bind variations of the E-box motif (CANNTG). The homo- or heterodimerization mediated by the HLH domain is independent of, but necessary for DNA binding, as two basic regions are required for DNA binding activity. The HLH proteins lacking the basic domain function as negative regulators since they form heterodimers, but fail to bind DNA.

Kinase Domain of Tors. The TOR profile is directed towards a lipid kinase protein family. This family is composed of large proteins with a lipid and protein kinase domain and characterized through their sensitivity to rapamycin (an antifungal compound). TOR proteins are involved in signal transduction downstream of PI3 kinase and many other signals. TOR (also called FRAP, RAFT) plays a role in regulating protein synthesis and cell growth, and in yeast controls translation initiation and early G1 progression. See, e.g., Barbet et al. *Mol Biol Cell*. (1996) 7(1):25-42; Helliwell et al. *Genetics* (1998) 148:99-112.

MAP kinase kinase (mkk). Some SEQ ID NOS represent members of the MAP kinase kinase (mkk) family. MAP kinases (MAPK) are involved in signal transduction, and are important in cell cycle and cell growth controls. The MAP kinase kinases (MAPKK) are dual-specificity protein kinases which phosphorylate and activate MAP kinases. MAPKK homologues have been found in yeast, invertebrates, amphibians, and mammals. Moreover, the MAPKK/MAPK phosphorylation switch constitutes a basic module activated in distinct pathways in yeast and in vertebrates. MAPKKs are essential transducers through which signals must pass before reaching the nucleus. For review, see, e.g., Biologique *Biol Cell* (1993) 79:193-207; Nishida et al., *Trends Biochem Sci* (1993) 18:128-31; Ruderman *Curr Opin Cell Biol* (1993) 5:207-13; Dhanasekaran et al., *Oncogene* (1998) 17:1447-55; Kiefer et al., *Biochem Soc Trans* (1997) 25:491-8; and Hill, *Cell Signal* (1996) 8:533-44.

Neurotransmitter-Gated Ion-Channel (neur_chan). Several of the sequences correspond to a sequence encoding a neurotransmitter-gated ion channel. Neurotransmitter-gated ion-channels, which provide the molecular basis for rapid signal transmission at chemical synapses, are post-synaptic oligomeric transmembrane complexes that transiently form a ionic channel upon the binding of a specific neurotransmitter. Five types of neurotransmitter-gated receptors are known: 1) nicotinic acetylcholine receptor (AchR); 2) glycine receptor; 3) gamma-aminobutyric-acid (GABA) receptor; 4) serotonin 5HT3 receptor; and 5) glutamate receptor. All known sequences of subunits from neurotransmitter-gated ion-channels are structurally related, and are composed of a large extracellular glycosylated N-terminal ligand-binding domain, followed by three hydrophobic transmembrane regions that form the ionic channel, followed by an intracellular region of variable length. A fourth hydrophobic region is found at the C-terminal of the sequence.

Protein Kinase (protkinase). Several sequences represent polynucleotides encoding protein kinases, which catalyze phosphorylation of proteins in a variety of pathways, and are implicated in cancer. Eukaryotic protein kinases (Hanks, et al., *FASEB J.* (1995) 9:576; Hunter, *Meth. Enzymol.* (1991) 200:3; Hanks, et al., *Meth. Enzymol.* (1991) 200:38; Hanks, *Curr. Opin. Struct. Biol.* (1991) 1:369; Hanks et al., *Science* (1988) 241:42) belong to a very extensive family of proteins that share a conserved catalytic core common to both serine/threonine and tyrosine protein kinases. There are a number of conserved regions in the catalytic domain of protein kinases. The first region, located in the N-terminal extremity of the catalytic domain, is a glycine-rich stretch of residues in the vicinity of a lysine residue, which has been shown to be involved in ATP binding. The second region, located in the central part of the catalytic domain, contains a conserved an aspartic acid residue that is important for the catalytic activity of the enzyme (Knighton, et al., *Science* (1991) 253:407).

The protein kinase profile includes two signature patterns for this second region: one specific for serine/threonine kinases and the other for tyrosine kinases. A third profile is based on the alignment in (Hanks, et al., *FASEB J.* (1995) 9:576) and covers the entire catalytic domain.

Protein Tyrosine Phosphatase (Y_phosphatase) (PTPase). Some SEQ ID NOS represent polynucleotides encoding a tyrosine-specific protein phosphatase, a kinase that catalyzes the removal of a phosphate groups attached to a tyrosine residue (EC 3.1.3.48) (PTPase) (Fischer et al., *Science* (1991) 253:401; Charbonneau et al., *Annu. Rev. Cell Biol.* (1992) 8:463; Trowbridge *Biol. Chem.* (1991) 266:23517; Tonks et al., *Trends Biochem. Sci.* (1989) 14:497; and Hunter, *Cell* (1989) 58:1013). PTPases are important in the control of cell growth, proliferation, differentiation and transformation. Multiple forms of PTPase have been characterized and can be classified into two categories: soluble PTPases and transmembrane receptor proteins that contain PTPase domain(s). Structurally, all known receptor PTPases are made up of a variable length extracellular domain, followed by a transmembrane region and a C-terminal catalytic cytoplasmic domain. PTPase domains consist of about 300 amino acids. Two conserved cysteines are absolutely required for activity, with a number of other conserved residues in the immediate vicinity also important for activity.

RNA Recognition Motif (rrm). Some SEQ ID NOS correspond to sequence encoding an RNA recognition motif, also known as an RRM, RBD, or RNP domain. This domain, which is about 90 amino acids long, is contained in eukaryotic proteins that bind single-stranded RNA (Bandziulis et al. *Genes Dev.* (1989) 3:431-437; Dreyfuss et al. *Trends Biochem. Sci.* (1988) 13:86-91). Two regions within the RNA-binding domain are highly conserved: the first is a hydrophobic segment of six residues (which is called the RNP-2 motif), the second is an octapeptide motif (which is called RNP-1 or RNP-CS).

SH2 Domain (SH2). One SEQ ID NO corresponds to a sequence encoding an SH2 domain. The Src homology 2 (SH2) domain includes an approximately 100 amino acid residue domain, which is conserved in the oncoproteins Src and Fps, as well as in many other intracellular signal-transducing proteins (Sadowski et al. *Mol. Cell. Biol.* (1986) 6:4396-4408; Russel et al. *FEBS Lett.* (1992) 304:15-20). SH2 domains function as regulatory modules of intracellular signaling cascades by interacting with high affinity to phosphotyrosine-containing target peptides in a sequence-specific and strictly phosphorylation-dependent manner. The SH2 domain has a conserved 3D structure consisting of two alpha helices and six to seven beta-strands. The core of the domain is formed by a continuous beta-meander composed of two connected beta-sheets (Kuriyan et al. *Curr. Opin. Struct. Biol.* (1993) 3:828-837).

Thioredoxin family active site (Thioredox). One SEQ ID NO represents a polynucleotide encoding a protein of the thioredoxin family. Thioredoxins are small proteins of approximately one hundred amino acid residues that participate in various redox reactions via the reversible oxidation of an active center disulfide bond (Holmgren, *Annu. Rev. Biochem.* (1985) 54:237; Gleason, et al., *FEMS Microbiol. Rev.* (1988) 54:271; Holmgren A. *J. Biol. Chem.* (1989) 264:13963; Eklund, et al. *Proteins* (1991) 11:13). Thioredoxins exist in either reduced or oxidized forms where the two cysteine residues are linked in an intramolecular disulfide bond. The sequence around the redox-active disulfide bond is well conserved.

Trypsin (trypsin). Some SEQ ID NOS correspond to novel serine proteases of the trypsin family. The catalytic activity of the serine proteases from the trypsin family is provided by a charge relay system involving an aspartic acid residue hydrogen-bonded to a histidine, which itself is hydrogen-bonded to a serine. The sequences in the vicinity of the active site serine and histidine residues are well conserved (Brenner *Nature* (1988) 334:528). All sequences known to belong to this family are detected by the above consensus sequences, except for 18 different proteases which have lost the first conserved glycine. If a protein includes both the serine and the histidine active site signatures, the probability of it being a trypsin family serine protease is 100%.

WD Domain G-Beta Repeats (WD_domain). One SEQ ID NO represents a member of the WD domain/G-beta repeat family. Beta-transducin (G-beta) is one of the three subunits (alpha, beta, and gamma) of the guanine nucleotide-binding proteins (G proteins) which act as intermediaries in the transduction of signals generated by transmembrane receptors (Gilman, *Annu. Rev. Biochem.* (1987) 56:615). The alpha subunit binds to and hydrolyzes GTP; the beta and gamma subunits are required for the replacement of GDP by GTP as well as for membrane anchoring and receptor recognition. In higher eukaryotes, G-beta exists as a small multigene family of highly conserved proteins of about 340 amino acid residues. Structurally, G-beta has eight tandem repeats of about 40 residues, each containing a central Trp-Asp motif (this type of repeat is sometimes called a WD-40 repeat).

wnt Family of Developmental Signaling Proteins (Wnt_dev_sign). Several of the sequences correspond to novel members of the wnt family of developmental signaling proteins. Wnt-1 (previously known as int-1), the seminal member of this family, (Nusse, *Trends Genet.* (1988) 4:291) plays a role in intercellular communication and is important in central nervous system development. All wnt family proteins share the following features characteristic of secretory proteins: a signal peptide, several potential N-glycosylation sites and 22 conserved cysteines that may be involved in disulfide bonds. Wnt proteins generally adhere to the plasma membrane of secreting cells and are therefore likely to signal over only few cell diameters.

Zinc Finger, C2H2 Type (Zincfing_C2H2). Some SEQ ID NOS correspond to polynucleotides encoding members of the C2H2 type zinc finger protein family, which contain zinc finger domains that facilitate nucleic acid binding (Klug et al., *Trends Biochem. Sci.* (1987) 12:464; Evans et al., *Cell* (1988) 52:1; Payre et al., *FEBS Lett.* (1988) 234:245; Miller et al., *EMBO J.* (1985) 4:1609; and Berg, *Proc. Natl. Acad. Sci. USA* (1988) 85:99). In addition to the conserved zinc ligand residues, a number of other positions are also important for the structural integrity of the C2H2 zinc fingers. (Rosenfeld et al., *J. Biomol. Struct. Dyn.* (1993) 11:557) The best conserved position, which is generally an aromatic or aliphatic residue, is located four residues after the second cysteine.

Example 30

Differential Expression of Polynucleotides of the Invention: Description of Libraries and Detection of Differential Expression The relative expression levels of the polynucleotides of the invention was assessed in several libraries prepared from various sources, including cell lines and patient tissue samples. Table 43 provides a summary of these libraries, including the shortened library name (used hereafter), the mRNA source used to prepared the cDNA library, the "nickname" of the library that is used in the tables below (in quotes), and the approximate number of clones in the library.

TABLE 43

Description of cDNA Libraries

| Library (lib #) | Description | Number of Clones in Cluster |
|---|---|---|
| 1 | Km12 L4 Human Colon Cell Line, High Metastatic Potential (derived from Km12C); "High Met Colon" | 307133 |
| 2 | Km12C Human Colon Cell Line, Low Metastatic Potential; "Low Met Colon" | 284755 |
| 3 | MDA-MB-231 Human Breast Cancer Cell Line, High Metastatic Potential; micro-metastases in lung; "High Met Breast" | 326937 |
| 4 | MCF7 Human Breast Cancer Cell, Non Metastatic; "Low Met Breast" | 318979 |
| 8 | MV-522 Human Lung Cancer Cell Line, High Metastatic Potential; "High Met Lung" | 223620 |

TABLE 43-continued

Description of cDNA Libraries

| Library (lib #) | Description | Number of Clones in Cluster |
|---|---|---|
| 9 | UCP-3<br>Human Lung Cancer Cell Line, Low Metastatic Potential; "Low Met Lung" | 312503 |
| 12 | Human microvascular endothelial cells (HMEC) - Untreated PCR (OligodT) cDNA library; "HMEC" | 41938 |
| 13 | Human microvascular endothelial cells (HMEC) - Basic fibroblast growth factor (bFGF) treated PCR (OligodT) cDNA library; "HMEC-bFGF" | 42100 |
| 14 | Human microvascular endothelial cells (HMEC) - Vascular endothelial growth factor (VEGF) treated PCR (OligodT) cDNA library; "HMEC-VEGF" | 42825 |
| 15 | Normal Colon - UC#2 Patient PCR (OligodT) cDNA library; "Normal Colon Tissue" | 282722 |
| 16 | Colon Tumor - UC#2 Patient PCR (OligodT) cDNA library; "Normal Colon Tumor Tissue" | 298831 |
| 17 | Liver Metastasis from Colon Tumor of UC#2 Patient PCR (OligodT) cDNA library; "High Met Colon Tissue" | 303467 |
| 18 | Normal Colon - UC#3 Patient PCR (OligodT) cDNA library; "Normal Colon Tissue" | 36216 |
| 19 | Colon Tumor - UC#3 Patient PCR (OligodT) cDNA library; "Colon Tumor Tissue" | 41388 |
| 20 | Liver Metastasis from Colon Tumor of UC#3 Patient PCR (OligodT) cDNA library; "High Met Colon Tissue" | 30956 |
| 21 | GRRpz<br>Human Prostate Cell Line; "Normal Prostate" | 164801 |
| 22 | Woca<br>Human Prostate Cancer Cell Line; "Prostate Cancer" | 162088 |

The KM12L4, KM12C, and MDA-MB-231 cell lines are described above. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., *Cancer Res.* (1979) 39:870 (MDA-MB-231 and MCF-7); Gastpar et al., *J Med Chem* (1998) 41:4965 (MDA-MB-231 and MCF-7); Ranson et al., *Br J Cancer* (1998) 77:1586 (MDA-MB-231 and MCF-7); Kuang et al., *Nucleic Acids Res* (1998) 26:1116 (MDA-MB-231 and MCF-7); Varki et al., *Int J Cancer* (1987) 40:46 (UCP-3); Varki et al., *Tumour Biol.* (1990) 11:327; (MV-522 and UCP-3); Varki et al., *Anticancer Res.* (1990) 10:637; (MV-522); Kelner et al., *Anticancer Res* (1995) 15:867 (MV-522); and Zhang et al., *Anticancer Drugs* (1997) 8:696 (MV522)). The samples of libraries 15-20 are derived from two different patients (UC#2, and UC#3). The bFGF-treated HMEC were prepared by incubation with bFGF at 10 ng/ml for 2 hrs; the VEGF-treated HMEC were prepared by incubation with 20 ng/ml VEGF for 2 hrs. Following incubation with the respective growth factor, the cells were washed and lysis buffer added for RNA preparation. The GRRpz and WOca cell lines were provided by Dr. Donna M. Peehl, Department of Medicine, Stanford University School of Medicine. GRRpz was derived from normal prostate epithelium. The WOca cell line is a Gleason Grade 4 cell line.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., *Genomics* (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences between Proportions," pp 296-298 (1974).

Examples 31-38

Differential Expression of Polynucleotides of the Invention

A number of polynucleotide sequences have been identified that are differentially expressed between, for example, cells derived from high metastatic potential cancer tissue and low metastatic cancer cells, and between cells derived from high metastatic potential cancer tissue and normal tissue. Evaluation of the levels of expression of the genes corresponding to these sequences can be valuable in diagnosis, prognosis, and/or treatment (e.g., to facilitate rationale design of therapy, monitoring during and after therapy, etc.). Moreover, the genes corresponding to differentially expressed sequences described herein can be therapeutic targets due to their involvement in regulation (e.g., inhibition or promotion) of development of, for example, the metastatic phenotype. For example, sequences that correspond to genes that are increased in expression in high metastatic potential cells relative to normal or non-metastatic tumor cells may encode genes or regulatory sequences involved in processes such as angiogenesis, differentiation, cell replication, and metastasis.

Detection of the relative expression levels of differentially expressed polynucleotides described herein can provide valuable information to guide the clinician in the choice of therapy. For example, a patient sample exhibiting an expression level of one or more of these polynucleotides that corresponds to a gene that is increased in expression in metastatic or high metastatic potential cells may warrant more aggressive treatment for the patient. In contrast, detection of expression levels of a polynucleotide sequence that corresponds to expression levels associated with that of low metastatic potential cells may warrant a more positive prognosis than the gross pathology would suggest.

A number of polynucleotide sequences of the present invention are differentially expressed between human microvascular endothelial cells (HMEC) that have been treated with growth factors relative to untreated HMEC. Sequences that are differentially expressed between growth factor-treated HMEC and untreated HMEC can represent sequences encoding gene products involved in angiogenesis, metastasis (cell migration), and other development and oncogenic processes. For example, sequences that are more highly expressed in HMEC treated with growth factors (such as bFGF or VEGF) relative to untreated HMEC can serve as markers of cancer cells of higher metastatic potential. Detection of expression of these sequences in colon cancer tissue can be valuable in determining diagnostic, prognostic and/or treatment information associated with the prevention of achieving the malignant state in these tissues, and can be important in risk assessment for a patient. A patient sample displaying an increased level of one or more of these polynucleotides may thus warrant closer attention or more frequent screening procedures to catch the malignant state as early as possible.

The differential expression of the polynucleotides described herein can thus be used as, for example, diagnostic markers, prognostic markers, for risk assessment, patient treatment and the like. These polynucleotide sequences can also be used in combination with other known molecular and/or biochemical markers. The following examples provide relative expression levels of polynucleotides from specified cell lines and patient tissue samples.

Example 31

High Metastatic Potential Breast Cancer Versus Low Metastatic Breast Cancer Cells The following tables summarize polynucleotides that represent genes that are differentially expressed between high metastatic potential and low metastatic potential breast cancer cells.

TABLE 44

High metastatic potential breast (lib3) > low metastatic potential (lib4) breast cancer cells

| SEQ ID NO: | Lib3 Clones | Lib4 Clones | Lib3/Lib4 |
|---|---|---|---|
| 7309 | 40 | 0 | 39 |
| 7634 | 60 | 3 | 20 |
| 7562 | 14 | 0 | 14 |
| 7452 | 10 | 0 | 10 |
| 7479 | 10 | 1 | 10 |
| 7254 | 10 | 1 | 10 |
| 6537 | 10 | 1 | 10 |
| 7434 | 10 | 0 | 10 |
| 7522 | 19 | 2 | 9 |
| 7643 | 9 | 1 | 9 |
| 7409 | 8 | 1 | 8 |
| 6937 | 8 | 1 | 8 |
| 7630 | 8 | 0 | 8 |
| 7599 | 8 | 0 | 8 |
| 6925 | 8 | 1 | 8 |
| 7504 | 8 | 0 | 8 |
| 7543 | 7 | 0 | 7 |
| 7485 | 7 | 0 | 7 |
| 6452 | 7 | 0 | 7 |
| 7588 | 7 | 0 | 7 |
| 7639 | 22 | 3 | 7 |
| 6895 | 7 | 0 | 7 |
| 7533 | 6 | 0 | 6 |
| 7347 | 6 | 0 | 6 |
| 7068 | 18 | 3 | 6 |
| 7578 | 6 | 0 | 6 |
| 7395 | 6 | 0 | 6 |
| 6205 | 24 | 4 | 6 |
| 7654 | 6 | 0 | 6 |
| 7451 | 6 | 0 | 6 |
| 7644 | 11 | 2 | 5 |
| 6346 | 10 | 2 | 5 |
| 7015 | 26 | 6 | 4 |
| 6454 | 36 | 12 | 3 |

TABLE 44-continued

High metastatic potential breast (lib3) > low metastatic potential (lib4) breast cancer cells

| SEQ ID NO: | Lib3 Clones | Lib4 Clones | Lib3/Lib4 |
|---|---|---|---|
| 7621 | 75 | 28 | 3 |
| 7253 | 49 | 17 | 3 |

TABLE 45

Low metastatic potential breast (lib4) > high metastatic potential breast cancer cells (lib3)

| SEQ ID NO: | Lib3 Clones | Lib4 Clones | Lib4/Lib3 |
|---|---|---|---|
| 6344 | 0 | 58 | 59 |
| 6822 | 1 | 23 | 24 |
| 6110 | 1 | 19 | 19 |
| 6795 | 0 | 14 | 14 |
| 6859 | 1 | 14 | 14 |
| 6116 | 1 | 13 | 13 |
| 6175 | 1 | 13 | 13 |
| 6811 | 0 | 10 | 10 |
| 7087 | 0 | 8 | 8 |
| 7295 | 0 | 8 | 8 |
| 6803 | 0 | 7 | 7 |
| 7224 | 4 | 26 | 7 |
| 6987 | 0 | 6 | 6 |
| 7242 | 2 | 11 | 6 |
| 6827 | 7 | 44 | 6 |
| 7614 | 3 | 15 | 5 |
| 6436 | 3 | 13 | 4 |
| 7045 | 4 | 13 | 3 |
| 7343 | 7 | 18 | 3 |
| 7281 | 497 | 1216 | 3 |

Example 32

High Metastatic Potential Lung Cancer Versus Low Metastatic Lung Cancer Cells

The following summarizes polynucleotides that represent genes differentially expressed between high metastatic potential lung cancer cells and low metastatic potential lung cancer cells:

TABLE 46

High metastatic potential lung (lib8) > low metastatic potential lung (lib9) lung cancer cells

| SEQ ID NO: | Lib8 Clones | Lib9 Clones | Lib8/Lib9 |
|---|---|---|---|
| 6246 | 31 | 0 | 43 |
| 6747 | 43 | 2 | 30 |
| 7394 | 14 | 1 | 20 |
| 6153 | 11 | 0 | 15 |
| 6721 | 7 | 0 | 10 |
| 7418 | 7 | 1 | 10 |
| 6132 | 7 | 0 | 10 |
| 6717 | 18 | 3 | 8 |
| 6311 | 6 | 1 | 8 |
| 6657 | 19 | 4 | 7 |
| 6343 | 5 | 0 | 7 |
| 6295 | 5 | 0 | 7 |
| 7094 | 5 | 0 | 7 |
| 6598 | 5 | 0 | 7 |
| 7478 | 8 | 2 | 6 |
| 7277 | 17 | 4 | 6 |
| 7405 | 8 | 2 | 6 |

TABLE 46-continued

High metastatic potential lung (lib8) > low metastatic potential lung (lib9) lung cancer cells

| SEQ ID NO: | Lib8 Clones | Lib9 Clones | Lib8/Lib9 |
|---|---|---|---|
| 7253 | 15 | 4 | 5 |
| 7356 | 14 | 5 | 4 |
| 7281 | 710 | 266 | 4 |
| 7621 | 21 | 10 | 3 |

TABLE 47

Low metastatic potential lung (lib9) > high metastatic potential lung (lib8) cancer cells

| SEQ ID NO: | Lib8 Clones | Lib9 Clones | Lib9/Lib8 |
|---|---|---|---|
| 7020 | 1 | 13 | 9 |
| 6918 | 1 | 13 | 9 |
| 6824 | 1 | 12 | 9 |
| 6437 | 1 | 12 | 9 |
| 7623 | 3 | 31 | 7 |
| 6794 | 4 | 26 | 5 |
| 7045 | 2 | 15 | 5 |
| 6840 | 3 | 23 | 5 |
| 7069 | 8 | 27 | 2 |

Example 33

High Metastatic Potential Colon Cancer Versus Low Metastatic Colon Cancer Cells

Tables 48 and 49 summarize polynucleotides that represent genes differentially expressed between high metastatic potential and low metastatic potential colon cancer cells:

TABLE 48

High metastatic potential (lib1) > low metastatic potential (lib2) colon cancer cells

| SEQ ID NO: | Lib1 Clones | Lib2 Clones | Lib1/Lib2 |
|---|---|---|---|
| 6344 | 67 | 2 | 31 |
| 6183 | 12 | 0 | 11 |
| 6794 | 11 | 0 | 10 |
| 6153 | 13 | 3 | 4 |
| 7020 | 24 | 10 | 2 |
| 7345 | 24 | 9 | 2 |

TABLE 49

Low metastatic potential (lib2) > high metastatic potential colon cancer (lib1) cells

| SEQ ID NO: | Lib1 Clones | Lib2 Clones | Lib2/Lib1 |
|---|---|---|---|
| 7364 | 1 | 17 | 18 |
| 7210 | 0 | 15 | 16 |
| 7128 | 1 | 14 | 15 |
| 6205 | 5 | 60 | 13 |
| 7069 | 1 | 11 | 12 |
| 6187 | 1 | 11 | 12 |
| 7078 | 0 | 9 | 10 |
| 7363 | 3 | 28 | 10 |
| 6189 | 1 | 8 | 9 |
| 7652 | 1 | 8 | 9 |

TABLE 49-continued

Low metastatic potential (lib2) > high metastatic potential colon cancer (lib1) cells

| SEQ ID NO: | Lib1 Clones | Lib2 Clones | Lib2/Lib1 |
|---|---|---|---|
| 7347 | 0 | 8 | 9 |
| 7302 | 2 | 17 | 9 |
| 6908 | 0 | 8 | 9 |
| 7350 | 0 | 7 | 8 |
| 7316 | 0 | 7 | 8 |
| 6862 | 0 | 7 | 8 |
| 7252 | 0 | 7 | 8 |
| 7103 | 0 | 7 | 8 |
| 7077 | 0 | 7 | 8 |
| 6858 | 0 | 7 | 8 |
| 6972 | 0 | 6 | 6 |
| 7330 | 2 | 11 | 6 |
| 7279 | 0 | 6 | 6 |
| 7140 | 2 | 12 | 6 |
| 6881 | 0 | 6 | 6 |
| 7165 | 3 | 17 | 6 |
| 6866 | 0 | 6 | 6 |
| 6874 | 0 | 6 | 6 |
| 6888 | 0 | 6 | 6 |
| 6918 | 2 | 10 | 5 |
| 7354 | 7 | 23 | 4 |
| 7320 | 7 | 17 | 3 |
| 7080 | 8 | 19 | 3 |
| 6937 | 10 | 28 | 3 |
| 6435 | 14 | 34 | 3 |
| 7309 | 11 | 29 | 3 |
| 7297 | 5 | 14 | 3 |
| 7288 | 22 | 48 | 2 |

Example 34

High Metastatic Potential Colon Cancer Patient Tissue Vs. Normal Patient Tissue

Table 50 summarizes polynucleotides that represent genes differentially expressed between high metastatic potential colon cancer cells and normal colon cells of patient tissue.

TABLE 50

High metastatic potential colon tissue (lib17) vs. normal colon tissue (lib15)

| SEQ ID NO: | Lib15 Clones | Lib17 Clones | Lib17/Lib15 |
|---|---|---|---|
| 7518 | 1 | 13 | 12 |
| 7228 | 1 | 10 | 9 |
| 6826 | 1 | 9 | 8 |
| 7407 | 0 | 7 | 7 |
| 6174 | 9 | 48 | 5 |
| 6918 | 5 | 20 | 4 |

| SEQ ID NO: | Lib15 Clones | Lib17 Clones | Lib15/Lib17 |
|---|---|---|---|
| 6559 | 8 | 1 | 9 |

Example 35

High Tumor Potential Colon Tissue Vs. Metastasized Colon Cancer Tissue

The following table summarizes polynucleotides that represent genes differentially expressed between high tumor potential colon cancer cells and cells derived from high metastatic potential colon cells of a patient.

TABLE 51

High tumor potential colon tissue (lib16) vs. high metastatic colon tissue (lib17)

| SEQ ID NO: | Lib16 Clones | Lib17 Clones | Lib16/Lib17 |
|---|---|---|---|
| 7281 | 14 | 4 | 4 |

| SEQ ID NO: | Lib16 Clones | Lib17 Clones | Lib17/Lib16 |
|---|---|---|---|
| 6918 | 2 | 20 | 10 |

Example 36

High Tumor Potential Colon Cancer Patient Tissue Versus Normal Patient

Tables 13 and 14 summarize polynucleotides that represent genes differentially expressed between high metastatic potential colon cancer cells and normal colon cells in patient tissue:

TABLE 52

Higher expression in tumor potential colon tissue (lib16) vs. normal colon tissue (lib15)

| SEQ ID NO: | Lib15 Clones | Lib16 Clones | Lib16/Lib15 |
|---|---|---|---|
| 7407 | 0 | 8 | 8 |
| 6174 | 9 | 28 | 3 |

TABLE 53

Higher expression in normal colon tissue (lib15) vs. tumor potential colon tissue (lib16)

| SEQ ID NO: | Lib15 Clones | Lib16 Clones | Lib15/Lib16 |
|---|---|---|---|
| 6559 | 8 | 0 | 8 |
| 7195 | 12 | 3 | 4 |

Example 37

Growth Factor-Stimulated Human Microvascular Endothelial Cells (HMEC) Relative to Untreated HMEC The following tables summarize polynucleotides that represent genes differentially expressed between growth factor-treated and untreated HMEC.

TABLE 54

Higher expression in bFGF treated HMEC (lib13) vs. untreated HMEC (lib12)

| SEQ ID NO: | Lib12 Clones | Lib13 Clones | Lib13/Lib12 |
|---|---|---|---|
| 7616 | 9 | 23 | 3 |
| 7634 | 17 | 35 | 2 |

TABLE 55

Higher expression in VEGF treated HMEC (lib14) vs. untreated HMEC (lib12)

| SEQ ID NO: | Lib12 Clones | Lib14 Clones | Lib14/Lib12 |
|---|---|---|---|
| 7250 | 2 | 12 | 6 |
| 7322 | 2 | 10 | 5 |
| 7634 | 17 | 38 | 2 |

Example 38

Polynucleotides Differentially Expressed in Human Prostate Cancer Cells Relative to Normal Human Prostate Cells The following tables summarize identified polynucleotides that represent genes differentially expressed between prostate cancer cells and normal prostate cells:

TABLE 56

Higher expression in normal prostate cells (lib21) relative to prostate cancer cells (lib22)

| SEQ ID NO: | Lib21 Clones | Lib22 Clones | Lib21/Lib22 |
|---|---|---|---|
| 7621 | 6 | 0 | 6 |
| 6344 | 116 | 51 | 2 |
| 7299 | 22 | 9 | 2 |

TABLE 57

Higher expression in prostate cancer cells (lib22) relative to normal prostate cells (lib21)

| SEQ ID NO: | Lib21 Clones | Lib22 Clones | Lib22/Lib21 |
|---|---|---|---|
| 7309 | 0 | 34 | 35 |
| 6436 | 1 | 12 | 12 |
| 6795 | 0 | 11 | 11 |

Example 39

Differential Expression Across Multiple Libraries

A number of polynucleotide sequences have been identified that represent genes that are differentially expressed across multiple libraries. Expression of these sequences in a tissue or any origin can be valuable in determining diagnostic, prognostic and/or treatment information associated with the prevention of achieving the malignant state in these tissues, and can be important in risk assessment for a patient. These polynucleotides can also serve as non-tissue specific markers of, for example, risk of metastasis of a tumor. Table 58 summarizes this data.

TABLE 58

Genes Differentially Expressed Across Multiple Library Comparisons

| SEQ ID NO: | Cell or Tissue Sample and Cancer State Compared | Ratio |
|---|---|---|
| 6153 | High Met Lung (lib8) > Low Met Lung (lib9) | 15 |
| 6153 | High Met Colon (lib1) > Low Met Colon (lib2) | 4 |
| 6174 | High Met Colon Tissue (lib17) > Normal Colon Tissue (lib15) | 5 |
| 6174 | Normal Colon Tumor Tissue (lib16) > Normal Colon Tissue (lib15) | 3 |
| 6205 | High Met Breast (lib3) > Low Met Breast (lib4) | 6 |
| 6205 | Low Met Colon (lib2) > High Met Colon (lib1) | 13 |
| 6344 | High Met Colon (lib1) > Low Met Colon (lib2) | 31 |
| 6344 | Normal Prostate (lib21) > Prostate Cancer (lib22) | 2 |
| 6344 | Low Met Breast (lib4) > High Met Breast (lib3) | 59 |
| 6436 | Prostate Cancer (lib22) > Normal Prostate (lib21) | 12 |
| 6436 | Low Met Breast (lib4) > High Met Breast (lib3) | 4 |
| 6559 | Normal Colon Tissue (lib15) > High Met Colon Tissue (lib17) | 9 |
| 6559 | Normal Colon Tissue (lib15) > Normal Colon Tumor Tissue (lib16) | 8 |
| 6794 | High Met Colon (lib1) > Low Met Colon (lib2) | 10 |
| 6794 | Low Met Lung (lib9) > High Met Lung (lib8) | 5 |
| 6795 | Low Met Breast (lib4) > High Met Breast (lib3) | 14 |
| 6795 | Prostate Cancer (lib22) > Normal Prostate (lib21) | 11 |
| 6918 | High Met Colon Tissue (lib17) > Normal Colon Tumor Tissue (lib16) | 10 |
| 6918 | Low Met Lung (lib9) > High Met Lung (lib8) | 9 |
| 6918 | Low Met Colon (lib2) > High Met Colon (lib1) | 5 |
| 6918 | High Met Colon Tissue (lib17) > Normal Colon Tissue (lib15) | 4 |
| 6937 | High Met Breast (lib3) > Low Met Breast (lib4) | 8 |
| 6937 | Low Met Colon (lib2) > High Met Colon (lib1) | 3 |
| 7020 | High Met Colon (lib1) > Low Met Colon (lib2) | 2 |
| 7020 | Low Met Lung (lib9) > High Met Lung (lib8) | 9 |
| 7045 | Low Met Lung (lib9) > High Met Lung (lib8) | 5 |
| 7045 | Low Met Breast (lib4) > High Met Breast (lib3) | 3 |
| 7069 | Low Met Colon (lib2) > High Met Colon (lib1) | 12 |
| 7069 | Low Met Lung (lib9) > High Met Lung (lib8) | 2 |
| 7253 | High Met Lung (lib8) > Low Met Lung (lib9) | 5 |
| 7253 | High Met Breast (lib3) > Low Met Breast (lib4) | 3 |
| 7281 | Normal Colon Tumor Tissue (lib16) > High Met Colon Tissue (lib17) | 4 |
| 7281 | High Met Lung (lib8) > Low Met Lung (lib9) | 4 |
| 7281 | Low Met Breast (lib4) > High Met Breast (lib3) | 3 |
| 7309 | High Met Breast (lib3) > Low Met Breast (lib4) | 39 |
| 7309 | Prostate Cancer (lib22) > Normal Prostate (lib21) | 35 |
| 7309 | Low Met Colon (lib2) > High Met Colon (lib1) | 3 |
| 7347 | High Met Breast (lib3) > Low Met Breast (lib4) | 6 |
| 7347 | Low Met Colon (lib2) > High Met Colon (lib1) | 9 |
| 7407 | Normal Colon Tumor Tissue (lib16) > Normal Colon Tissue (lib15) | 8 |
| 7407 | High Met Colon Tissue (lib17) > Normal Colon Tissue (lib15) | 7 |
| 7621 | Normal Prostate (lib21) > Prostate Cancer (lib22) | 6 |
| 7621 | High Met Lung (lib8) > Low Met Lung (lib9) | 3 |
| 7621 | High Met Breast (lib3) > Low Met Breast (lib4) | 3 |
| 7634 | High Met Breast (lib3) > Low Met Breast (lib4) | 20 |
| 7634 | HMEC-VEGF (lib14) > HMEC (lib12) | 2 |
| 7634 | HMEC-bFGF (lib13) > HMEC (lib12) | 2 |

Key for Table 58:
High Met = high metastatic potential;
Low Met = low metastatic potential;
met = metastasized;
tumor = non-metastasized tumor;
HMEC = human microvascular endothelial cell;
bFGF = bFGF treated;
VEGF = VEGF treated.

Example 40

Identification of Contiguous Sequences Having a Polynucleotide of the Invention The novel polynucleotides were used to screen publicly available and proprietary databases to determine if any of the polynucleotides of SEQ ID NOS:8707-8803 would facilitate identification of a contiguous sequence, e.g. the polynucleotides would provide sequence that would result in 5' extension of another DNA sequence, resulting in production of a longer contiguous sequence composed of the provided polynucleotide and the other DNA sequence(s). Contiging was performed using the Gelmerge application (default settings) of GCG from the Univ. of Wisconsin.

Using these parameters, 97 contiged sequences were generated. These contiged sequences are provided as SEQ ID NOS: 8707-8803 (see Table 41C). Table 41C provides the SEQ ID NO of the contig sequence, the name of the sequence used to create the contig, and the accession number of the publicly available tentative human consensus (THC) sequence used with the sequence of the corresponding sequence name to provide the contig. The sequence name of Table 41C can be correlated with the SEQ ID NO: of the polynucleotide of the invention using Tables 41A and 41B.

TABLE 41C

| SEQ ID NO: | Sequence Name | THC Accession No. |
|---|---|---|
| 8707 | RTA00000587F.p.24.1.Seq | THC226834 |
| 8708 | RTA00000629F.1.02.1.Seq | THC210324 |
| 8709 | RTA00000623F.n.17.1.Seq | THC208388 |
| 8710 | RTA00000593F.i.08.2.Seq | H91190 |
| 8711 | RTA00000622F.b.03.1.Seq | AA554045 |
| 8712 | RTA00000618F.e.06.1.Seq | THC226692 |
| 8713 | RTA00000592F.o.02.1.Seq | AA099789 |
| 8714 | RTA00000618F.c.04.1.Seq | THC222808 |
| 8715 | RTA00000590F.i.01.1.Seq | THC173163 |
| 8716 | RTA00000606F.o.14.1.Seq | THC223717 |
| 8717 | RTA00000626F.d.07.1.Seq | THC234888 |
| 8718 | RTA00000587F.1.08.1.Seq | THC104384 |
| 8719 | RTA00000586F.a.13.1.Seq | THC140691 |
| 8720 | RTA00000617F.a.17.1.Seq | THC221850 |
| 8721 | RTA00000615F.b.23.1.Seq | THC205191 |
| 8722 | RTA00000632F.f.10.1.Seq | N39216 |
| 8723 | RTA00000607F.o.13.2.Seq | THC233619 |
| 8724 | RTA00000622F.c.12.1.Seq | THC118482 |
| 8725 | RTA00000625F.b.07.1.Seq | THC223154 |
| 8726 | RTA00000587F.j.01.1.Seq | H63018 |
| 8727 | RTA00000608F.i.15.1.Seq | THC216448 |
| 8728 | RTA00000592F.j.06.1.Seq | THC148215 |
| 8729 | RTA00000589F.b.14.1.Seq | THC158020 |
| 8730 | RTA00000633F.g.19.1.Seq | THC202541 |
| 8731 | RTA00000620F.o.07.1.Seq | THC155200 |
| 8732 | RTA00000586F.p.01.1.Seq | AA558590 |
| 8733 | RTA00000630F.1.10.1.Seq | THC204748 |
| 8734 | RTA00000626F.c.13.1.Seq | AA159259 |
| 8735 | RTA00000591F.m.06.1.Seq | THC227858 |
| 8736 | RTA00000630F.i.11.1.Seq | THC228806 |
| 8737 | RTA00000621F.h.08.1.Seq | THC163604 |
| 8738 | RTA00000589F.d.10.1.Seq | THC177076 |
| 8739 | RTA00000597F.p.01.1.Seq | THC210746 |
| 8740 | RTA00000619F.c.13.1.Seq | R57955 |
| 8741 | RTA00000607F.c.07.2.Seq | THC208762 |
| 8742 | RTA00000595F.b.02.1.Seq | THC233682 |
| 8743 | RTA00000631F.h.04.1.Seq | THC223281 |
| 8744 | RTA00000596F.p.18.1.Seq | THC197103 |
| 8745 | RTA00000586F.o.13.1.Seq | THC222729 |
| 8746 | RTA00000610F.p.17.1.Seq | EST19015 |
| 8747 | RTA00000596F.c.05.1.Seq | EST72617 |
| 8748 | RTA00000632F.j.19.1.Seq | THC90741 |
| 8749 | RTA00000607F.e.23.2.Seq | AA639216 |
| 8750 | RTA00000628F.b.19.1.Seq | THC118075 |
| 8751 | RTA00000609F.d.13.1.Seq | THC195579 |
| 8752 | RTA00000621F.k.03.1.Seq | EST70278 |
| 8753 | RTA00000592F.1.04.1.Seq | THC91941 |
| 8754 | RTA00000592F.k.09.1.Seq | THC229803 |
| 8755 | RTA00000622F.e.17.1.Seq | R57425 |
| 8756 | RTA00000628F.g.13.1.Seq | THC176706 |
| 8757 | RTA00000592F.k.23.1.Seq | THC232202 |
| 8758 | RTA00000609F.m.04.2.Seq | AA507611 |
| 8759 | RTA00000626F.b.04.1.Seq | EST69420 |
| 8760 | RTA00000591F.m.01.1.Seq | H41850 |
| 8761 | RTA00000608F.n.23.1.Seq | THC214886 |
| 8762 | RTA00000583F.d.19.1.Seq | THC229251 |

TABLE 41C-continued

| SEQ ID NO: | Sequence Name | THC Accession No. |
|---|---|---|
| 8763 | RTA00000621F.p.15.1.Seq | THC212450 |
| 8764 | RTA00000583F.n.05.1.Seq | AA252468 |
| 8765 | RTA00000597F.f.17.1.Seq | THC219322 |
| 8766 | RTA00000606F.1.10.1.Seq | THC225232 |
| 8767 | RTA00000618F.n.14.1.Seq | THC216591 |
| 8768 | RTA00000612F.h.05.3.Seq | THC158250 |
| 8769 | RTA00000619F.a.24.1.Seq | AA437370 |
| 8770 | RTA00000617F.k.13.1.Seq | AA244445 |
| 8771 | RTA00000623F.h.07.1.Seq | THC212330 |
| 8772 | RTA00000620F.e.01.1.Seq | THC167493 |
| 8773 | RTA00000620F.h.10.1.Seq | THC232456 |
| 8774 | RTA00000589F.e.21.2.Seq | THC208239 |
| 8775 | RTA00000626F.b.22.1.Seq | THC225644 |
| 8776 | RTA00000620F.i.16.1.Seq | AA536090 |
| 8777 | RTA00000613F.c.17.1.Seq | THC92470 |
| 8778 | RTA00000621F.c.12.1.Seq | THC156244 |
| 8779 | RTA00000618F.b.17.1.Seq | THC209838 |
| 8780 | RTA00000585F.d.16.1.Seq | THC211870 |
| 8781 | RTA00000592F.a.06.1.Seq | THC233200 |
| 8782 | RTA00000583F.p.08.1.Seq | THC196844 |
| 8783 | RTA00000622F.h.21.1.Seq | EST12698 |
| 8784 | RTA00000591F.h.03.1.Seq | THC213771 |
| 8785 | RTA00000620F.g.22.1.Seq | THC224063 |
| 8786 | RTA00000588F.l.20.2.Seq | R84876 |
| 8787 | RTA00000614F.a.20.1.Seq | R84876 |
| 8788 | RTA00000611F.n.14.3.Seq | THC200742 |
| 8789 | RTA00000619F.f.23.1.Seq | THC227573 |
| 8790 | RTA00000608F.g.24.1.Seq | T93977 |
| 8791 | RTA00000595F.o.01.2.Seq | EST61392 |
| 8792 | RTA00000608F.b.23.1.Seq | THC161665 |
| 8793 | RTA00000606F.o.23.1.Seq | AA464645 |
| 8794 | RTA00000588F.i.22.3.Seq | THC162216 |
| 8795 | RTA00000610F.i.13.1.Seq | AA595068 |
| 8796 | RTA00000608F.b.15.1.Seq | EST11866 |
| 8797 | RTA00000597F.e.16.1.Seq | N88730 |
| 8798 | RTA00000610F.h.13.1.Seq | THC195895 |
| 8799 | RTA00000611F.h.21.2.Seq | EST46722 |
| 8800 | RTA00000584F.b.06.1.Seq | EST02998 |
| 8801 | RTA00000584F.b.06.2.Seq | EST02998 |
| 8802 | RTA00000608F.j.05.1.Seq | EST60433 |
| 8803 | RTA00000588F.b.03.1.Seq | THC164651 |

The contiged sequences (SEQ ID NOS: 8707-8803) thus represent longer sequences that encompass a polynucleotide sequence of the invention. The contiged sequences were then translated in all three reading frames to determine the best alignment with individual sequences using the BLAST programs as described above. The sequences were masked using the XBLAST program for masking low complexity as described above in Example 27. Several of the contiged sequences were found to encode polypeptides having characteristics of a polypeptide belonging to a known protein families (and thus represent new members of these protein families) and/or comprising a known functional domain (Table 42B, inserted prior to claims). Thus the invention encompasses fragments, fusions, and variants of such polynucleotides that retain biological activity associated with the protein family and/or functional domain identified herein.

Descriptions of the profiles for the indicated protein families and functional domains are provided 3 above. A description of the profile for PR55 is provided below.

Protein Phosphatase 2A Regulatory Subunit PR55 (PR55). Several of the contigs correspond to a sequence encoding a protein comprising a protein phosphatase 2A (PP2A) regulatory subunit PR55. PP2A is a serine/threonine phosphatase involved in many aspects of cellular function including the regulation of metabolic enzymes and proteins involved in signal transduction. PP2A is a trimeric enzyme comprising a core composed of a catalytic subunit associated with a 65 Kd regulatory subunit (PR65, also called subunit A). This complex associates with a third variable subunit (subunit B), which confers distinct properties to the holoenzyme (Mayer-Jaekel et al. *Trends Cell Biol*. (1994) 4:287-291). One of the forms of the variable subunit is a 55 Kd protein (PR55) which is highly conserved in mammals and may facilitate substrate recognition or targeting the enzyme complex to the appropriate subcellular compartment. The PR55 subunit comprises two conserved sequences of 15 residues; one located in the N-terminal region, the other in the center of the protein.

Those skilled in the art will recognize, or be able to ascertain, using not more than routine experimentation, many equivalents to the specific embodiments of the invention described herein. Such specific embodiments and equivalents are intended to be encompassed by the following claims.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

Deposit Information. The following materials were deposited with the American Type Culture Collection (CMCC=Chiron Master Culture Collection).

TABLE 59

Cell Lines Deposited with ATCC

| Cell Line | Deposit Date | ATCC Accession No. | CMCC Accession No. |
|---|---|---|---|
| KM12L4-A | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

In addition, pools of selected clones, as well as libraries containing specific clones, were assigned an "ES" number (internal reference) and deposited with the ATCC. Table 60 below provides the ATCC Accession Nos. of the ES deposits, all of which were deposited on or before May 13, 1999. The names of the clones contained within each of these deposits are provided in the tables numbered 61-63 (inserted before the claims).

TABLE 60

Pools of Clones and Libraries Deposited with ATCC on or before May 14, 1999

| ES # | ATCC Accession # |
|---|---|
| 34 | |
| 35 | |
| 36 | |
| 37 | |
| 38 | |
| 39 | |
| 40 | |
| 41 | |
| 42 | |

TABLE 60-continued

Pools of Clones and Libraries Deposited with ATCC on or before May 14, 1999

| ES # | ATCC Accession # |
|---|---|
| 43 | |
| 44 | |
| 45 | |
| 46 | |
| 47 | |
| 48 | |
| 49 | |
| 50 | |
| 51 | |
| 52 | |
| 53 | |
| 54 | |

The deposits described herein are provided merely as convenience to those of skill in the art, and is not an admission that a deposit is required under 35 U.S.C. §112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby.

Retrieval of Individual Clones from Deposit of Pooled Clones. Where the ATCC deposit is composed of a pool of cDNA clones or a library of cDNA clones, the deposit was prepared by first transfecting each of the clones into separate bacterial cells. The clones in the pool or library were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

TABLE 61

Deposits of Pooled Clones

| ES34 | ES35 | ES36 | ES37 |
|---|---|---|---|
| M00006992C:G02 | M00005468A:D08 | M00005452C:A02 | M00022171D:B08 |
| M00006756D:E10 | M00021892B:H03 | M00001382C:C09 | M00008061A:F02 |
| M00003984C:F04 | M00001390A:C06 | M00004841C:B09 | M00003820C:A09 |
| M00007125D:E03 | M00022074D:F11 | M00001441D:H05 | M00022109B:A11 |
| M00006650A:A10 | M00005460B:D02 | M00022716D:D08 | M00005342D:F03 |
| M00001452B:H06 | M00022423B:D03 | M00022828C:E04 | M00022070B:C10 |
| M00022972D:C10 | M00007140A:F11 | M00004350B:F06 | M00006966B:B09 |
| M00022305C:A01 | M00004081B:C11 | M00005685B:D08 | M00022381C:C12 |
| M00007010B:H01 | M00005480A:H12 | M00004190A:A09 | M00003991B:B05 |
| M00021946D:C11 | M00008015D:E09 | M00004054D:D02 | M00022404D:G05 |

| ES38 | ES39 | ES40 | ES41 |
|---|---|---|---|
| M00021912B:H11 | M00007118B:B04 | M00006993B:B09 | M00007974B:C11 |
| M00005378C:A10 | M00007019A:B01 | M00004242C:C01 | M00021860B:G06 |
| M00022578C:B07 | M00021682B:D12 | M00007986C:C05 | M00006927C:F12 |
| M00005513A:D08 | M00005411D:A03 | M00004115A:G09 | M00022582C:E12 |
| M00022176C:A08 | M00006641C:H02 | M00022600C:A06 | M00006618C:G08 |
| M00006822D:F07 | M00007041B:C05 | M00005384A:A01 | M00005450B:B01 |
| M00004031A:B04 | M00005444B:E11 | M00021667D:E03 | M00001417B:E01 |
| M00021927D:D12 | M00022745B:G02 | M00008078C:C06 | M00003825B:A05 |
| M00001553B:B06 | M00022685A:F11 | M00007985B:A09 | M00001370B:B04 |
| M00022404B:H05 | M00004446A:G01 | M00007953B:B03 | M00006727B:E09 |

| ES42 | ES43 | ES44 | ES45 |
|---|---|---|---|
| M00001478A:B06 | M00006923B:H08 | M00006615B:F05 | M00005468D:F04 |
| M00003972B:A11 | M00005377D:F11 | M00005486C:B03 | M00006720C:C11 |
| M00005477C:D08 | M00006640B:H09 | M00007124C:A11 | M00005817D:E12 |
| M00006745A:A01 | M00005404C:F02 | M00006995D:A03 | M00001669B:A03 |
| M00007090B:A02 | M00004030A:G12 | M00007149D:G06 | M00003998A:G12 |
| M00007152A:B04 | M00006704D:D03 | M00006990D:D06 | M00004045A:B12 |
| M00006953B:H10 | M00006810D:A05 | M00005530B:E04 | M00004130D:E04 |
| M00005399D:B02 | M00005481C:A05 | M00003918C:E07 | M00004160A:D07 |
| M00006987B:F04 | M00005411A:C07 | M00007163A:B10 | M00001655B:F07 |
| M00005772A:F03 | M00003970A:G10 | M00005485C:A03 | M00001468D:D11 |

| ES46 |
|---|
| M00004217A:A05 |
| M00004183D:B07 |
| M00001415D:A05 |
| M00004158C:F03 |
| M00004031D:G02 |

TABLE 62

Library Deposits

| ES47 | ES48 | ES49 | ES50 |
|---|---|---|---|
| M00001399D:F09 | M00004217D:G10 | M00004508A:G12 | M00021653A:G07 |
| M00001455A:C03 | M00004218C:G10 | M00004508B:G02 | M00021654C:A02 |
| M00001456C:F02 | M00004252D:H08 | M00001432B:H08 | M00021660C:G04 |
| M00001487D:G03 | M00004253B:A10 | M00001432C:G01 | M00021665A:D04 |
| M00001539B:B01 | M00004253B:F06 | M00003992D:G01 | M00021670B:G11 |
| M00001565A:A02 | M00004253C:E10 | M00005326B:F03 | M00021678A:B08 |
| M00001572C:E07 | M00004260A:B07 | M00005332A:H10 | M00021680B:C01 |
| M00001582D:B10 | M00004260C:A12 | M00005342A:C04 | M00021681C:B10 |
| M00001584C:A03 | M00004260C:E10 | M00005342A:D04 | M00021690D:E05 |
| M00001586A:F09 | M00001339B:A03 | M00005349B:G01 | M00021692A:E03 |
| M00001588D:H08 | M00001342C:A04 | M00005352B:D02 | M00021692C:E06 |
| M00001610B:A01 | M00001344D:G11 | M00005354C:E02 | M00021694B:A07 |
| M00001618B:F02 | M00001345A:A12 | M00005356A:D09 | M00021698B:B12 |
| M00001618C:E06 | M00001347A:G06 | M00005359D:G07 | M00021828A:C08 |
| M00001621C:A04 | M00001347B:H01 | M00005378A:A08 | M00021841C:D07 |
| M00001626B:H05 | M00001353B:D11 | M00005383D:D06 | M00021859A:D04 |
| M00001641B:G05 | M00001355B:A01 | M00005383D:E07 | M00021861C:A02 |
| M00001648C:F06 | M00001358D:D09 | M00005385C:G05 | M00021862A:A04 |
| M00001649D:H05 | M00001359A:B07 | M00005388D:F09 | M00021862D:F01 |
| M00001656D:F11 | M00001362A:C10 | M00005390B:G10 | M00021886D:E04 |
| M00001660A:F10 | M00001362B:A09 | M00005397C:B03 | M00021897B:A06 |
| M00001669A:H11 | M00001365D:D12 | M00005399A:D01 | M00021905A:G05 |

TABLE 62-continued

| Library Deposits | | | |
|---|---|---|---|
| ES47 | ES48 | ES49 | ES50 |
| M00003741A:E01 | M00001365D:H09 | M00005409D:C02 | M00021905B:A01 |
| M00003745C:E03 | M00001370A:G09 | M00005415C:G08 | M00021906C:G11 |
| M00003746A:E01 | M00001370B:B12 | M00005417A:E10 | M00021910A:C10 |
| M00003748B:B06 | M00001374D:D09 | M00005442D:C05 | M00021927A:C11 |
| M00003749B:C08 | M00001376C:C11 | M00005446A:G01 | M00021927B:F01 |
| M00003749D:G07 | M00001377A:D03 | M00005446C:D12 | M00021932C:C05 |
| M00003752A:B06 | M00001377A:E01 | M00005454C:H12 | M00021932C:G10 |
| M00003752D:D09 | M00001377C:B08 | M00005455A:D01 | M00021947A:C01 |
| M00003753C:B01 | M00001387A:A04 | M00005455A:G03 | M00021952B:F11 |
| M00003754C:F01 | M00001387D:C07 | M00005462C:B02 | M00021954A:A03 |
| M00003756C:C08 | M00001389B:B06 | M00005469D:C11 | M00021964A:C04 |
| M00003759A:E10 | M00001390A:H01 | M00005480C:B12 | M00021967D:E08 |
| M00003762A:D11 | M00001399C:E10 | M00005483D:A12 | M00021977D:E02 |
| M00003763B:D03 | M00001401D:D04 | M00005484A:D09 | M00021978A:F08 |
| M00003763D:F06 | M00001402C:C07 | M00005491B:C03 | M00021982C:F08 |
| M00003765D:E02 | M00001402D:H03 | M00005493B:C08 | M00021983B:B03 |
| M00003766B:G04 | M00001403B:A01 | M00005494D:F11 | M00021983D:B10 |
| M00003767C:F04 | M00001405D:F05 | M00005496C:A01 | M00022005C:G03 |
| M00003769B:A04 | M00001406C:A11 | M00005496D:A10 | M00022032A:E07 |
| M00003769D:G12 | M00001406D:H01 | M00005497B:H07 | M00022049A:A02 |
| M00003770D:C07 | M00001407B:A08 | M00005497C:C07 | M00022049A:D06 |
| M00003771A:G09 | M00001407D:H11 | M00005497C:C12 | M00022054D:C05 |
| M00003771D:A10 | M00001411A:D01 | M00005497C:E03 | M00022064C:H07 |
| M00003773A:C09 | M00001411C:G02 | M00005498B:F08 | M00022067D:C05 |
| M00003773B:E09 | M00001412A:A11 | M00005498C:G05 | M00022068B:H11 |
| M00003773B:G08 | M00001415D:E12 | M00005508B:B04 | M00022068D:D12 |
| M00003773C:G06 | M00001417C:E02 | M00005524C:B01 | M00022069D:G02 |
| M00003773D:C02 | M00001421A:H07 | M00005528D:A10 | M00022071B:D05 |
| M00003789C:E03 | M00001422D:D02 | M00005530B:D03 | M00022071C:D09 |
| M00003790B:F12 | M00001423C:D06 | M00005534B:H10 | M00022075D:F05 |
| M00003793C:D11 | M00001424A:H09 | M00005548B:E03 | M00022081C:G11 |
| M00003796B:C07 | M00001425C:E10 | M00005550B:D09 | M00022084B:F04 |
| M00003797D:H06 | M00001426A:F09 | M00005565C:A08 | M00022085C:C04 |
| M00003801D:F05 | M00001426D:D09 | M00005589C:B03 | M00022090A:G08 |
| M00003805A:G05 | M00001431A:C10 | M00005616B:D05 | M00022093A:A05 |
| M00003808C:D09 | M00001431A:E05 | M00005620C:C05 | M00022093D:B10 |
| M00003809A:A12 | M00001432A:F12 | M00005621A:G10 | M00022094B:G10 |
| M00003809A:H12 | M00001432B:H08 | M00005621D:F01 | M00022106C:F04 |
| M00003813D:A06 | M00001432C:G01 | M00005631A:A11 | M00022110A:E04 |
| M00003818A:F09 | M00001433A:C07 | M00005632C:D06 | M00022114C:B02 |
| M00003818B:A01 | M00001434A:A01 | M00005637B:D12 | M00022117C:G07 |
| M00003819D:G09 | M00001435A:F03 | M00005642B:C03 | M00022128A:D04 |
| M00003821C:E04 | M00001435A:G01 | M00005647D:D09 | M00022139A:C01 |
| M00003822A:G05 | M00001435B:G10 | M00005655C:C02 | M00022149B:D05 |
| M00003825C:B02 | M00001435C:G08 | M00005703A:C08 | M00022150A:H06 |
| M00003825C:B12 | M00001435D:A06 | M00005704A:B11 | M00022153D:D11 |
| M00003833B:A11 | M00001436C:C10 | M00005708D:B03 | M00022157A:F12 |
| M00003834A:A03 | M00001437B:B05 | M00005710A:C08 | M00022157B:A10 |
| M00003835D:H05 | M00001438C:H05 | M00005720A:D03 | M00022169D:C02 |
| M00003839D:G06 | M00001439B:F10 | M00005722D:G03 | M00022170D:H09 |
| M00003841A:E09 | M00001439C:A01 | M00005743B:F02 | M00022175A:A11 |
| M00003841B:D05 | M00001439C:G06 | M00005763B:H09 | M00022176A:E08 |
| M00003843A:B01 | M00001442A:D08 | M00005765C:C04 | M00022178D:H01 |
| M00003844C:D04 | M00001443D:A01 | M00005810C:D04 | M00022183A:G03 |
| M00003844C:H05 | M00001444A:A09 | M00005813D:F06 | M00022189A:A01 |
| M00003846B:H02 | M00001446B:B10 | M00005818C:E08 | M00022198A:C12 |
| M00003850B:D11 | M00001452D:E05 | M00005818C:G01 | M00022199C:F03 |
| M00003852D:D03 | M00001453C:F09 | M00006576D:F11 | M00022202C:F11 |
| M00003859C:B09 | M00001463C:A01 | M00006577B:H12 | M00022206B:G06 |
| M00003868D:F02 | M00001466C:F02 | M00006587A:H08 | M00022212C:C02 |
| M00003868D:F07 | M00001471C:G03 | M00006594A:E08 | M00022216D:C01 |
| M00003871A:E09 | M00001488B:G12 | M00006596D:H04 | M00022218C:B06 |
| M00003884D:A12 | M00001489B:F08 | M00006601C:A07 | M00022218D:B12 |
| M00003887B:C03 | M00001489D:C08 | M00006601C:E06 | M00022220C:F08 |
| M00003888B:A10 | M00001490B:G04 | M00006609A:G10 | M00022221D:E08 |
| M00003888C:E01 | M00001491C:C01 | M00006633C:E11 | M00022226C:B06 |
| M00003890B:H07 | M00001496A:B03 | M00006633D:A06 | M00022226D:A07 |
| M00003890D:C03 | M00001496C:D02 | M00006634B:C02 | M00022231A:F12 |
| M00003892C:D04 | M00001500A:D09 | M00006636A:B08 | M00022231C:A04 |
| M00003893C:D12 | M00001504D:D09 | M00006644A:B11 | M00022236D:A03 |
| M00003895D:A03 | M00001505A:E09 | M00006644D:C02 | M00022239A:A10 |
| M00003896B:F08 | M00001506A:F01 | M00006686A:G12 | M00022239B:B07 |
| M00003896C:B01 | M00001517C:C03 | M00006692B:E04 | M00022239D:A07 |
| M00003903C:H03 | M00001518D:A10 | M00006728D:G10 | M00022252C:E06 |
| M00003905C:B01 | M00001536B:B11 | M00006733D:G12 | M00022253B:E06 |
| M00003905C:E10 | M00001537B:C12 | M00006734A:H12 | M00022254C:D08 |

TABLE 62-continued

| Library Deposits | | | |
|---|---|---|---|
| ES47 | ES48 | ES49 | ES50 |
| M00003906C:H12 | M00001542C:D10 | M00006735A:H02 | M00022255A:C08 |
| M00003909D:G01 | M00001542C:F06 | M00006764B:D05 | M00022255D:E03 |
| M00003911C:G05 | M00001543A:E04 | M00006765B:H06 | M00022258C:F06 |
| M00003912B:G11 | M00001546B:H01 | M00006785B:F09 | M00022259B:G02 |
| M00003912C:C11 | M00001551D:C12 | M00006791B:B08 | M00022278C:E03 |
| M00003914C:E03 | M00001552B:D01 | M00006796A:C03 | M00022278D:F10 |
| M00003915A:D09 | M00001556D:A11 | M00006800C:G08 | M00022288C:D04 |
| M00003915C:G01 | M00001557C:B08 | M00006814A:F07 | M00022289A:D05 |
| M00003920B:A10 | M00001558B:A12 | M00006819A:D10 | M00022289D:B06 |
| M00003921D:C06 | M00001560C:C01 | M00006820A:G05 | M00022294A:D11 |
| M00003923A:H07 | M00001561B:C10 | M00006821C:C10 | M00022296B:C11 |
| M00003936C:F10 | M00001597C:B03 | M00006822A:D07 | M00022305A:H11 |
| M00003948B:B03 | M00001623B:B01 | M00006823D:D12 | M00022364C:G12 |
| M00003949B:A08 | M00001623D:A09 | M00006826B:H03 | M00022366B:E09 |
| M00003949B:D05 | M00001644D:F09 | M00006828C:C12 | M00022372B:D03 |
| M00003961B:A12 | M00003784C:B09 | M00006832D:F11 | M00022381A:F05 |
| M00003961C:G02 | M00003785D:E01 | M00006846A:B01 | M00022382D:H11 |
| M00003962B:B09 | M00003862C:H10 | M00006850C:D09 | M00022386A:A07 |
| M00003963B:D12 | M00003864B:A04 | M00006850C:G07 | M00022386B:D11 |
| M00003973A:C05 | M00003864D:G05 | M00006851C:H09 | M00022386C:A04 |
| M00003973B:H06 | M00003992C:G01 | M00006863B:E06 | M00022386C:D07 |
| M00003976D:D12 | M00003992D:G01 | M00006866C:F03 | M00022399C:A10 |
| M00003977C:A08 | M00003994C:C11 | M00006867C:E07 | M00022407C:H11 |
| M00003980B:F12 | M00003996D:C04 | M00006868D:E02 | M00022411D:G09 |
| M00003980C:G10 | M00003997D:D07 | M00006870C:H06 | M00022412A:C08 |
| M00003981C:E04 | M00003998A:D03 | M00006873B:G11 | M00022444A:A11 |
| M00003983C:E07 | M00003998C:H10 | M00006875A:A02 | M00022449C:B01 |
| M00003987D:F06 | M00003999C:C12 | M00006877B:E05 | M00022452C:B03 |
| M00004027A:B10 | M00004046A:F04 | M00006879A:H11 | M00022457C:B01 |
| M00004027C:H01 | M00004051C:D02 | M00006882A:D01 | M00022495C:G05 |
| M00004028C:B04 | M00004052C:A08 | M00006901D:A11 | M00022504B:E03 |
| M00004030B:B02 | M00004052C:B05 | M00006907C:D03 | M00022505D:A12 |
| M00004030B:C05 | M00004054B:G02 | M00006907D:C07 | M00022509D:F06 |
| M00004035D:E04 | M00004054D:A03 | M00006912B:E01 | M00022527A:E05 |
| M00004036B:F09 | M00004055B:F06 | M00006921B:E01 | M00022527D:B03 |
| M00004036C:D01 | M00004058B:C11 | M00006960B:E06 | M00022531B:D07 |
| M00004037A:A07 | M00004058C:E08 | M00006963A:H11 | M00022535D:B11 |
| M00004037B:B05 | M00004059A:G09 | M00006966C:B07 | M00022535D:C04 |
| M00004038C:C05 | M00004060C:A02 | M00006972A:F10 | M00022536B:B04 |
| M00004038C:D12 | M00004060D:A07 | M00006973C:E11 | M00022551A:G03 |
| M00004039D:D03 | M00004063C:B11 | M00006973D:E11 | M00022556B:C04 |
| M00004040B:B09 | M00004143A:G12 | M00006974B:F06 | M00022556B:G02 |
| M00004040C:G12 | M00004143A:H07 | M00006976B:E09 | M00022562C:H10 |
| M00004040D:B05 | M00004145C:A03 | M00007014C:B07 | M00022578B:G05 |
| M00004041B:F01 | M00004146D:A07 | M00007015C:G05 | M00022578D:F03 |
| M00004041D:E06 | M00004147A:G03 | M00007016C:E06 | M00022583B:E05 |
| M00004043D:C10 | M00004149B:H12 | M00007041B:G01 | M00022587C:G04 |
| M00004069D:G02 | M00004153D:E06 | M00007042A:E07 | M00022594B:H12 |
| M00004071A:H03 | M00004154D:F11 | M00007043A:B05 | M00022598A:F11 |
| M00004073D:B11 | M00004159D:C04 | M00007046A:D02 | M00022599D:E07 |
| M00004076D:B03 | M00004166B:E10 | M00007047D:D01 | M00022604B:C11 |
| M00004081C:A01 | M00004166C:A03 | M00007051D:D09 | M00022607B:A04 |
| M00004084C:G04 | M00004166D:G07 | M00007053B:H03 | M00022613D:C04 |
| M00004085B:G06 | M00004196C:G05 | M00007058A:C02 | M00022651D:C06 |
| M00004087C:F05 | M00004234B:E03 | M00007062A:D03 | M00022666C:H11 |
| M00004091A:E01 | M00004234B:G06 | M00007099A:F09 | M00022681C:H02 |
| M00004091B:C12 | M00004236D:E07 | M00007100C:D01 | M00022682A:F12 |
| M00004091B:G04 | M00004236D:F04 | M00007112B:C06 | M00022698C:E06 |
| M00004091C:F04 | M00004240D:A07 | M00007105D:C07 | M00022701B:B12 |
| M00004091D:D09 | M00004242C:C02 | M00007121A:A05 | M00022708A:C08 |
| M00004092A:C03 | M00004244B:A02 | M00007122A:G11 | M00022708D:G10 |
| M00004092A:D04 | M00004245A:G09 | M00007122B:A11 | M00022725C:E09 |
| M00004093D:D09 | M00004245C:A03 | M00007127B:A04 | M00022726A:A06 |
| M00004101D:A03 | M00004247A:E01 | M00007129A:G10 | M00022730A:E04 |
| M00004103B:C07 | M00004247B:C11 | M00007130B:B03 | M00022737A:C08 |
| M00004107C:A01 | M00004248A:G08 | M00007132D:G08 | M00022763A:E10 |
| M00004114C:F02 | M00004263D:F06 | M00007134C:F07 | M00022824C:H11 |
| M00004115A:F01 | M00004272D:D02 | M00007137D:C10 | M00022835C:E06 |
| M00004117B:F01 | M00004273D:E11 | M00007140C:C12 | M00022854D:H07 |
| M00004120A:C02 | M00004277D:C08 | M00007150A:C09 | M00022856A:D02 |
| M00004126B:G02 | M00004281B:B05 | M00007150A:H06 | M00022856B:F04 |
| M00004129A:H08 | M00004283C:D03 | M00007154A:E04 | M00022856C:B11 |
| M00004130C:A09 | M00004285B:E01 | M00007163A:F11 | M00022893C:H11 |
| M00004133D:A01 | M00004297D:E08 | M00007163B:A12 | M00022897A:F04 |
| M00004178B:F06 | M00004298B:D04 | M00007166B:E06 | M00022900D:E08 |
| M00004180B:F04 | M00004308A:E06 | M00007170D:A10 | M00022900D:G03 |

TABLE 62-continued

Library Deposits

| ES47 | ES48 | ES49 | ES50 |
|---|---|---|---|
| M00004184B:F11 | M00004324B:D09 | M00007172A:A05 | |
| M00004191B:G01 | M00004328A:H06 | M00007172D:C08 | |
| M00004193A:C07 | M00004329C:F11 | M00007188A:D03 | |
| M00004193C:H01 | M00004331D:H08 | M00007189D:A09 | |
| M00004199D:C02 | M00004332D:E09 | M00007193D:A04 | |
| M00004200A:A09 | M00004337D:G08 | M00007195B:B02 | |
| M00004200A:G06 | M00004345A:H06 | M00007198C:A10 | |
| M00004200D:A07 | M00004383A:F02 | M00007199D:B07 | |
| M00004201D:C11 | M00004385C:B11 | M00007204C:F09 | |
| M00004201D:E12 | M00004388C:D05 | M00007929B:H10 | |
| M00004202B:A02 | M00004406A:H03 | M00007961A:B01 | |
| M00004204A:D04 | M00004408D:A10 | M00007964B:D10 | |
| M00004204A:D10 | M00004410A:E03 | M00007971A:B04 | |
| M00004204B:A04 | M00004412B:E03 | M00007977C:E08 | |
| M00004210A:B09 | M00004421A:G04 | M00007995D:E06 | |
| M00004216D:E10 | M00004447D:D10 | M00008074D:C01 | |
| M00004217A:A11 | M00004460B:H09 | M00008094A:E10 | |
| | M00004465C:B10 | M00021611D:D05 | |
| | M00004465C:B12 | M00021611D:H03 | |
| | M00004467A:F09 | M00021614B:G12 | |
| | M00004467D:F09 | M00021618D:D07 | |
| | M00004491D:D07 | M00021624A:D07 | |
| | M00004497C:E09 | M00021624B:A03 | |
| | M00004501A:G06 | M00021625A:C07 | |
| | M00004506C:H10 | M00021629D:D05 | |

TABLE 63

Library Deposits

| ES51 | ES52 | ES53 | ES54 |
|---|---|---|---|
| M00001448A:D05 | M00001439B:E02 | M00006621A:G10 | M00021640A:G03 |
| M00001458B:F06 | M00001443A:E02 | M00006626A:G11 | M00021657B:C08 |
| M00001530A:D11 | M00001443D:C03 | M00006629D:D04 | M00021690B:B06 |
| M00001563C:D06 | M00001444A:G12 | M00006630B:H06 | M00021690C:B07 |
| M00001564C:D04 | M00001445B:E03 | M00006631B:B02 | M00022071C:C09 |
| M00001569B:F04 | M00001451B:H11 | M00006631D:C04 | M00022081C:B11 |
| M00001575A:H02 | M00001452B:F09 | M00006631D:E09 | M00022085C:A07 |
| M00001589C:D12 | M00001488B:H02 | M00006635C:B10 | M00022091B:B07 |
| M00001589D:G10 | M00001491B:E07 | M00006636A:E06 | M00022122D:D06 |
| M00001590A:A07 | M00001496C:H10 | M00006636D:A05 | M00022150D:D11 |
| M00001598C:D10 | M00001499A:D01 | M00006636D:F11 | M00022154A:C01 |
| M00001599A:H09 | M00001499B:D05 | M00006640A:B01 | M00022170D:H07 |
| M00001609A:B12 | M00001499B:H05 | M00006640B:F05 | M00022365A:A01 |
| M00001614C:G04 | M00001500B:H07 | M00006640D:H08 | M00022389B:H04 |
| M00001626C:C10 | M00001504C:H11 | M00006641A:B03 | M00022439A:E07 |
| M00001634C:E12 | M00001506D:A11 | M00006643A:E10 | M00022449D:F06 |
| M00001639A:A04 | M00001543A:D03 | M00006644C:E09 | M00022458B:E06 |
| M00001640A:F02 | M00001543A:F01 | M00006648C:E04 | M00022474A:H09 |
| M00001640A:F04 | M00001548C:A09 | M00006650A:B11 | M00022480B:E07 |
| M00001647C:C07 | M00001555D:F11 | M00006656C:C10 | M00022489C:A08 |
| M00001649B:E08 | M00001557B:D10 | M00006664B:B04 | M00022490C:A08 |
| M00001654D:F06 | M00001597A:C07 | M00006664D:H09 | M00022490C:C01 |
| M00001658B:C07 | M00001604B:D09 | M00006665A:F07 | M00022493C:B07 |
| M00001659D:G08 | M00001605D:G01 | M00006665B:D10 | M00022493C:C06 |
| M00001663C:C03 | M00001621D:B09 | M00006674B:F04 | M00022498C:C08 |
| M00001675C:B03 | M00001622C:F06 | M00006676B:F11 | M00022514A:D04 |
| M00001677A:A06 | M00001624A:A09 | M00006676D:D11 | M00022515D:C04 |
| M00001677A:A12 | M00001640D:C10 | M00006679C:D07 | M00022549B:G07 |
| M00001678D:A12 | M00001645B:C09 | M00006681C:G04 | M00022557B:A08 |
| M00001679C:F03 | M00003782D:F04 | M00006695B:F08 | M00022565C:H02 |
| M00001681A:H09 | M00003783C:A06 | M00006698B:E06 | M00022578D:A08 |
| M00001687C:A06 | M00003786D:C06 | M00006699C:C07 | M00022597B:F11 |
| M00001693D:F07 | M00003787B:D07 | M00006705D:D02 | M00022599A:C03 |
| M00003746B:E12 | M00003787D:A06 | M00006712B:H10 | M00022661B:E11 |
| M00003766A:G09 | M00003864C:D09 | M00006717A:D04 | M00022661D:H01 |
| M00003795A:B01 | M00003993A:E12 | M00006721C:G07 | M00022666B:E12 |
| M00003796C:H03 | M00003997B:H04 | M00006725A:A03 | M00022674D:G04 |
| M00003797D:E10 | M00003997D:G11 | M00006725A:B03 | M00022718D:G05 |
| M00003799B:D02 | M00004047B:G09 | M00006727B:G08 | M00022725C:B03 |
| M00003809B:D08 | M00004048D:A07 | M00006728C:B06 | M00022727B:C05 |
| M00003811B:E07 | M00004049D:G04 | M00006737C:A08 | M00022728A:A09 |

TABLE 63-continued

| Library Deposits | | | |
|---|---|---|---|
| ES51 | ES52 | ES53 | ES54 |
| M00003812B:F08 | M00004050A:F02 | M00006738A:E05 | M00022730D:E10 |
| M00003812D:E08 | M00004051C:D10 | M00006739B:B10 | M00022735B:B01 |
| M00003815C:A06 | M00004058B:F12 | M00006739B:B12 | M00022745A:B04 |
| M00003815D:D01 | M00004060C:A11 | M00006739C:H07 | M00022856B:D07 |
| M00003816C:F10 | M00004064A:B12 | M00006743B:G12 | M00022901D:C09 |
| M00003818C:E09 | M00004066A:E12 | M00006744C:C06 | M00022902D:D03 |
| M00003819A:B09 | M00004067D:D08 | M00006745D:E08 | M00022953B:C07 |
| M00003819C:E04 | M00004134A:F08 | M00006751A:F03 | M00022960D:E08 |
| M00003820A:H04 | M00004134A:H04 | M00006758D:C01 | M00022963A:D11 |
| M00003820D:E02 | M00004134C:B11 | M00006760D:G12 | M00022968A:F02 |
| M00003824B:D06 | M00004140B:B01 | M00006763B:B11 | M00022980B:E11 |
| M00003825B:D12 | M00004143C:F08 | M00006769D:A04 | M00022980C:A09 |
| M00003826B:D01 | M00004144D:B06 | M00006770B:C05 | M00022993A:F02 |
| M00003829A:E02 | M00004152C:E01 | M00006771A:E06 | M00023003C:A03 |
| M00003832B:G03 | M00004159D:H07 | M00006771A:H07 | M00023011A:A06 |
| M00003833D:D06 | M00004160A:A01 | M00006771B:A09 | M00023021A:H08 |
| M00003835A:E03 | M00004161B:A12 | M00006771B:F03 | M00023023A:B12 |
| M00003837C:F05 | M00004163A:D11 | M00006774D:C01 | M00023028A:A02 |
| M00003839C:B05 | M00004164D:D02 | M00006777B:D10 | M00023033A:E10 |
| M00003845A:A05 | M00004165C:E09 | M00006779B:A11 | M00023034C:E05 |
| M00003846D:C12 | M00004166A:F02 | M00006779D:D03 | M00023036D:C04 |
| M00003857C:A03 | M00004167C:F10 | M00006780A:H12 | M00023094A:C04 |
| M00003858A:D01 | M00004169A:B11 | M00006789C:F04 | M00023103A:E11 |
| M00003860B:A07 | M00004200B:B04 | M00006790D:A05 | M00006754B:D05 |
| M00003868B:C07 | M00004222A:H10 | M00006796A:H10 | |
| M00003881D:D09 | M00004223D:D07 | M00006797B:D12 | |
| M00003883D:C03 | M00004225D:F01 | M00006801A:G05 | |
| M00003884B:E06 | M00004228C:D11 | M00006805A:E11 | |
| M00003886C:D10 | M00004229C:G11 | M00006805A:H09 | |
| M00003903C:A12 | M00004239C:A07 | M00006805B:C04 | |
| M00003912C:H01 | M00004239C:C09 | M00006807D:D08 | |
| M00003915B:G07 | M00004240D:E06 | M00006813A:C04 | |
| M00003920D:D09 | M00004241B:B01 | M00006822D:D05 | |
| M00003926B:E03 | M00004243C:E10 | M00006825C:D06 | |
| M00003934D:F01 | M00004266A:F10 | M00006831B:B04 | |
| M00003958C:C10 | M00004266B:H06 | M00006832A:F05 | |
| M00003965A:F07 | M00004268C:F08 | M00006832D:F10 | |
| M00003972C:F02 | M00004268D:G07 | M00006833B:E11 | |
| M00003974B:A04 | M00004269A:B11 | M00006872B:G01 | |
| M00003974C:A05 | M00004269D:E08 | M00006875D:D10 | |
| M00003975B:H09 | M00004276C:E12 | M00006879D:A10 | |
| M00003976C:C05 | M00004277B:C06 | M00006882D:F03 | |
| M00003980C:A11 | M00004277C:H11 | M00006884D:D06 | |
| M00003987A:C07 | M00004279D:E02 | M00006908C:A05 | |
| M00003988B:C10 | M00004281B:B03 | M00006921B:C02 | |
| M00003988C:A06 | M00004284B:F07 | M00006921B:E03 | |
| M00003989C:F01 | M00004287B:B12 | M00006949B:F03 | |
| M00004028C:D01 | M00004287C:B06 | M00006960A:G11 | |
| M00004029A:E01 | M00004297C:B08 | M00006966D:G03 | |
| M00004030A:E09 | M00004332B:D02 | M00006974B:D06 | |
| M00004031A:G05 | M00004332D:E11 | M00007013B:F02 | |
| M00004032D:D03 | M00004346D:D06 | M00007014C:C05 | |
| M00004033C:D10 | M00004389C:E01 | M00007014D:D04 | |
| M00004034A:E08 | M00004403A:B05 | M00007030A:G01 | |
| M00004035A:A10 | M00004407D:B09 | M00007030C:F08 | |
| M00004035B:H11 | M00004419D:G01 | M00007053B:C07 | |
| M00004035D:C05 | M00004449D:H01 | M00007065B:B12 | |
| M00004037B:A09 | M00004463C:F11 | M00007065D:C01 | |
| M00004037C:C05 | M00004466A:E09 | M00007075C:D08 | |
| M00004037D:B05 | M00004469A:C12 | M00007085A:B07 | |
| M00004044A:F08 | M00004470C:A02 | M00007118C:G02 | |
| M00004068A:F02 | M00004498B:E01 | M00007119B:H10 | |
| M00004068B:D04 | M00004509A:H02 | M00004824C:G09 | |
| M00004068D:B01 | M00004605C:A09 | M00004826A:E09 | |
| M00004069B:B01 | M00004609C:C11 | M00004839C:B01 | |
| M00004073D:E01 | M00001378B:F06 | M00004840C:F02 | |
| M00004075A:G10 | M00005294C:G08 | M00004840C:H05 | |
| M00004075C:C09 | M00005294D:H02 | M00004845D:E11 | |
| M00004076A:E02 | M00005330C:F09 | M00004846A:D02 | |
| M00004077D:D10 | M00005333C:C08 | M00004846D:H09 | |
| M00004078A:F03 | M00005342B:G10 | M00004854A:C09 | |
| M00004078C:A08 | M00005352C:G09 | M00004858D:E06 | |
| M00004084A:D11 | M00005352E:E06 | M00004999A:F01 | |
| M00004086A:A03 | M00005353B:B09 | M00004999B:D12 | |
| M00004086D:A07 | M00005359B:G01 | M00004999D:E01 | |
| M00004088A:F12 | M00005359D:H08 | M00005004B:C11 | |

TABLE 63-continued

| Library Deposits | | | |
|---|---|---|---|
| ES51 | ES52 | ES53 | ES54 |
| M00004089A:F02 | M00005377A:A04 | M00005005C:E06 | |
| M00004089A:G03 | M00005377A:D05 | M00005009B:A02 | |
| M00004093A:F03 | M00005385C:D08 | M00005015D:D11 | |
| M00004097C:A03 | M00005388A:F07 | M00005457D:C08 | |
| M00004102B:B04 | M00005388D:B11 | M00005519B:H04 | |
| M00004102C:F07 | M00005392C:C04 | M00005519C:F08 | |
| M00004103B:C09 | M00005393A:E11 | M00005531B:A03 | |
| M00004103C:F11 | M00005394A:G07 | M00005535B:F06 | |
| M00004104A:H09 | M00005396B:C04 | M00005587B:H02 | |
| M00004104D:C09 | M00005399B:F02 | M00005685A:A04 | |
| M00004108A:D04 | M00005400A:D02 | M00005706D:A09 | |
| M00004109B:A01 | M00005403D:E11 | M00005711A:H01 | |
| M00004126D:B11 | M00005406D:B08 | M00005798B:C11 | |
| M00004133C:B02 | M00005411D:E05 | M00005799C:C12 | |
| M00004182D:H03 | M00005415D:G02 | M00005805D:E06 | |
| M00004183A:D06 | M00005417C:E10 | M00005827B:H08 | |
| M00004186B:E05 | M00005419A:D05 | M00005828D:C09 | |
| M00004187C:H09 | M00005419C:D09 | M00005837A:D12 | |
| M00004188A:E05 | M00005443D:C12 | M00006751B:B11 | |
| M00004188A:E10 | M00005447B:D02 | M00006754B:D05 | |
| M00004190A:C12 | M00005448D:E08 | M00006756B:B08 | |
| M00004190C:G07 | M00005450A:A02 | M00006757B:E04 | |
| M00004190D:A10 | M00005450A:B10 | M00006758A:B12 | |
| M00004190D:G12 | M00005450D:D02 | M00006758D:C04 | |
| M00004198D:H04 | M00005451A:E03 | M00006834A:C08 | |
| M00004202B:F04 | M00005456B:B07 | M00006835B:F04 | |
| M00004202B:G09 | M00005456B:E03 | M00006837C:G06 | |
| M00004206C:G11 | M00005460A:B10 | M00006841D:A08 | |
| M00004213A:H12 | M00005465C:H02 | M00006855C:H02 | |
| M00004214A:D03 | M00005466A:F12 | M00006855D:H02 | |
| M00004218D:F12 | M00005468B:D04 | M00006859A:F06 | |
| M00004249C:E12 | M00005470B:E01 | M00006860B:H01 | |
| M00004249D:G02 | M00005473D:E10 | M00006886A:D06 | |
| M00004252D:A07 | M00005483A:F05 | M00006893C:B02 | |
| M00004253D:F09 | M00005483D:A02 | M00006893C:F02 | |
| M00004257C:A08 | M00005487A:H01 | M00006895D:E10 | |
| M00004262C:C01 | M00005489A:F06 | M00006917C:E07 | |
| M00001339B:E05 | M00005493B:A12 | M00006919B:C03 | |
| M00001341A:A11 | M00005493B:E01 | M00006923C:B01 | |
| M00001346A:B09 | M00005497C:C10 | M00006926A:H11 | |
| M00001346B:A07 | M00005505A:C08 | M00006934A:G02 | |
| M00001346B:G03 | M00005508A:H01 | M00006936B:E09 | |
| M00001346C:B07 | M00005510B:D06 | M00006936B:F10 | |
| M00001348A:G04 | M00005528D:H06 | M00006937B:F07 | |
| M00001348D:H08 | M00005534A:G06 | M00006937B:G09 | |
| M00001352C:E01 | M00005539D:G07 | M00006939B:E05 | |
| M00001362B:H09 | M00005571A:E11 | M00006953D:H11 | |
| M00001370A:B01 | M00005619C:H10 | M00006980A:F02 | |
| M00001370B:D04 | M00005625D:C03 | M00006986C:G11 | |
| M00001374C:C09 | M00005626A:B11 | M00006989C:C11 | |
| M00001376A:H02 | M00005635B:A06 | M00006990B:H09 | |
| M00001378B:F06 | M00005635C:F11 | M00006991A:E07 | |
| M00001380C:D10 | M00005636C:D11 | M00006991D:G07 | |
| M00001383C:C07 | M00005637D:C05 | M00006995C:A02 | |
| M00001384A:C09 | M00005641B:E02 | M00006997B:E06 | |
| M00001391D:A07 | M00005645C:F08 | M00006997D:B03 | |
| M00001391D:A09 | M00005646C:B09 | M00007006D:D04 | |
| M00001396C:G02 | M00005646D:B03 | M00007010B:C11 | |
| M00001397A:F10 | M00005655D:C04 | M00007010B:H03 | |
| M00001397B:E02 | M00005703C:B01 | M00007012B:D07 | |
| M00001397B:H11 | M00005720B:D09 | M00007031C:D01 | |
| M00001399D:F01 | M00005722A:E09 | M00007032A:F11 | |
| M00001400D:B08 | M00005762D:A01 | M00007033A:H05 | |
| M00001402C:E09 | M00005783A:C05 | M00007033D:F04 | |
| M00001406A:G12 | M00005812C:F10 | M00007036A:D02 | |
| M00001406D:B06 | M00006581C:D02 | M00007037B:D04 | |
| M00001408A:B02 | M00006581D:H08 | M00007084B:A05 | |
| M00001409C:D01 | M00006582A:B09 | M00007093A:F09 | |
| M00001411C:F02 | M00006582A:E05 | M00007099C:F09 | |
| M00001411D:C01 | M00006592A:D03 | M00007101A:A11 | |
| M00001412D:C03 | M00006594A:F09 | M00007107A:D11 | |
| M00001417B:C07 | M00006596A:F07 | M00007121C:H01 | |
| M00001417C:A09 | M00006601D:F04 | M00007129A:E04 | |
| M00001418A:C02 | M00006604C:H10 | M00007132B:B11 | |
| M00001421C:A03 | M00006607B:E03 | M00007134B:G07 | |
| M00001426A:C02 | M00006607B:F04 | M00007146D:G01 | |

TABLE 63-continued

| Library Deposits | | | |
|---|---|---|---|
| ES51 | ES52 | ES53 | ES54 |
| M00001427A:C05 | M00006615D:F04 | M00007148B:C06 | |
| M00001433A:F04 | M00006616C:H09 | M00007160C:B08 | |
| M00001434C:D05 | M00006616D:C08 | M00007161A:H03 | |
| M00001435C:H05 | M00006617B:D09 | M00007192C:H08 | |
| M00001438A:H10 | M00006619B:C11 | M00007200B:C02 | |
| M00001438B:H06 | | M00021619B:G10 | |

Example 41

Source of Biological Materials and Overview of Novel Polynucleotides Expressed by the Biological Materials cDNA libraries were constructed from either human colon cancer cell line Km12L4-A (Morikawa, et al., *Cancer Research* (1988) 48:6863), KM12C (Morikawa et al. *Cancer Res.* (1988) 48:1943-1948), or MDA-MB-231 (Brinkley et al. *Cancer Res.* (1980) 40:3118-3129) was used to construct a cDNA library from mRNA isolated from the cells. Sequences expressed by these cell lines were isolated and analyzed; most sequences were about 275-300 nucleotides in length. The KM12L4-A cell line is derived from the KM12C cell line. The KM12C cell line, which is poorly metastatic (low metastatic) was established in culture from a Dukes' stage $B_2$ surgical specimen (Morikawa et al. *Cancer Res.* (1988) 48:6863). The KML4-A is a highly metastatic subline derived from KM12C (Yeatman et al. *Nucl. Acids. Res.* (1995) 23:4007; Bao-Ling et al. *Proc. Annu. Meet. Am. Assoc. Cancer. Res.* (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res.* (1995) 1:19; Yeatman et al., (1995) supra; Yeatman et al. *Clin. Exp. Metastasis* (1996) 14:246). The MDA-MB-231 cell line was originally isolated from pleural effusions (Cailleau, *J. Natl. Cancer. Inst.* (1974) 53:661), is of high metastatic potential, and forms poorly differentiated adenocarcinoma grade II in nude mice consistent with breast carcinoma.

Example 42

Differential Expression of Polynucleotides of the Invention: Description of Libraries and Detection of Differential Expression The relative expression levels of various polynucleotides isolated from the Example 41 were assessed in several libraries prepared from various sources, including cell lines and patient tissue samples. Table 64 provides a summary of these libraries, including the shortened library name (used hereafter), the mRNA source used to prepared the cDNA library, the "nickname" of the library that is used in the tables below (in quotes), and the approximate number of clones in the library.

TABLE 64

Description of cDNA Libraries

| Library (lib #) | Description | No. of Clones in Library |
|---|---|---|
| 1 | Human Colon Cell Line Km12 L4: High Metastatic Potential (derived from Km12C) | 308731 |
| 2 | Human Colon Cell Line Km12C: Low Metastatic Potential | 284771 |
| 3 | Human Breast Cancer Cell Line MDA-MB-231: High Metastatic Potential; micro-metastases in lung | 326937 |
| 4 | Human Breast Cancer Cell Line MCF7: Non Metastatic | 318979 |
| 8 | Human Lung Cancer Cell Line MV-522: High Metastatic Potential | 223620 |
| 9 | Human Lung Cancer Cell Line UCP-3: Low Metastatic Potential | 312503 |
| 12 | Human microvascular endothelial cells (HMEC) - UNTREATED (PCR (OligodT) cDNA library) | 41938 |
| 13 | Human microvascular endothelial cells (HMEC) - bFGF TREATED (PCR (OligodT) cDNA library) | 42100 |
| 14 | Human microvascular endothelial cells (HMEC) - VEGF TREATED (PCR (OligodT) cDNA library) | 42825 |
| 15 | Normal Colon - UC#2 Patient (MICRODISSECTED PCR (OligodT) cDNA library) | 282722 |
| 16 | Colon Tumor - UC#2 Patient (MICRODISSECTED PCR (OligodT) cDNA library) | 298831 |
| 17 | Liver Metastasis from Colon Tumor of UC#2 Patient (MICRODISSECTED PCR (OligodT) cDNA library) | 303467 |
| 18 | Normal Colon - UC#3 Patient (MICRODISSECTED PCR (OligodT) cDNA library) | 36216 |
| 19 | Colon Tumor - UC#3 Patient (MICRODISSECTED PCR (OligodT) cDNA library) | 41388 |
| 20 | Liver Metastasis from Colon Tumor of UC#3 Patient (MICRODISSECTED PCR (OligodT) cDNA library) | 30956 |
| 21 | GRRpz Cells derived from normal prostate epithelium | 164801 |
| 22 | WOca Cells derived from Gleason Grade 4 prostate cancer epithelium | 162088 |

TABLE 64-continued

Description of cDNA Libraries

| Library (lib #) | Description | No. of Clones in Library |
|---|---|---|
| 23 | Normal Lung Epithelium of Patient #1006 (MICRODISSECTED PCR (OligodT) cDNA library) | 306198 |
| 24 | Primary tumor, Large Cell Carcinoma of Patient #1006 (MICRODISSECTED PCR (OligodT) cDNA library) | 309349 |

The KM12L4 and KM12C cell lines are described in Example 41 above. The MDA-MB-231 cell line was originally isolated from pleural effusions (Cailleau, J. Natl. Cancer. Inst. (1974) 53:661), is of high metastatic potential, and forms poorly differentiated adenocarcinoma grade II in nude mice consistent with breast carcinoma. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., Cancer Res. (1979) 39:870 (MDA-MB-231 and MCF-7); Gastpar et al., J Med Chem (1998) 41:4965 (MDA-MB-231 and MCF-7); Ranson et al., Br J Cancer (1998) 77:1586 (MDA-MB-231 and MCF-7); Kuang et al, Nucleic Acids Res (1998) 26:1116 (MDA-MB-231 and MCF-7); Varki et al., Int J Cancer (1987) 40:46 (UCP-3); Varki et al., Tumour Biol. (1990) 11:327; (MV-522 and UCP-3); Varki et al., Anticancer Res. (1990) 10:637; (MV-522); Kelner et al., Anticancer Res (1995) 15:867 (MV-522); and Zhang et al., Anticancer Drugs (1997) 8:696 (MV522)). The samples of libraries 15-20 are derived from two different patients (UC#2, and UC#3). The bFGF-treated HMEC were prepared by incubation with bFGF at 10 ng/ml for 2 hrs; the VEGF-treated HMEC were prepared by incubation with 20 ng/ml VEGF for 2 hrs. Following incubation with the respective growth factor, the cells were washed and lysis buffer added for RNA preparation. The GRRpz and WOca cell lines were provided by Dr. Donna M. Peehl, Department of Medicine, Stanford University School of Medicine. GRRpz was derived from normal prostate epithelium. The WOca cell line is a Gleason Grade 4 cell line.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., Genomics (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, Biostatistical Analysis, Prentice Hall, Inc., USA, "Differences between Proportions," pp 296-298 (1974).

Using the methods and libraries described above, 37 of the isolated polynucleotides were identified as being differentially expressed across multiple libraries. Table 65 provides a list of these polynucleotides and their corresponding sequence names. The sequences of each of the above-referenced polynucleotides were determined using methods well known in the art. The sequences of the 37 polynucleotides, assigned SEQ ID NOS:8804-8840, are provided in the Sequence Listing below.

TABLE 65

Polynucleotides corresponding to differentially expressed genes

| SEQ ID NO. | Sequence Name |
|---|---|
| 8804 | 13905 |
| 8805 | RTA00000281F.o.21.1 |
| 8806 | RTA00000348R.d.10.1 |
| 8807 | RTA00000177AF.d.22.3 |
| 8808 | RTA00000684F.e.07.1 |
| 8809 | RTA00000618F.p.24.1 |
| 8810 | RTA00000596F.d.12.1 |
| 8811 | RTA00000421F.d.20.1 |
| 8812 | 17090 |
| 8813 | RTA00000161A.1.7.1 |
| 8814 | RTA00000155A.k.14.1 |
| 8815 | RTA00000163A.e.10.1 |
| 8816 | RTA00000126A.o.15.2 |
| 8817 | 2546 |
| 8818 | RTA00000144A.p.8.1 |
| 8819 | RTA00000618F.k.16.1 |
| 8820 | RTA00000742F.o.19.1 |
| 8821 | RTA00000148A.o.18.1 |
| 8822 | RTA00000619F.d.02.1 |
| 8823 | RTA00000683F.1.19.1 |
| 8824 | RTA00000172A.d.9.3 |
| 8825 | RTA00000165A.d.16.1 |
| 8826 | RTA00000188AR.d.05.1 |
| 8827 | RTA00000183AF.n.14.1 |
| 8828 | RTA00000346F.g.11.1 |
| 8829 | RTA00000183AR.n.14.1 |
| 8830 | RTA00000742F.g.08.1 |
| 8831 | RTA00000689F.h.06.1 |
| 8832 | RTA00000185AF.b.9.1 |
| 8833 | RTA0000018SAF.b.9.2 |
| 8834 | RTA00000192AR.o.8.2 |
| 8835 | RTA00000192AF.o.8.1 |
| 8836 | RTA00000685F.j.16.1 |
| 8837 | RTA00000621F.i.13.2 |
| 8838 | RTA00000685F.1.23.1 |
| 8839 | 16405 |
| 8840 | 028035A |

The differential expression data for these sequences is provided below.

Example 43

Genes Differentially Expressed Genes in Non-Metastatic or Low Metastatic Potential Cancer Cells Versus High Metastatic Potential Cancer Cells The relative levels of expression of genes corresponding to SEQ ID NO:8804-8840 across various libraries described in Table 64 are summarized in Table 66 below.

TABLE 66

Genes Differentially Expressed Across Multiple Library Comparisons

| SEQ ID NO: | Cell or Tissue Sample and Cancer State Compared | RATIO |
|---|---|---|
| 8804 | Low Met Breast (lib4) > High Met Breast (lib3) | 5.38 |
| 8804 | Low Met Colon (lib2) > High Met Colon (lib1) | 6.14 |
| 8805 | Low Met Colon (lib2) > High Met Colon (lib1) | 3.56 |
| 8805 | Low Met Breast (lib4) > High Met Breast (lib3) | 2.73 |
| 8805 | Normal Prostate (lib21) > Prostate Cancer (lib 22) | 4.92 |
| 8806 | Low Met Colon (lib2) > High Met Colon (lib1) | 3.52 |
| 8806 | Low Met Breast (lib4) > High Met Breast (lib3) | 4.3 |
| 8807 | Low Met Colon (lib2) > High Met Colon (lib1) | 3.52 |
| 8807 | Low Met Breast (lib4) > High Met Breast (lib3) | 4.3 |
| 8808 | High Met Lung (lib8) > Low Met Lung (lib9) | 3.35 |
| 8808 | Low Met Colon (lib2) > High Met Colon (lib1) | 3.47 |
| 8808 | Low Met Breast (lib4) > High Met Breast (lib3) | 30.24 |
| 8809 | Low Met Breast (lib4) > High Met Breast (lib3) | 30.24 |
| 8809 | Low Met Colon (lib2) > High Met Colon (lib1) | 3.47 |
| 8809 | High Met Lung (lib8) > Low Met Lung (lib9) | 3.35 |
| 8810 | Low Met Colon (lib2) > High Met Colon (lib1) | 3.47 |
| 8810 | Low Met Breast (lib4) > High Met Breast (lib3) | 30.24 |
| 8810 | High Met Lung (lib8) > Low Met Lung (lib9) | 3.35 |
| 8811 | Low Met Breast (lib4) > High Met Breast (lib3) | 2.42 |
| 8811 | Low Met Colon (lib2) > High Met Colon (lib1) | 2.63 |
| 8812 | Low Met Colon (lib2) > High Met Colon (lib1) | 2.49 |
| 8812 | Low Met Breast (lib4) > High Met Breast (lib3) | 2.19 |
| 8812 | Low Met Lung (lib9) > High Met Lung (lib8) | 3.07 |
| 8813 | Low Met Breast (lib4) > High Met Breast (lib3) | 41 |
| 8813 | High Met Lung (lib8) > Low Met Lung (lib9) | 2.29 |
| 8814 | Low Met Breast (lib4) > High Met Breast (lib3) | 7.35 |
| 8814 | Normal Prostate (lib21) > Prostate Cancer (lib 22) | 9.84 |
| 8815 | High Met Breast (lib3) > Low Met Breast (lib4) | 6.41 |
| 8815 | High Met Colon (lib1) > Low Met Colon (lib2) | 2.39 |
| 8816 | High Met Colon (lib1) > Low Met Colon (lib2) | 2.05 |
| 8816 | High Met Breast (lib3) > Low Met Breast (lib4) | 9.76 |
| 8817 | Low Met Breast (lib4) > High Met Breast (lib3) | 4.54 |
| 8817 | High Met Lung (lib8) > Low Met Lung (lib9) | 10.48 |
| 8817 | Low Met Colon (lib2) > High Met Colon (lib1) | 8.31 |
| 8818 | Low Met Breast (lib4) > High Met Breast (lib3) | 2.05 |
| 8818 | Low Met Colon (lib2) > High Met Colon (lib1) | 7.05 |
| 8819 | Low Met Colon (lib2) > High Met Colon (lib1) | 4.34 |
| 8819 | Low Met Breast (lib4) > High Met Breast (lib3) | 6.75 |
| 8820 | Low Met Colon (lib2) > High Met Colon (lib1) | 4.34 |
| 8820 | Low Met Breast (lib4) > High Met Breast (lib3) | 6.75 |
| 8821 | Low Met Colon (lib2) > High Met Colon (lib1) | 3.98 |
| 8821 | Low Met Breast (lib4) > High Met Breast (lib3) | 3.31 |
| 8821 | Low Met Lung (lib9) > High Met Lung (lib8) | 2.5 |
| 8822 | Low Met Colon (lib2) > High Met Colon (lib1) | 3.56 |
| 8822 | Normal Prostate (lib21) > Prostate Cancer (lib 22) | 4.92 |
| 8822 | Low Met Breast (lib4) > High Met Breast (lib3) | 2.73 |
| 8823 | Normal Prostate (lib21) > Prostate Cancer (lib 22) | 4.92 |
| 8823 | Low Met Breast (lib4) > High Met Breast (lib3) | 2.73 |
| 8823 | Low Met Colon (lib2) > High Met Colon (lib1) | 3.56 |
| 8824 | Low Met Colon (lib2) > High Met Colon (lib1) | 3.56 |
| 8824 | Low Met Breast (lib4) > High Met Breast (lib3) | 2.73 |
| 8824 | Normal Prostate (lib21) > Prostate Cancer (lib 22) | 4.92 |
| 8825 | Low Met Colon (lib2) > High Met Colon (lib1) | 3.52 |
| 8825 | Low Met Breast (lib4) > High Met Breast (lib3) | 3.55 |
| 8825 | High Met Lung (lib8) > Low Met Lung (lib9) | 17.7 |
| 8826 | Low Met Colon (lib2) > High Met Colon (lib1) | 3.25 |
| 8826 | Low Met Breast (lib4) > High Met Breast (lib3) | 3.07 |
| 8827 | Low Met Breast (lib4) > High Met Breast (lib3) | 3.07 |
| 8827 | Low Met Colon (lib2) > High Met Colon (lib1) | 3.25 |
| 8828 | Low Met Colon (lib2) > High Met Colon (lib1) | 3.25 |
| 8828 | Low Met Breast (lib4) > High Met Breast (lib3) | 3.07 |
| 8829 | Low Met Colon (lib2) > High Met Colon (lib1) | 3.25 |
| 8829 | Low Met Breast (lib4) > High Met Breast (lib3) | 3.07 |
| 8830 | Low Met Colon (lib2) > High Met Colon (lib1) | 3.25 |
| 8830 | Low Met Breast (lib4) > High Met Breast (lib3) | 3.07 |
| 8831 | Low Met Colon (lib2) > High Met Colon (lib1) | 2.86 |
| 8831 | Low Met Breast (lib4) > High Met Breast (lib3) | 8.14 |
| 8832 | Low Met Colon (lib2) > High Met Colon (lib1) | 2.1 |
| 8832 | Low Met Breast (lib4) > High Met Breast (lib3) | 2.5 |
| 8833 | Low Met Colon (lib2) > High Met Colon (lib1) | 2.1 |
| 8833 | Low Met Breast (lib4) > High Met Breast (lib3) | 2.5 |
| 8834 | Low Met Colon (lib2) > High Met Colon (lib1) | 2.1 |
| 8834 | Low Met Breast (lib4) > High Met Breast (lib3) | 2.5 |
| 8835 | Low Met Colon (lib2) > High Met Colon (lib1) | 2.1 |
| 8835 | Low Met Breast (lib4) > High Met Breast (lib3) | 2.5 |
| 8836 | Low Met Colon (lib2) > High Met Colon (lib1) | 2.14 |
| 8836 | Low Met Breast (lib4) > High Met Breast (lib3) | 2.27 |
| 8837 | Normal Prostate (lib21) > Prostate Cancer (lib 22) | 5.9 |
| 8837 | Low Met Colon (lib2) > High Met Colon (lib1) | 2.1 |
| 8837 | Low Met Breast (lib4) > High Met Breast (lib3) | 2.18 |
| 8838 | Normal Prostate (lib21) > Prostate Cancer (lib 22) | 5.9 |
| 8838 | Low Met Colon (lib2) > High Met Colon (lib1) | 2.1 |
| 8838 | Low Met Breast (lib4) > High Met Breast (lib3) | 2.18 |
| 8839 | Low Met Colon (lib2) > High Met Colon (lib1) | 2.1 |
| 8839 | Low Met Breast (lib4) > High Met Breast (lib3) | 2.18 |
| 8839 | Normal Prostate (lib21) > Prostate Cancer (lib 22) | 5.9 |
| 8840 | Low Met Colon (lib2) > High Met Colon (lib1) | 2.17 |

TABLE 66-continued

Genes Differentially Expressed Across Multiple Library Comparisons

| SEQ ID NO: | Cell or Tissue Sample and Cancer State Compared | RATIO |
|---|---|---|
| 8840 | Low Met Breast (lib4) > High Met Breast (lib3) | 2.9 |
| 8840 | Low Met Lung (lib9) > High Met Lung (lib8) | 3.4 |

Key for Table 66:
High Met = high metastatic potential;
Low Met = low metastatic potential;
met = metastasized;
tumor = non-metastasized tumor The relative expression levels of the genes corresponding to the polynucleotides above can be exploited in diagnostic and prognostic assays. For example, where the polynucleotide corresponds to a gene that is expressed at a relatively higher level in a low metastatic potential cell relative to a high metastatic potential cell (or at a relatively higher level in normal cells or nonmetastasized tumor cells relatively to metastatic or high metastatic potential cancerous cells), expression of the gene can serve as a marker indicating low risk of metastasis and may encode a suppressor of metastasis. Where the polynucleotide corresponds to a gene expressed at a relatively higher level in a high metastatic potential cell relative to a low metastatic potential cell, expression of the gene can serve as a marker of metastatic potential, indicating the need for more aggressive therapy.

Example 44

Identification of a Gene and Protein Encoded by the Polynucleotide

SEQ ID NOS:8804-8840 were translated in all three reading frames, and the nucleotide sequences and translated amino acid sequences used as query sequences to search for homologous sequences in either the GenBank (nucleotide sequences) or Non-Redundant Protein (amino acid sequences) databases. Query and individual sequences were aligned using the BLAST 2.0 programs, available at the world wide web of the NCBI. (see also Altschul, et al. *Nucleic Acids Res.* (1997) 25:3389-3402). The sequences were masked to various extents to prevent searching of repetitive sequences or poly-A sequences, using the XBLAST program for masking low complexity.

The results are provided in Table 67 below.

TABLE 67

Results of search of publicly available sequence databases using SEQ ID NOS: 8804–8840 as query sequences

| SEQ ID NO: | Description |
|---|---|
| 8804 | yt88d06.r1 *Homo sapiens* cDNA clone 231371 5'. (EST Accession No. H56522) |
| 8805 | za04c10.r1 Soares melanocyte 2NbHM *Homo sapiens* cDNA clone 291570 5' (EST Accession No. W03386) |
| 8806 | *Homo sapiens* heat shock factor binding protein 1 HSBP1 mRNA, complete cds (GenBank Accession No. AF068754) |
| 8807 | *Homo sapiens* heat shock factor binding protein 1 HSBP1 mRNA, complete cds (GenBank Accession No. AF068754) |
| 8808 | *Homo sapiens* CGI-122 protein mRNA, complete cds (GenBank Accession No. AF151880.1) |
| 8809 | *Homo sapiens* CGI-122 protein mRNA, complete cds (GenBank Accession No. AF151880.1) |
| 8810 | *Homo sapiens* CGI-122 protein mRNA, complete cds (GenBank Accession No. AF151880.1) |
| 8811 | zn42b05.s1 Stratagene endothelial cell 937223 *Homo sapiens* cDNA clone 550065 3' similar to SW: RPC9__YEAST P28000 DNA-DIRECTED RNA POLYMERASES I AND III 16 KD POLYPEPTIDE (EST Accession No. AA102570) |
| 8812 | yv31g09.r1 Soares fetal liver spleen 1NFLS *Homo sapiens* cDNA clone 244384 5' similar to contains Alu repetitive element (EST Accession No. N72329) |
| 8813 | tz22h11.x1 NCI__CGAP__Ut2 *Homo sapiens* cDNA clone IMAGE: 2289381 3', mRNA sequence (EST Accession No. AI635233.1) |
| 8814 | zi02h12.r1 Soares fetal liver spleen 1NFLS S1 Homo sapines cDNA clone 429671 5' similar to contains Alu repetitive element (EST Accession No. AA011438) |
| 8815 | Human quiescin (Q6) mRNA |
| 8816 | Human Treacher Collins Syndrome |
| 8817 | Human mRNA for annexin IV (carbohydrate-binding protein p33/41) |
| 8818 | Human mRNA for TGIF protein |
| 8819 | Human MHC class I lymphocyte antigen (HLA-E) (HLA-6.2) |
| 8820 | Human HLA-E class I mRNA |
| 8821 | Human Mpv17 mRNA |
| 8822 | Human kidney cyclophilin C |
| 8823 | Human kidney cyclophilin C |
| 8824 | Human kidney cyclophilin C |
| 8825 | Human mRNA for 26S proteasome subunit p55 |
| 8826 | Human gamma-interferon-inducible protein (IP-30) mRNA |
| 8827 | Human gamma-interferon-inducible protein (IP-30) mRNA |
| 8828 | Human gamma-interferon-inducible protein (IP-30) mRNA |
| 8829 | Human gamma-interferon-inducible protein (IP-30) mRNA |
| 8830 | Human gamma-interferon-inducible protein (IP-30) mRNA |
| 8831 | Human Na+/H+ exchange regulatory co-factor (NHERF) mRNA |
| 8832 | Human mRNA for mitochondrial dodecenoyl-CoA delta-isomerase |
| 8833 | Human mRNA for mitochondrial dodecenoyl-CoA delta-isomerase |
| 8834 | Human mRNA for mitochondrial dodecenoyl-CoA delta-isomerase |
| 8835 | Human mRNA for mitochondrial dodecenoyl-CoA delta-isomerase |
| 8836 | Human (clone PSK-J3) cyclin-dependent protein kinase mRNA |
| 8837 | Human serine hydroxymethyltransferase mRNA |

TABLE 67-continued

Results of search of publicly available sequence databases using SEQ ID
NOS: 8804–8840 as query sequences

| SEQ ID NO: | Description |
|---|---|
| 8838 | Human serine hydroxymethyltransferase mRNA |
| 8839 | Human serine hydroxymethyltransferase mRNA |
| 8840 | Human DNA damage-inducible RNA binding protein (A18hnRNP). |

Key:
ES = EST database;
GB = GenBank database

SEQ ID NO:8804 corresponds to a cDNA clone generated from an EST isolated from human pineal gland (Hillier et al. Genome Res. (1996) 6(9):807-28).

SEQ ID NO:8805 corresponds to a sequence contained within a cDNA clone derived from an EST isolated from a human melanocyte 2NbHM.

SEQ ID NOS:8806 and 8807 correspond to a sequence encoding a human heat chock factor binding protein, HSBP-1, which acts as a negative regulator of the heat shock response through its interaction with heat shock factor 1 (HSF1) (Satyal et al. Genes Dev. (1998) 12(13):1962-74). Briefly, HSF-1 responds to stress by undergoing conformational transition from an inert non-DNA binding monomer to an active trimed that exhibits rapid DNA binding and activity as a transcriptional activator. Attenuation of the inducible transcriptional response, which occurs during heat shock or upon recovery at non-stress conditions, involves dissociation of the HSF1 trimer and loss of activity. HSBP-1, a nuclear-localized, conserved, 76-amino-acid protein, contains two extended arrays of hydrophobic repeats that interact with HSF-1 heptad repeats of the active trimeric state of HSF1. During attenuation of HSF1 to the inert monomer, HSBP1 also associates with Hsp70. Through its interaction with HSF-1, HSBP1 negatively affects HSF-1 DNA-binding activity.

SEQ ID NOS:8808-8810 correspond to a gene encoding human CGI-122 protein.

SEQ ID NO:8811 corresponds to a cDNA clone generated from an EST isolated from human endothelial cells (Hillier et al. Genome Res. (1996) 6(9):807-28).

SEQ ID NOS:8812 and 8814 correspond to a cDNA clone generated from an EST isolated human fetal liver and spleen (Hillier et al. Genome Res. (1996) 6(9):807-28).

SEQ ID NO:8813 corresponds to a sequence contained within a human cDNA clone isolated from moderately-differentiated endometrial adenocarcinoma.

The gene corresponding to SEQ ID NO:8816 encodes human quiescin Q6 (Coppoch et al., 1998, Proc. Amer. Assoc. Can. Res. 39:471).

The gene corresponding to SEQ ID NO:8817 encodes a human Treacher Collins Syndrome protein. Treacher Collins Syndrome (TCS) is an autosomal dominant disorder of craniofacial development including hearing loss and cleft palate. The TCS gene (called Treacle) has been positionally cloned and has 26 exons exhibiting a low complexity serine/alanine-rich protein of about 144 kDa (Dixon et al., 1997, Genome Res. 7:223-234). Thirty-five mutations in the gene are reported from studies of individuals and families affected by Treacher Collins Syndrome (Edwards et al., 1997, Am. J. Human Genet. 60:515-524. Mutation in Treacle generally results in premature termination of the predicted protein (Nat. Genet. 12:130-136, 1996).

The gene corresponding to SEQ ID NO: 8817 encodes human annexin IV (carbohydrate-binding protein p33/41).

Annexins are a family of Ca2+ and phospholipid binding proteins. Annexin IV binds to glycosaminoglycans (GAGs) in a calcium-dependent manner (Kojima et al., 1996, J. Biol. Chem. 271:7679-7685; Ishitsuka et al., 1998, J. Biol. Chem. 273:9935-9941; and Satoh et al., 1997, Biol. Pharm. Bull. 20:224-229). Annexin IV is highly expressed in various human adenocarcinoma cell lines (Satoh et al., 1997, FEBS Lett. 405:107-110), and calcium-induced relocation of annexin IV is observed in a human osteosarcoma cell line (Mohiti et al., 1995, Mol. Membr. Biol. 12:321-329).

The gene corresponding to SEQ ID NO: 8818 encodes human TGIF protein (Bertolino et al., 1995, J. Biol. Chem. 270:31178-31188).

The gene corresponding to SEQ ID NO:8819 encodes human MHC Class I lymphocyte antigen (HLA-E) (HLA-6.2), as described by Koller et al., 1988, J. Immunol. 141:897-904.

The gene corresponding to SEQ ID NO:8820 encodes human HLA-E class I mRNA, as described by Mizuno et al., 1988, J. Immunol. 140:4024-4030.

The gene corresponding to SEQ ID NO:8821 is the human glomerulosclerosis gene Mpv17, as described by Karasawa, 1993, Hum. Mol. Genet. 11:1829-1834.

The gene corresponding to any one or more of SEQ ID NOS:8822-8824 encodes a human cyclophilin C (Schneider et al., 1994, Biochemistry 33:8218-8224).

The gene corresponding to SEQ ID NO:8825 encodes human 26S proteasome subunit p55. Human 26S proteasome is a heterodimer of p44.5 and p55 (Saito et al., 1997, Gene 203:241-250) and plays a major role in the non-lysosomal degradation of intracellular proteins (Mason et al., 1998, FEBS Lett. 430:269-274). Homologues of 26S proteasome subunits are regulators of transcription and translation as described in Aravind and Ponting, 1998, Protein Sci. 7:1250-1254. Proteasomes are cylindrical particles made up of a stack of four heptameric rings (Rivett et al., 1997, Mol. Biol. Rep. 24:99-102) and 26S proteasome has stringent organization of ATPases, as described in Seeger et al., 1997, Mol. Biol. Rep. 24:83-88. In mammalian cells, the proteasome is a site for degradation of proteins, as described in Goldberg et al., 1997, Biol. Chem. 378:131-140. In addition, proteolytic processing involving 26S proteasome occurs in lesions of Alzheimer's Disease and dementia with Lewy bodies (Fergusson et al., 1996, Neurosci. Lett. 219:167-170).

The gene corresponding to any one or more of SEQ ID NOS:8826-8830 encodes human gamma-interferon-inducible protein (IP-30), Luster et al., 1988, J. Biol. Chem. 263:12036-12043.

The gene corresponding to SEQ ID NO:8831 encodes human $Na^+/H^+$ exchange regulatory co-factor (NHEFR) (Murphy et al., 1998, J. Biol. Chem. in press).

The gene corresponding to any one or more of SEQ ID NOS:8832-8835 encodes human mitochondrial dodecenoyl-CoA delta-isomerase.

The gene corresponding to SEQ ID NO:8836 encodes human (clone PSK-J3) cyclin-dependent protein kinase (Hanks, 1987, *Proc. Natl. Acad. Sci.* 84:388-392).

The gene corresponding to any one or more of SEQ ID NOS:8837-8839 encodes human serine hydroxymethyltransferase. Human serine hydroxymethyltransferase is a pyridoxine enzyme that is low in resting lymphocytes but increases upon antigenic or mitogenic stimuli, such as in an immune response (Trakatellis et al., 1997, *Postgrad. Med. J.* 73:617-622, and Trakatellis et al., 1994, *Postgrad. Med. J.* 70(Suppl 1):S89-S92). The catalytic function of the protein is tested as described in Kim et al., 1997, *Anal. Biochem.* 253:201-209.

The polynucleotide comprising SEQ ID NO:8840 corresponds to a GenBank entry having accession number AF021336, an mRNA complete coding sequence for human DNA damage-inducible RNA binding protein (A18hnRNP). The p value of $1.9^{-113}$ indicates an extremely high level of similarity between the sequence of SEQ ID NO: 8840 and the identified GenBank sequence. Likewise, the protein search identified a high level of similarity (p value of $2.4^{-63}$) between the amino acid translated from the second reading frame of the polynucleotide of SEQ ID NO: 8840 and the entry HUMCIRPA_1 for human mRNA for glycine-rich RNA binding protein cold-inducible RNA-binding protein (CIRP). The search of DBEST identified accession number AA166551, murine CIRP, with a p value of $5.8^{-115}$. CIRP is an 18 kD protein induced in mouse cells by mild cold stress and consists of an N-terminal RNA-binding domain and a C-terminal glycine-rich domain (Nishiyama et al., 1997, *J. Cell Biol.* 137(4):899). Lowering the culture temperature of BALB/3T3 cells from 37° C. to 32° C. induces CIRP expression and impairs cell growth. Suppression of CIRP with antisense oligonucleotides alleviates the impaired growth, while overexpression of CIRP impairs growth at 37° C. and prolongs the G1 phase of the cell cycle (Nishiyama et al., supra). The cloning and characterization of human CIRP was described by Nishiyama et al., 1997, *Gene* 204(1-2):115).

Deposit Information. The materials described in Table 68 were deposited with the American Type Culture Collection (CMCC=Chiron Master Culture Collection).

TABLE 68

Cell Lines Deposited with ATCC

| Cell Line | Deposit Date | ATCC Accession No. | CMCC Accession No. |
| --- | --- | --- | --- |
| KM12L4-A | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

The deposits described herein are provided merely as convenience to those of skill in the art, and is not an admission that a deposit is required under 35 U.S.C. §112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby Example 45

Source of Biological Materials and Overview of Novel Polynucleotides Expressed by the Biological Materials cDNA libraries were constructed from either human colon cancer cell line Km12L4-A (Morikawa, et al., *Cancer Research* (1988) 48:6863), KM12C (Morikawa et al. *Cancer Res*. (1988) 48:1943-1948), or MDA-MB-231 (Brinkley et al. *Cancer Res*. (1980) 40:3118-3129) was used to construct a cDNA library from mRNA isolated from the cells. Sequences expressed by these cell lines were isolated and analyzed; most sequences were about 275-300 nucleotides in length. The KM12L4-A cell line is derived from the KM12C cell line. The KM12C cell line, which is poorly metastatic (low metastatic) was established in culture from a Dukes' stage $B_2$ surgical specimen (Morikawa et al. *Cancer Res.* (1988) 48:6863). The KML4-A is a highly metastatic subline derived from KM12C (Yeatman et al. *Nucl. Acids. Res.* (1995) 23:4007; Bao-Ling et al. *Proc. Annu. Meet. Am. Assoc. Cancer. Res*. (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res*. (1995) 1:19; Yeatman et al., (1995) supra; Yeatman et al. *Clin. Exp. Metastasis* (1996) 14:246). The MDA-MB-231 cell line was originally isolated from pleural effusions (Cailleau, *J. Natl. Cancer. Inst*. (1974) 53:661), is of high metastatic potential, and forms poorly differentiated adenocarcinoma grade II in nude mice consistent with breast carcinoma.

The sequences of the isolated polynucleotides were first masked to eliminate low complexity sequences using the XBLAST masking program (Claverie "Effective Large-Scale Sequence Similarity Searches," In: *Computer Methods for Macromolecular Sequence Analysis*, Doolittle, ed., *Meth. Enzymol*. 266:212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem*. (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. Masking resulted in the elimination of 43 sequences. The remaining sequences were then used in a BLASTN vs. GenBank search; sequences that exhibited greater than 70% overlap, 99% identity, and a p value of less than $1 \times 10^{-40}$ were discarded. Sequences from this search also were discarded if the inclusive parameters were met, but the sequence was ribosomal or vector-derived.

The resulting sequences from the previous search were classified into three groups (1, 2 and 3 below) and searched in a BLASTX vs. NRP (non-redundant proteins) database search: (1) unknown (no hits in the GenBank search), (2) weak similarity (greater than 45% identity and p value of less than $1 \times 10^{-5}$), and (3) high similarity (greater than 60% overlap, greater than 80% identity, and p value less than $1 \times 10^{-5}$). Sequences having greater than 70% overlap, greater than 99% identity, and p value of less than $1 \times 10^{-40}$ were discarded.

The remaining sequences were classified as unknown (no hits), weak similarity, and high similarity (parameters as above). Two searches were performed on these sequences. First, a BLAST vs. EST database search was performed and sequences with greater than 99% overlap, greater than 99% similarity and a p value of less than $1 \times 10^{-40}$ were discarded. Sequences with a p value of less than $1 \times 10^{-65}$ when compared to a database sequence of human origin were also excluded. Second, a BLASTN vs. Patent GeneSeq database was performed and sequences having greater than 99% identity, p value less than $1 \times 10^{-40}$, and greater than 99% overlap were discarded.

The remaining sequences were subjected to screening using other rules and redundancies in the dataset. Sequences with a p value of less than $1\times10^{-111}$ in relation to a database sequence of human origin were specifically excluded. The final result provided the 982 sequences listed as SEQ ID NOS:8841-9785 in the accompanying Sequence Listing and summarized in Table 69A (inserted prior to claims). Each identified polynucleotide represents sequence from at least a partial mRNA transcript.

Table 69A provides: 1) the SEQ ID NO assigned to each sequence for use in the present specification; 2) the filing date of the U.S. priority application in which the sequence was first filed; 3) the attorney docket number assigned to the priority application (for internal use); 4) the SEQ ID NO assigned to the sequence in the priority application; 5) the sequence name used as an internal identifier of the sequence; and 6) the name assigned to the clone from which the sequence was isolated. Because the provided polynucleotides represent partial mRNA transcripts, two or more polynucleotides of the invention may represent different regions of the same mRNA transcript and the same gene. Thus, if two or more SEQ ID NOS: are identified as belonging to the same clone, then either sequence can be used to obtain the full-length mRNA or gene.

In order to confirm the sequences of SEQ ID NOS: 8841-9785, the clones were retrieved from a library using a robotic retrieval system, and the inserts of the retrieved clones re-sequenced. These "validation" sequences are provided as SEQ ID 9786:983-9799 in the Sequence Listing, and a summary of the "validation" sequences provided in Table 69B (inserted prior to claims). Table 69B provides: 1) the SEQ ID NO assigned to each sequence for use in the present specification; 2) the sample name assigned to the "validation" sequence obtained; and 3) the name of the clone that contains the indicated "validation" sequence. "Validation" sequences can be correlated with the original sequences they validate by referring to Table 69A. Because the "validation" sequences are often longer than the original polynucleotide sequences and thus provide additional sequence information. All validation sequences can be obtained either from the corresponding clone or from a cDNA library described herein (e.g., using primers designed from the sequence provided in the sequence listing).

TABLE 69A

| | | Priority Appln Information | | | |
|---|---|---|---|---|---|
| SEQ ID NO: | Filed | Dkt NO. | SEQ ID NO: | Sequence Name | Clone Name |
| 8841 | Sep. 28, 1998 | 1492.001 | 1 | RTA00000617F.o.18.2 | M00005513A:H01 |
| 8842 | Sep. 28, 1998 | 1492.001 | 2 | RTA00001075F.h.12.1 | M00005434A:F11 |
| 8843 | Sep. 28, 1998 | 1492.001 | 3 | RTA00001076F.m.09.1 | M00006946B:C08 |
| 8844 | Sep. 28, 1998 | 1492.001 | 4 | RTA00001075F.o.08.1 | M00005628D:A10 |
| 8845 | Sep. 28, 1998 | 1492.001 | 5 | RTA00001064F.f.14.1 | M00005465A:A07 |
| 8846 | Sep. 28, 1998 | 1492.001 | 6 | RTA00001075F.n.19.1 | M00005614A:B07 |
| 8847 | Sep. 28, 1998 | 1492.001 | 7 | RTA00001075F.i.24.1 | M00005453B:B06 |
| 8848 | Sep. 28, 1998 | 1492.001 | 8 | RTA00001075F.p.24.1 | M00005721D:B03 |
| 8849 | Sep. 28, 1998 | 1492.001 | 9 | RTA00001075F.o.04.1 | M00005621B:C09 |
| 8850 | Sep. 28, 1998 | 1492.001 | 10 | RTA00000616F.j.04.1 | M00005412D:G07 |
| 8851 | Sep. 28, 1998 | 1492.001 | 11 | RTA00001064F.k.01.1 | M00005708C:D11 |
| 8852 | Sep. 28, 1998 | 1492.001 | 12 | RTA00001064F.j.19.1 | M00005657B:F11 |
| 8853 | Sep. 28, 1998 | 1492.001 | 13 | RTA00001065F.a.22.1 | M00006920B:H07 |
| 8854 | Sep. 28, 1998 | 1492.001 | 14 | RTA00001076F.d.11.1 | M00006623C:G07 |
| 8855 | Sep. 28, 1998 | 1492.001 | 15 | RTA00000615F.e.08.2 | M00004872A:D07 |
| 8856 | Sep. 28, 1998 | 1492.001 | 16 | RTA00000617F.p.05.2 | M00005515D:G02 |
| 8857 | Sep. 28, 1998 | 1492.001 | 17 | RTA00001076F.f.03.1 | M00006668D:B10 |
| 8858 | Sep. 28, 1998 | 1492.001 | 18 | RTA00001064F.l.17.2 | M00006582A:F12 |
| 8859 | Sep. 28, 1998 | 1492.001 | 19 | RTA00001076F.h.13.1 | M00006745B:C05 |
| 8860 | Sep. 28, 1998 | 1492.001 | 20 | RTA00001075F.k.12.1 | M00005482A:D08 |
| 8861 | Sep. 28, 1998 | 1492.001 | 21 | RTA00001076F.c.09.1 | M00006594B:D05 |
| 8862 | Sep. 28, 1998 | 1492.001 | 22 | RTA00001076F.l.16.1 | M00006919A:H12 |
| 8863 | Sep. 28, 1998 | 1492.001 | 23 | RTA00001076F.b.13.1 | M00005825A:A10 |
| 8864 | Sep. 28, 1998 | 1492.001 | 24 | RTA00001065F.d.06.2 | M00007078B:H04 |
| 8865 | Sep. 28, 1998 | 1492.001 | 25 | RTA00001075F.p.23.1 | M00005721C:A12 |
| 8866 | Sep. 28, 1998 | 1492.001 | 26 | RTA00001075F.n.22.1 | M00005616B:E11 |
| 8867 | Sep. 28, 1998 | 1492.001 | 27 | RTA00001075F.o.21.1 | M00005648C:E10 |
| 8868 | Sep. 28, 1998 | 1492.001 | 28 | RTA00001065F.b.22.1 | M00006968A:H05 |
| 8869 | Sep. 28, 1998 | 1492.001 | 29 | RTA00001075F.p.06.1 | M00005698A:F12 |
| 8870 | Sep. 28, 1998 | 1492.001 | 30 | RTA00001076F.d.19.1 | M00006630A:E05 |
| 8871 | Sep. 28, 1998 | 1492.001 | 31 | RTA00001075F.e.14.1 | M00005375B:H03 |
| 8872 | Sep. 28, 1998 | 1492.001 | 32 | RTA00001065F.f.02.1 | M00007186A:A12 |
| 8873 | Sep. 28, 1998 | 1492.001 | 33 | RTA00001064F.p.03.1 | M00006814D:D09 |
| 8874 | Sep. 28, 1998 | 1492.001 | 34 | RTA00001076F.i.19.1 | M00006813B:E04 |
| 8875 | Sep. 28, 1998 | 1492.001 | 35 | RTA00001077F.c.06.1 | M00007157B:B04 |
| 8876 | Sep. 28, 1998 | 1492.001 | 36 | RTA00001064F.c.21.1 | M00005366D:E12 |
| 8877 | Sep. 28, 1998 | 1492.001 | 37 | RTA00001065F.e.21.1 | M00007177A:G07 |
| 8878 | Sep. 28, 1998 | 1492.001 | 38 | RTA00001076F.o.14.1 | M00007038D:D01 |
| 8879 | Sep. 28, 1998 | 1492.091 | 39 | RTA00001064F.c.01.1 | M00005327C:G08 |
| 8880 | Sep. 28, 1998 | 1492.001 | 40 | RTA00001064F.d.16.1 | M00005397A:G08 |
| 8881 | Sep. 28, 1998 | 1492.001 | 41 | RTA00000615F.e.05.2 | M00004870D:E05 |
| 8882 | Sep. 28, 1998 | 1492.001 | 42 | RTA00000616F.j.12.1 | M00005413D:G12 |
| 8883 | Sep. 28, 1998 | 1492.001 | 43 | RTA00001075F.a.17.1 | M00004852B:H08 |
| 8884 | Sep. 28, 1998 | 1492.001 | 44 | RTA00001076F.n.10.1 | M00006989C:B01 |
| 8885 | Sep. 28, 1998 | 1492.001 | 45 | RTA00001075F.l.04.1 | M00005505D:H08 |
| 8886 | Sep. 28, 1998 | 1492.001 | 46 | RTA00001075F.l.10.1 | M00005509B:E10 |
| 8887 | Sep. 28, 1998 | 1492.001 | 47 | RTA00001075F.i.09.1 | M00005444D:D01 |
| 8888 | Sep. 28, 1998 | 1492.001 | 48 | RTA00001075F.j.13.1 | M00005464B:B08 |

TABLE 69A-continued

| | | Priority Appln Information | | | |
|---|---|---|---|---|---|
| SEQ ID NO: | Filed | Dkt NO. | SEQ ID NO: | Sequence Name | Clone Name |
| 8889 | Sep. 28, 1998 | 1492.001 | 49 | RTA00001076F.e.03.1 | M00006635A:C01 |
| 8890 | Sep. 28, 1998 | 1492.001 | 50 | RTA00001076F.j.14.1 | M00006837B:H12 |
| 8891 | Sep. 28, 1998 | 1492.001 | 51 | RTA00001075F.g.19.1 | M00005418C:B09 |
| 8892 | Sep. 28, 1998 | 1492.001 | 52 | RTA0000I075F.m.05.1 | M00005538C:H11 |
| 8893 | Sep. 28, 1998 | 1492.001 | 53 | RTA00001076F.p.03.1 | M00007046D:E10 |
| 8894 | Sep. 28, 1998 | 1492.001 | 54 | RTA00001075F.h.19.1 | M00005435B:F01 |
| 8895 | Sep. 28, 1998 | 1492.001 | 55 | RTA00001075F.h.14.1 | M00005434C:E02 |
| 8896 | Sep. 28, 1998 | 1492.001 | 56 | RTA00001076F.l.14.1 | M00006917B:C05 |
| 8897 | Sep. 28, 1998 | 1492.001 | 57 | RTA00001075F.h.17.1 | M00005434D:H02 |
| 8898 | Sep. 28, 1998 | 1492.001 | 58 | RTA00001075F.f.18.1 | M00005396C:H04 |
| 8899 | Sep. 28, 1998 | 1492.001 | 59 | RTA00001076F.l.03.1 | M00006894D:A07 |
| 8900 | Sep. 28, 1998 | 1492.001 | 60 | RTA00001065F.d.07.2 | M00007079D:H01 |
| 8901 | Sep. 28, 1998 | 1492.001 | 61 | RTA00001075F.e.18.1 | M00005377C:F07 |
| 8902 | Sep. 28, 1998 | 1492.001 | 62 | RTA00001065F.d.03.2 | M00007065D:A03 |
| 8903 | Sep. 28, 1998 | 1492.001 | 63 | RTA00001076F.b.18.1 | M00006577A:B01 |
| 8904 | Sep. 28, 1998 | 1492.001 | 64 | RTA00001075F.m.16.1 | M00005569B:E04 |
| 8905 | Sep. 28, 1998 | 1492.001 | 65 | RTA00001076F.d.13.1 | M00006627C:C02 |
| 8906 | Sep. 28, 1998 | 1492.001 | 66 | RTA00001076F.i.16.1 | M00006805D:H12 |
| 8907 | Sep. 28, 1998 | 1492.001 | 67 | RTA00001076F.p.10.1 | M00007064B:E09 |
| 8908 | Sep. 28, 1998 | 1492.001 | 68 | RTA00001064F.p.14.1 | M00006835D:C08 |
| 8909 | Sep. 28, 1998 | 1492.001 | 69 | RTA00001077F.b.04.1 | M00007126D:H01 |
| 8910 | Sep. 28, 1998 | 1492.001 | 70 | RTA00001076F.d.04.1 | M00006619A:G11 |
| 8911 | Sep. 28, 1998 | 1492.001 | 71 | RTA00001077F.a.22.1 | M00007121D:A11 |
| 8912 | Sep. 28, 1998 | 1492.001 | 72 | RTA00001077F.c.19.1 | M00007178D:A10 |
| 8913 | Sep. 28, 1998 | 1492.001 | 73 | RTA00001065F.f.06.1 | M00007197D:D12 |
| 8914 | Sep. 28, 1998 | 1492.001 | 74 | RTA00000616F.f.11.3 | M00005395D:D11 |
| 8915 | Sep. 28, 1998 | 1492.001 | 75 | RTA00001064F.l.13.2 | M00006577B:F01 |
| 8916 | Sep. 28, 1998 | 1492.001 | 76 | RTA00001064F.o.08.1 | M00006757D:H04 |
| 8917 | Sep. 28, 1998 | 1492.001 | 77 | RTA00001075F.o.03.1 | M00005621A:B05 |
| 8918 | Sep. 28, 1998 | 1492.001 | 78 | RTA00001064F.l.23.2 | M00006596D:H02 |
| 8919 | Sep. 28, 1998 | 1492.001 | 79 | RTA00001076F.e.01.1 | M00006631D:G09 |
| 8920 | Sep. 28, 1998 | 1492.001 | 80 | RTA00001075F.j.22.1 | M00005473C:F02 |
| 8921 | Sep. 28, 1998 | 1492.001 | 81 | RTA00001076F.h.16.1 | M00006757A:C09 |
| 8922 | Sep. 28, 1998 | 1492.001 | 82 | RTA00001075F.j.08.1 | M00005459B:A01 |
| 8923 | Sep. 28, 1998 | 1492.001 | 83 | RTA00001064F.o.19.1 | M00006795C:B12 |
| 8924 | Sep. 28, 1998 | 1492.001 | 84 | RTA00001064F.o.07.1 | M00006756D:G07 |
| 8925 | Sep. 28, 1998 | 1492.001 | 85 | RTA00001076F.i.09.1 | M00006790D:F10 |
| 8926 | Sep. 28, 1998 | 1492.001 | 86 | RTA00001076F.i.22.1 | M00006815D:D11 |
| 8927 | Sep. 28, 1998 | 1492.001 | 87 | RTA00001076F.c.21.1 | M00006613C:C02 |
| 8928 | Sep. 28, 1998 | 1492.001 | 88 | RTA00001076F.j.19.1 | M00006846A:B03 |
| 8929 | Sep. 28, 1998 | 1492.001 | 89 | RTA00001064F.o.13.1 | M00006779D:F03 |
| 8930 | Sep. 28, 1998 | 1492.001 | 90 | RTA00001077F.a.06.1 | M00007101C:H01 |
| 8931 | Sep. 28, 1998 | 1492.001 | 91 | RTA00001064F.n.01.1 | M00006664A:C05 |
| 8932 | Sep. 28, 1998 | 1492.001 | 92 | RTA00001064F.c.12.1 | M00005358A:H03 |
| 8933 | Sep. 28, 1998 | 1492.001 | 93 | RTA00001077F.d.07.1 | M00007196D:D02 |
| 8934 | Sep. 28, 1998 | 1492.001 | 94 | RTA00001077F.c.18.1 | M00007177B:C02 |
| 8935 | Sep. 28, 1998 | 1492.001 | 95 | RTA00001064F.g.12.1 | M00005490B:B02 |
| 8936 | Sep. 28, 1998 | 1492.001 | 96 | RTA00001075F.b.07.1 | M00004866C:H08 |
| 8937 | Sep. 28, 1998 | 1492.001 | 97 | RTA00000617F.p.03.2 | M00005515B:B08 |
| 8938 | Sep. 28, 1998 | 1492.001 | 98 | RTA00000616F.f.10.3 | M00005395D:B12 |
| 8939 | Sep. 28, 1998 | 1492.001 | 99 | RTA00001064F.p.15.1 | M00006840A:A12 |
| 8940 | Sep. 28, 1998 | 1492.001 | 100 | RTA00000617F.p.10.2 | M00005516D:F12 |
| 8941 | Sep. 28, 1998 | 1492.001 | 101 | RTA00001076F.m.01.1 | M00006925B:B02 |
| 8942 | Sep. 28, 1998 | 1492.001 | 102 | RTA00001075F.f.15.1 | M00005395C:C11 |
| 8943 | Sep. 28, 1998 | 1492.001 | 103 | RTA00001075F.e.23.1 | M00005385A:A10 |
| 8944 | Sep. 28, 1998 | 1492.001 | 104 | RTA00001076F.f.12.1 | M00006688C:C12 |
| 8945 | Sep. 28, 1998 | 1492.001 | 105 | RTA00001075F.g.21.1 | M00005420C:E03 |
| 8946 | Sep. 28, 1998 | 1492.001 | 106 | RTA00001075F.g.18.1 | M00006727A:H12 |
| 8947 | Sep. 28, 1998 | 1492.001 | 107 | RTA00001075F.d.24.1 | M00005363D:C05 |
| 8948 | Sep. 28, 1998 | 1492.001 | 108 | RTA00001075F.e.02.1 | M00005364C:A02 |
| 8949 | Sep. 28, 1998 | 1492.001 | 109 | RTA00001075F.m.14.1 | M00005563C:D05 |
| 8950 | Sep. 28, 1998 | 1492.001 | 110 | RTA00001064F.h.07.1 | M00005520A:H11 |
| 8951 | Sep. 28, 1998 | 1492.001 | 111 | RTA00001065F.b.07.1 | M00006936C:G11 |
| 8952 | Sep. 28, 1998 | 1492.001 | 112 | RTA00001065F.b.23.1 | M00006968D:H02 |
| 8953 | Sep. 28, 1998 | 1492.001 | 113 | RTA00001064F.g.15.1 | M00005497C:G08 |
| 8954 | Sep. 28, 1998 | 1492.001 | 114 | RTA00001064F.d.14.1 | M00005390C:E05 |
| 8955 | Sep. 28, 1998 | 1492.001 | 115 | RTA00001064F.l.22.2 | M00006595C:B08 |
| 8956 | Sep. 28, 1998 | 1492.001 | 116 | RTA00001064F.p.04.1 | M00006816D:D08 |
| 8957 | Sep. 28, 1998 | 1492.001 | 117 | RTA00001076F.g.04.1 | M00006712A:F01 |
| 8958 | Sep. 28, 1998 | 1492.001 | 118 | RTA00001075F.p.17.1 | M00005709D:H05 |
| 8959 | Sep. 28, 1998 | 1492.001 | 119 | RTA00001075F.l.03.1 | M00005505B:D10 |
| 8960 | Sep. 28, 1998 | 1492.001 | 120 | RTA00001076F.l.23.1 | M00006925B:B09 |
| 8961 | Sep. 28, 1998 | 1492.001 | 121 | RTA00001076F.k.11.1 | M00006874D:E01 |
| 8962 | Sep. 28, 1998 | 1492.001 | 122 | RTA00001076F.n.15.1 | M00006994A:C12 |
| 8963 | Sep. 28, 1998 | 1492.001 | 123 | RTA00001075F.o.10.1 | M00005629B:G06 |

TABLE 69A-continued

Priority Appln Information

| SEQ ID NO: | Filed | Dkt NO. | SEQ ID NO: | Sequence Name | Clone Name |
|---|---|---|---|---|---|
| 8964 | Sep. 28, 1998 | 1492.001 | 124 | RTA00001075F.n.04.1 | M00005589B:H12 |
| 8965 | Sep. 28, 1998 | 1492.001 | 125 | RTA00001075F.f.06.1 | M00005388B:B02 |
| 8966 | Sep. 28, 1998 | 1492.001 | 126 | RTA00001076F.j.05.1 | M00006823A:H06 |
| 8967 | Sep. 28, 1998 | 1492.001 | 127 | RTA00001076F.o.18.1 | M00007041C:C05 |
| 8968 | Sep. 28, 1998 | 1492.001 | 128 | RTA00001064F.j.14.1 | M00005648C:C11 |
| 8969 | Sep. 28, 1998 | 1492.001 | 129 | RTA00001064F.d.06.1 | M00005376B:E08 |
| 8970 | Sep. 28, 1998 | 1492.001 | 130 | RTA00001077F.d.10.1 | M00007200A:B12 |
| 8971 | Sep. 28, 1998 | 1492.001 | 131 | RTA00001065F.d.19.1 | M00007109D:G01 |
| 8972 | Sep. 28, 1998 | 1492.001 | 132 | RTA00001064F.f.13.1 | M00005464D:D07 |
| 8973 | Sep. 28, 1998 | 1492.001 | 133 | RTA00001075F.k.20.1 | M00005493D:H12 |
| 8974 | Sep. 28, 1998 | 1492.001 | 134 | RTA00001075F.k.07.1 | M00005479C:A05 |
| 8975 | Sep. 28, 1998 | 1492.001 | 135 | RTA00001075F.a.14.1 | M00004847D:G01 |
| 8976 | Sep. 28, 1998 | 1492.001 | 136 | RTA00001076F.f.22.1 | M00006704A:C11 |
| 8977 | Sep. 28, 1998 | 1492.001 | 137 | RTA00001076F.m.11.1 | M00006949B:C07 |
| 8978 | Sep. 28, 1998 | 1492.001 | 138 | RTA00001064F.i.13.2 | M00005618C:H11 |
| 8979 | Sep. 28, 1998 | 1492.001 | 139 | RTA00001076F.f.19.3 | M00006694D:G06 |
| 8980 | Sep. 28, 1998 | 1492.001 | 140 | RTA00001076F.c.23.1 | M00006617A:A06 |
| 8981 | Sep. 28, 1998 | 1492.001 | 141 | RTA00001077F.a.09.1 | M00007107C:D02 |
| 8982 | Sep. 28, 1998 | 1492.001 | 142 | RTA00001064F.b.14.1 | M00005020B:D10 |
| 8983 | Sep. 28, 1998 | 1492.001 | 143 | RTA00001075F.e.21.1 | M00005382A:G09 |
| 8984 | Sep. 28, 1998 | 1492.001 | 144 | RTA00001075F.p.15.1 | M00005705D:G09 |
| 8985 | Sep. 28, 1998 | 1492.001 | 145 | RTA00001076F.n.11.1 | M00006991B:E05 |
| 8986 | Sep. 28, 1998 | 1492.001 | 146 | RTA00001065F.e.18.1 | M00007161C:D12 |
| 8987 | Sep. 28, 1998 | 1492.001 | 147 | RTA00000615F.e.06.2 | M00004871C:C04 |
| 8988 | Sep. 28, 1998 | 1492.001 | 148 | RTA00001064F.a.04.2 | M00004821D:C03 |
| 8989 | Sep. 28, 1998 | 1492.001 | 149 | RTA00001075F.j.18.1 | M00005469A:D10 |
| 8990 | Sep. 28, 1998 | 1492.001 | 150 | RTA00001077F.c.05.1 | M00007156D:E11 |
| 8991 | Sep. 28, 1998 | 1492.001 | 151 | RTA00001075F.g.22.1 | M00005420C:E10 |
| 8992 | Sep. 28, 1998 | 1492.001 | 152 | RTA00001077F.a.08.1 | M00007104D:D10 |
| 8993 | Sep. 28, 1998 | 1492.001 | 153 | RTA00001077F.c.15.1 | M00007172C:H03 |
| 8994 | Sep. 28, 1998 | 1492.001 | 154 | RTA00001077F.c.16.1 | M00007175B:B11 |
| 8995 | Sep. 28, 1998 | 1492.001 | 155 | RTA00001077F.b.15.1 | M00007141A:G08 |
| 8996 | Sep. 28, 1998 | 1492.001 | 156 | RTA00001077F.c.17.1 | M00007175D:G02 |
| 8997 | Sep. 28, 1998 | 1492.001 | 157 | RTA00001077F.a.14.1 | M00007116A:C08 |
| 8998 | Sep. 28, 1998 | 1492.001 | 158 | RTA00001075F.i.02.1 | M00005438D:A08 |
| 8999 | Sep. 28, 1998 | 1492.001 | 159 | RTA00001075F.l.11.1 | M00005509D:G05 |
| 9000 | Sep. 28, 1998 | 1492.001 | 160 | RTA00001064F.d.20.1 | M00005403A:D12 |
| 9001 | Sep. 28, 1998 | 1492.001 | 161 | RTA00001076F.h.10.1 | M00006740A:A06 |
| 9002 | Sep. 28, 1998 | 1492.001 | 162 | RTA00001075F.k.21.1 | M00005494C:F08 |
| 9003 | Sep. 28, 1998 | 1492.001 | 163 | RTA00001075F.i.21.1 | M00005450C:G09 |
| 9004 | Sep. 28, 1998 | 1492.001 | 164 | RTA00001076F.p.24.1 | M00007093C:C11 |
| 9005 | Sep. 28, 1998 | 1492.001 | 165 | RTA00001075F.f.03.1 | M00005385D:B08 |
| 9006 | Sep. 28, 1998 | 1492.001 | 166 | RTA00001065F.d.18.2 | M00007107C:H08 |
| 9007 | Sep. 28, 1998 | 1492.001 | 167 | RTA00001076F.o.05.1 | M00007026A:A03 |
| 9008 | Sep. 28, 1998 | 1492.001 | 168 | RTA00001075F.d.10.1 | M00005353C:H01 |
| 9009 | Sep. 28, 1998 | 1492.001 | 169 | RTA00001064F.d.07.1 | M00005378B:B04 |
| 9010 | Sep. 28, 1998 | 1492.001 | 170 | RTA00001065F.b.11.1 | M00006945D:A07 |
| 9011 | Sep. 28, 1998 | 1492.001 | 171 | RTA00001076F.g.17.1 | M00006726D:H10 |
| 9012 | Sep. 28, 1998 | 1492.001 | 172 | RTA00001065F.a.21.1 | M00006918D:G08 |
| 9013 | Sep. 28, 1998 | 1492.001 | 173 | RTA00001077F.d.12.1 | M00007203C:E06 |
| 9014 | Sep. 28, 1998 | 1492.001 | 174 | RTA00001064F.g.08.1 | M00005481C:H05 |
| 9015 | Sep. 28, 1998 | 1492.001 | 175 | RTA00001064F.f.02.1 | M00005449D:D04 |
| 9016 | Sep. 28, 1998 | 1492.001 | 176 | RTA00001075F.a.02.1 | M00004825A:G12 |
| 9017 | Sep. 28, 1998 | 1492.001 | 177 | RTA00001064F.b.16.1 | M00005296B:H07 |
| 9018 | Sep. 28, 1998 | 1492.001 | 178 | RTA00001077F.c.02.1 | M00007152A:A10 |
| 9019 | Sep. 28, 1998 | 1492.001 | 179 | RTA00001064F.g.04.1 | M00005480C:A04 |
| 9020 | Sep. 28, 1998 | 1492.001 | 180 | RTA00001075F.c.12.1 | M00005305A:H01 |
| 9021 | Sep. 28, 1998 | 1492.001 | 181 | RTA00001064F.o.04.1 | M00006752C:D04 |
| 9022 | Sep. 28, 1998 | 1492.001 | 182 | RTA00001077F.a.21.1 | M00007121A:G04 |
| 9023 | Sep. 28, 1998 | 1492.001 | 183 | RTA00001075F.f.11.1 | M00005392C:B03 |
| 9024 | Sep. 28, 1998 | 1492.001 | 184 | RTA00001064F.k.24.2 | M00005820A:H11 |
| 9025 | Sep. 28, 1998 | 1492.001 | 185 | RTA00001075F.d.02.1 | M00005342D:E04 |
| 9026 | Sep. 28, 1998 | 1492.001 | 186 | RTA00001076F.c.13.1 | M00006600D:G07 |
| 9027 | Sep. 28, 1998 | 1492.001 | 187 | RTA00001075F.b.15.1 | M00004872C:G03 |
| 9028 | Sep. 28, 1998 | 1492.001 | 188 | RTA00001064F.f.09.1 | M00005461C:D11 |
| 9029 | Sep. 28, 1998 | 1492.001 | 189 | RTA00001075F.g.14.1 | M00005416B:A01 |
| 9030 | Sep. 28, 1998 | 1492.001 | 190 | RTA00001075F.f.17.1 | M00005396A:C01 |
| 9031 | Sep. 28, 1998 | 1492.001 | 191 | RTA00001076F.l.05.1 | M00006895D:A02 |
| 9032 | Sep. 28, 1998 | 1492.001 | 192 | RTA00001076F.o.02.1 | M00007019B:G01 |
| 9033 | Sep. 28, 1998 | 1492.001 | 193 | RTA00001064F.b.07.1 | M00005000A:H05 |
| 9034 | Sep. 28, 1998 | 1492.001 | 194 | RTA00001075F.d.17.1 | M00005358B:D10 |
| 9035 | Sep. 28, 1998 | 1492.001 | 195 | RTA00000624F.f.12.2 | M00005607A:C08 |
| 9036 | Sep. 28, 1998 | 1492.001 | 196 | RTA00001075F.c.22.1 | M00005342B:G01 |
| 9037 | Sep. 28, 1998 | 1492.001 | 197 | RTA00001065F.a.17.1 | M00006914C:D07 |
| 9038 | Sep. 28, 1998 | 1492.001 | 198 | RTA00001075F.b.02.1 | M00004859D:D01 |

TABLE 69A-continued

| | | | Priority Appln Information | | |
|---|---|---|---|---|---|
| SEQ ID NO: | Filed | Dkt NO. | SEQ ID NO: | Sequence Name | Clone Name |
| 9039 | Sep. 28, 1998 | 1492.001 | 199 | RTA00001077F.c.12.1 | M00007167C:B10 |
| 9040 | Sep. 28, 1998 | 1492.001 | 200 | RTA00001077F.c.20.1 | M00007179B:H04 |
| 9041 | Sep. 28, 1998 | 1492.001 | 201 | RTA00001076F.m.04.1 | M00006934B:B11 |
| 9042 | Sep. 28, 1998 | 1492.001 | 202 | RTA00001076F.j.22.1 | M00006859D:E11 |
| 9043 | Sep. 28, 1998 | 1492.001 | 203 | RTA00001076F.k.13.1 | M00006882C:D03 |
| 9044 | Sep. 28, 1998 | 1492.001 | 204 | RTA00001075F.k.14.1 | M00005485C:F09 |
| 9045 | Sep. 28, 1998 | 1492.001 | 205 | RTA00001076F.f.10.1 | M00006680D:A01 |
| 9046 | Sep. 28, 1998 | 1492.001 | 206 | RTA00001064F.o.05.1 | M00006755C:C03 |
| 9047 | Sep. 28, 1998 | 1492.001 | 207 | RTA00001064F.l.05.2 | M00005826B:F10 |
| 9048 | Sep. 28, 1998 | 1492.001 | 208 | RTA00001076F.p.04.1 | M00007047D:C02 |
| 9049 | Sep. 28, 1998 | 1492.001 | 209 | RTA00001064F.l.04.1 | M00005822D:C05 |
| 9050 | Sep. 28, 1998 | 1492.001 | 210 | RTA00001076F.c.03.1 | M00006584D:D01 |
| 9051 | Sep. 28, 1998 | 1492.001 | 211 | RTA00001064F.m.06.1 | M00006621B:B06 |
| 9052 | Sep. 28, 1998 | 1492.001 | 212 | RTA00001075F.k.15.1 | M00005486A:F07 |
| 9053 | Sep. 28, 1998 | 1492.001 | 213 | RTA00001064F.d.08.1 | M00005378C:B12 |
| 9054 | Sep. 28, 1998 | 1492.001 | 214 | RTA00001077F.d.11.1 | M00007202A:A09 |
| 9055 | Sep. 28, 1998 | 1492.001 | 215 | RTA00001077F.b.14.1 | M00007140C:G12 |
| 9056 | Sep. 28, 1998 | 1492.001 | 216 | RTA00001075F.k.04.1 | M00005476D:A11 |
| 9057 | Sep. 28, 1998 | 1492.001 | 217 | RTA00001064F.n.03.1 | M00006678C:B07 |
| 9058 | Sep. 28, 1998 | 1492.001 | 218 | RTA00001075F.i.12.1 | M00005446B:D10 |
| 9059 | Sep. 28, 1998 | 1492.001 | 219 | RTA00001075F.f.04.1 | M00005386C:G01 |
| 9060 | Sep. 28, 1998 | 1492.001 | 220 | RTA00001076F.n.14.1 | M00006993B:F02 |
| 9061 | Sep. 28, 1998 | 1492.001 | 221 | RTA00001064F.k.19.2 | M00005810B:C07 |
| 9062 | Sep. 28, 1998 | 1492.001 | 222 | RTA00001076F.d.20.1 | M00006630A:E09 |
| 9063 | Sep. 28, 1998 | 1492.001 | 223 | RTA00001077F.b.20.1 | M00007145C:B05 |
| 9064 | Sep. 28, 1998 | 1492.001 | 224 | RTA00001076F.f.11.1 | M00006688A:F09 |
| 9065 | Sep. 28, 1998 | 1492.001 | 225 | RTA00001065F.d.01.1 | M00007047C:H04 |
| 9066 | Sep. 28, 1998 | 1492.001 | 226 | RTA00001075F.g.12.1 | M00005413B:B02 |
| 9067 | Sep. 28, 1998 | 1492.001 | 227 | RTA00001064F.a.09.2 | M00004841C:H03 |
| 9068 | Sep. 28, 1998 | 1492.001 | 228 | RTA00001064F.k.20.2 | M00005810B:G02 |
| 9069 | Sep. 28, 1998 | 1492.001 | 229 | RTA00001064F.b.17.1 | M00005296D:G03 |
| 9070 | Sep. 28, 1998 | 1493.001 | 1 | RTA00001073F.f.17.1 | M00004087A:H06 |
| 9071 | Sep. 28, 1998 | 1493.001 | 2 | RTA00001073F.l.02.1 | M00004168D:F05 |
| 9072 | Sep. 28, 1998 | 1493.001 | 3 | RTA00001072F.i.07.3 | M00003845B:A04 |
| 9073 | Sep. 28, 1998 | 1493.001 | 4 | RTA00001071F.i.23.3 | M00001477A:G02 |
| 9074 | Sep. 28, 1998 | 1493.001 | 5 | RTA00000611F.e.04.2 | M00004170C:H06 |
| 9075 | Sep. 28, 1998 | 1493.001 | 6 | RTA00001062F.f.19.1 | M00003888C:G08 |
| 9076 | Sep. 28, 1998 | 1493.001 | 7 | RTA00001073F.l.22.1 | M00004176B:H09 |
| 9077 | Sep. 28, 1998 | 1493.001 | 8 | RTA00001063F.l.10.1 | M00004410B:F06 |
| 9078 | Sep. 28, 1998 | 1493.001 | 9 | RTA00001062F.l.13.1 | M00004034A:A05 |
| 9079 | Sep. 28, 1998 | 1493.001 | 10 | RTA00001074F.l.10.1 | M00004495D:A05 |
| 9080 | Sep. 28, 1998 | 1493.001 | 11 | RTA00001061F.d.01.1 | M00001389C:E01 |
| 9081 | Sep. 28, 1998 | 1493.001 | 12 | RTA00001072F.j.04.2 | M00003861D:G10 |
| 9082 | Sep. 28, 1998 | 1493.001 | 13 | RTA00001073F.d.04.1 | M00004048C:C02 |
| 9083 | Sep. 28, 1998 | 1493.001 | 14 | RTA00001061F.j.09.1 | M00001507A:H06 |
| 9084 | Sep. 28, 1998 | 1493.001 | 15 | RTA00001071F.h.16.1 | M00001450D:H12 |
| 9085 | Sep. 28, 1998 | 1493.001 | 16 | RTA00001062F.o.17.1 | M00004108B:D04 |
| 9086 | Sep. 28, 1998 | 1493.001 | 17 | RTA00001073F.c.20.1 | M00004046C:A04 |
| 9087 | Sep. 28, 1998 | 1493.001 | 18 | RTA00001063F.k.14.1 | M00004381A:E10 |
| 9088 | Sep. 28, 1998 | 1493.001 | 19 | RTA00000611F.e.18.2 | M00004171D:H10 |
| 9089 | Sep. 28, 1998 | 1493.001 | 20 | RTA00001072F.a.18.2 | M00001655C:F07 |
| 9090 | Sep. 28, 1998 | 1493.001 | 21 | RTA00001072F.b.04.2 | M00001660A:B10 |
| 9091 | Sep. 28, 1998 | 1493.001 | 22 | RTA00001074F.g.19.1 | M00004372A:A08 |
| 9092 | Sep. 28, 1998 | 1493.001 | 23 | RTA00001072F.i.09.3 | M00003845C:F08 |
| 9093 | Sep. 28, 1998 | 1493.001 | 24 | RTA00001072F.a.21.2 | M00001657D:D07 |
| 9094 | Sep. 28, 1998 | 1493.001 | 25 | RTA00001072F.m.18.3 | M00003916D:A10 |
| 9095 | Sep. 28, 1998 | 1493.001 | 26 | RTA00001061F.b.04.1 | M00001360B:F09 |
| 9096 | Sep. 28, 1998 | 1493.001 | 27 | RTA00001072F.o.06.2 | M00003935A:C04 |
| 9097 | Sep. 28, 1998 | 1493.001 | 28 | RTA00001072F.n.19.3 | M00003931A:G01 |
| 9098 | Sep. 28, 1998 | 1493.001 | 29 | RTA00001073F.e.08.1 | M00004068A:A03 |
| 9099 | Sep. 28, 1998 | 1493.001 | 30 | RTA00001074F.g.22.1 | M00004373D:G10 |
| 9100 | Sep. 28, 1998 | 1493.001 | 31 | RTA00001073F.c.01.1 | M00004030C:E05 |
| 9101 | Sep. 28, 1998 | 1493.001 | 32 | RTA00001074F.f.15.1 | M00004360B:B08 |
| 9102 | Sep. 28, 1998 | 1493.001 | 33 | RTA00001074F.f.01.1 | M00004350A:C04 |
| 9103 | Sep. 28, 1998 | 1493.001 | 34 | RTA00001074F.d.08.1 | M00004318D:D07 |
| 9104 | Sep. 28, 1998 | 1493.001 | 35 | RTA00001072F.f.11.2 | M00003788D:E06 |
| 9105 | Sep. 28, 1998 | 1493.001 | 36 | RTA00001074F.e.05.1 | M00004337A:A07 |
| 9106 | Sep. 28, 1998 | 1493.001 | 37 | RTA00001072F.g.05.2 | M00003803B:G12 |
| 9107 | Sep. 28, 1998 | 1493.001 | 38 | RTA00001071F.j.04.3 | M00001479D:B10 |
| 9108 | Sep. 28, 1998 | 1493.001 | 39 | RTA00001074F.j.05.1 | M00004415A:A01 |
| 9109 | Sep. 28, 1998 | 1493.001 | 40 | RTA00001074F.j.04.1 | M00004414D:C11 |
| 9110 | Sep. 28, 1998 | 1493.001 | 41 | RTA00001073F.e.06.1 | M00004067C:C10 |
| 9111 | Sep. 28, 1998 | 1493.001 | 42 | RTA00001071F.d.14.1 | M00001389A:F03 |
| 9112 | Sep. 28, 1998 | 1493.001 | 43 | RTA00001071F.f.12.1 | M00001418C:F06 |
| 9113 | Sep. 28, 1998 | 1493.001 | 44 | RTA00001061F.m.13.1 | M00001601D:A03 |

TABLE 69A-continued

| | | | Priority Appln Information | | |
|---|---|---|---|---|---|
| SEQ ID NO: | Filed | Dkt NO. | SEQ ID NO: | Sequence Name | Clone Name |
| 9114 | Sep. 28, 1998 | 1493.001 | 45 | RTA00001061F.e.17.1 | M00001418A:A02 |
| 9115 | Sep. 28, 1998 | 1493.001 | 46 | RTA00001071F.m.09.3 | M00001563A:F04 |
| 9116 | Sep. 28, 1998 | 1493.001 | 47 | RTA00001062F.l.05.1 | M00004029D:H03 |
| 9117 | Sep. 28, 1998 | 1493.001 | 48 | RTA00001073F.i.02.2 | M00004125B:A02 |
| 9118 | Sep. 28, 1998 | 1493.001 | 49 | RTA00001063F.l.04.1 | M00004404C:B03 |
| 9119 | Sep. 28, 1998 | 1493.001 | 50 | RTA00001063F.l.14.1 | M00004412A:G05 |
| 9120 | Sep. 28, 1998 | 1493.001 | 51 | RTA00001063F.e.05.1 | M00004232D:G11 |
| 9121 | Sep. 28, 1998 | 1493.001 | 52 | RTA00001062F.f.06.1 | M00003880A:G10 |
| 9122 | Sep. 28, 1998 | 1493.001 | 53 | RTA00001072F.b.23.2 | M00001683B:F12 |
| 9123 | Sep. 28, 1998 | 1493.001 | 54 | RTA00001073F.a.13.1 | M00003989D:A02 |
| 9124 | Sep. 28, 1998 | 1493.001 | 55 | RTA00001074F.h.16.1 | M00004386C:C03 |
| 9125 | Sep. 28, 1998 | 1493.001 | 56 | RTA00001073F.a.15.1 | M00003991A:D05 |
| 9126 | Sep. 28, 1998 | 1493.001 | 57 | RTA00001073F.k.01.1 | M00004152A:F03 |
| 9127 | Sep. 28, 1998 | 1493.001 | 58 | RTA00001072F.l.19.2 | M00003901B:C02 |
| 9128 | Sep. 28, 1998 | 1493.001 | 59 | RTA00001072F.i.15.3 | M00003848A:E08 |
| 9129 | Sep. 28, 1998 | 1493.001 | 60 | RTA00001072F.i.05.3 | M00003844D:B02 |
| 9130 | Sep. 28, 1998 | 1493.001 | 61 | RTA00001074F.m.06.1 | M00004603D:D09 |
| 9131 | Sep. 28, 1998 | 1493.001 | 62 | RTA00001062F.m.15.1 | M00004063B:B12 |
| 9132 | Sep. 28, 1998 | 1493.001 | 63 | RTA00001074F.d.19.1 | M00004326D:D06 |
| 9133 | Sep. 28, 1998 | 1493.001 | 64 | RTA00001073F.j.02.1 | M00004140B:C02 |
| 9134 | Sep. 28, 1998 | 1493.001 | 65 | RTA00001071F.l.11.1 | M00001545D:F12 |
| 9135 | Sep. 28, 1998 | 1493.001 | 66 | RTA00001074F.f.12.1 | M00004356C:D02 |
| 9136 | Sep. 28, 1998 | 1493.001 | 67 | RTA00001073F.h.03.1 | M00004110A:G03 |
| 9137 | Sep. 28, 1998 | 1493.001 | 68 | RTA00001074F.a.19.1 | M00004275A:H07 |
| 9138 | Sep. 28, 1998 | 1493.001 | 69 | RTA00001063F.g.15.1 | M00004292A:C08 |
| 9139 | Sep. 28, 1998 | 1493.001 | 70 | RTA00001061F.a.09.1 | M00001345C:B10 |
| 9140 | Sep. 28, 1998 | 1493.001 | 71 | RTA00001063F.f.23.1 | M00004284A:C09 |
| 9141 | Sep. 28, 1998 | 1493.001 | 72 | RTA00001073F.e.10.1 | M00004069A:E04 |
| 9142 | Sep. 28, 1998 | 1493.001 | 73 | RTA00001073F.g.15.1 | M00004103A:E06 |
| 9143 | Sep. 28, 1998 | 1493.001 | 74 | RTA00001073F.n.20.1 | M00004209B:G01 |
| 9144 | Sep. 28, 1998 | 1493.001 | 75 | RTA00001073F.g.11.1 | M00004099C:F04 |
| 9145 | Sep. 28, 1998 | 1493.001 | 76 | RTA00001071F.p.05.1 | M00001630A:E08 |
| 9146 | Sep. 28, 1998 | 1493.001 | 77 | RTA00001073F.l.19.1 | M00004175D:D05 |
| 9147 | Sep. 28, 1998 | 1493.001 | 78 | RTA00001074F.j.17.1 | M00004426B:H06 |
| 9148 | Sep. 28, 1998 | 1493.001 | 79 | RTA00001074F.b.22.1 | M00004292A:F03 |
| 9149 | Sep. 28, 1998 | 1493.001 | 80 | RTA00001071F.d.19.1 | M00001391C:B05 |
| 9150 | Sep. 28, 1998 | 1493.001 | 81 | RTA00001062F.j.02.1 | M00003960D:E09 |
| 9151 | Sep. 28, 1998 | 1493.001 | 82 | RTA00001072F.b.09.2 | M00001664D:E02 |
| 9152 | Sep. 28, 1998 | 1493.001 | 83 | RTA00001073F.b.08.1 | M00003998D:D04 |
| 9153 | Sep. 28, 1998 | 1493.001 | 84 | RTA00001062F.j.19.1 | M00003977D:H04 |
| 9154 | Sep. 28, 1998 | 1493.001 | 85 | RTA00001062F.m.18.1 | M00004066D:C02 |
| 9155 | Sep. 28, 1998 | 1493.001 | 86 | RTA00001062F.b.02.1 | M00003775C:C01 |
| 9156 | Sep. 28, 1998 | 1493.001 | 87 | RTA00001061F.d.20.1 | M00001401B:A02 |
| 9157 | Sep. 28, 1998 | 1493.001 | 88 | RTA00001071F.n.05.3 | M00001579C:E07 |
| 9158 | Sep. 28, 1998 | 1493.001 | 89 | RTA00001073F.l.04.1 | M00004170B:G04 |
| 9159 | Sep. 28, 1998 | 1493.001 | 90 | RTA00001071F.h.04.1 | M00001442D:D09 |
| 9160 | Sep. 28, 1998 | 1493.001 | 91 | RTA00001062F.o.11.1 | M00004104C:F06 |
| 9161 | Sep. 28, 1998 | 1493.001 | 92 | RTA00001062F.i.10.1 | M00003939B:C02 |
| 9162 | Sep. 28, 1998 | 1493.001 | 93 | RTA00001071F.g.16.1 | M00001431A:F03 |
| 9163 | Sep. 28, 1998 | 1493.001 | 94 | RTA00001061F.d.06.1 | M00001392A:F02 |
| 9164 | Sep. 28, 1998 | 1493.001 | 95 | RTA00001071F.m.01.3 | M00001561A:G10 |
| 9165 | Sep. 28, 1998 | 1493.001 | 96 | RTA00001062F.n.06.1 | M00004081A:E11 |
| 9166 | Sep. 28, 1998 | 1493.001 | 97 | RTA00001061F.d.14.1 | M00001397D:G04 |
| 9167 | Sep. 28, 1998 | 1493.001 | 98 | RTA00001061F.j.10.1 | M00001507D:F09 |
| 9168 | Sep. 28, 1998 | 1493.001 | 99 | RTA00001063F.c.07.1 | M00004185B:H03 |
| 9169 | Sep. 28, 1998 | 1493.001 | 100 | RTA00001061F.j.12.1 | M00001513B:F05 |
| 9170 | Sep. 28, 1998 | 1493.001 | 101 | RTA00001061F.o.22.1 | M00001678A:B10 |
| 9171 | Sep. 28, 1998 | 1493.001 | 102 | RTA00001071F.e.03.1 | M00001395D:B04 |
| 9172 | Sep. 28, 1998 | 1493.001 | 103 | RTA00001072F.e.13.2 | M00003772C:F12 |
| 9173 | Sep. 28, 1998 | 1493.001 | 104 | RTA00001062F.i.03.1 | M00003928D:A04 |
| 9174 | Sep. 28, 1998 | 1493.001 | 105 | RTA00001072F.d.20.2 | M00003761C:C05 |
| 9175 | Sep. 28, 1998 | 1493.001 | 106 | RTA00001074F.g.16.1 | M00004371B:A05 |
| 9176 | Sep. 28, 1998 | 1493.001 | 107 | RTA00001074F.f.09.1 | M00004353D:C06 |
| 9177 | Sep. 28, 1998 | 1493.001 | 108 | RTA00001071F.k.12.1 | M00001505C:C10 |
| 9178 | Sep. 28, 1998 | 1493.001 | 109 | RTA00001074F.f.13.1 | M00004357A:B10 |
| 9179 | Sep. 28, 1998 | 1493.001 | 110 | RTA00001071F.e.08.1 | M00001397C:F01 |
| 9180 | Sep. 28, 1998 | 1493.001 | 111 | RTA00001073F.h.11.1 | M00004117D:F06 |
| 9181 | Sep. 28, 1998 | 1493.001 | 112 | RTA00001072F.o.14.2 | M00003937D:F09 |
| 9182 | Sep. 28, 1998 | 1493.001 | 113 | RTA00001074F.c.11.1 | M00004298A:H09 |
| 9183 | Sep. 28, 1998 | 1493.001 | 114 | RTA00001074F.g.08.1 | M00004368A:G11 |
| 9184 | Sep. 28, 1998 | 1493.001 | 115 | RTA00001073F.a.18.1 | M00003993C:G11 |
| 9185 | Sep. 28, 1998 | 1493.001 | 116 | RTA00001073F.f.19.1 | M00004090A:B11 |
| 9186 | Sep. 28, 1998 | 1493.001 | 117 | RTA00001072F.l.20.2 | M00003902C:D02 |
| 9187 | Sep. 28, 1998 | 1493.001 | 118 | RTA00001073F.b.06.1 | M00003997D:G03 |
| 9188 | Sep. 28, 1998 | 1493.001 | 119 | RTA00001062F.o.14.1 | M00004105C:C05 |

TABLE 69A-continued

| | | | Priority Appln Information | | |
|---|---|---|---|---|---|
| SEQ ID NO: | Filed | Dkt NO. | SEQ ID NO: | Sequence Name | Clone Name |
| 9189 | Sep. 28, 1998 | 1493.001 | 120 | RTA00001071F.i.04.3 | M00001457D:E08 |
| 9190 | Sep. 28, 1998 | 1493.001 | 121 | RTA00001074F.a.23.1 | M00004278C:H11 |
| 9191 | Sep. 28, 1998 | 1493.001 | 122 | RTA00001073F.c.04.1 | M00004034A:G03 |
| 9192 | Sep. 28, 1998 | 1493.001 | 123 | RTA00001072F.h.18.2 | M00003833D:F11 |
| 9193 | Sep. 28, 1998 | 1493.001 | 124 | RTA00001074F.i.06.1 | M00004403A:A02 |
| 9194 | Sep. 28, 1998 | 1493.001 | 125 | RTA00001063F.e.09.1 | M00004240A:D03 |
| 9195 | Sep. 28, 1998 | 1493.001 | 126 | RTA00001061F.d.03.1 | M00001390C:H05 |
| 9196 | Sep. 28, 1998 | 1493.001 | 127 | RTA00001063F.d.23.1 | M00004225A:E03 |
| 9197 | Sep. 28, 1998 | 1493.001 | 128 | RTA00001063F.k.08.1 | M00004378A:H10 |
| 9198 | Sep. 28, 1998 | 1493.001 | 129 | RTA00001062F.b.04.1 | M00003776B:F08 |
| 9199 | Sep. 28, 1998 | 1493.001 | 130 | RTA00001063F.b.18.1 | M00004178B:F07 |
| 9200 | Sep. 28, 1998 | 1493.001 | 131 | RTA00001062F.b.11.1 | M00003788B:C08 |
| 9201 | Sep. 28, 1998 | 1493.001 | 132 | RTA00001074F.l.23.1 | M00004504C:G07 |
| 9202 | Sep. 28, 1998 | 1493.001 | 133 | RTA00001063F.m.08.1 | M00004444C:H11 |
| 9203 | Sep. 28, 1998 | 1493.001 | 134 | RTA00001071F.l.13.2 | M00001549C:F10 |
| 9204 | Sep. 28, 1998 | 1493.001 | 135 | RTA00001072F.p.19.2 | M00003973A:D09 |
| 9205 | Sep. 28, 1998 | 1493.001 | 136 | RTA00001071F.k.17.1 | M00001517C:A10 |
| 9206 | Sep. 28, 1998 | 1493.001 | 137 | RTA00001072F.o.24.2 | M00003943B:C12 |
| 9207 | Sep. 28, 1998 | 1493.001 | 138 | RTA00001074F.a.20.1 | M00004276A:C06 |
| 9208 | Sep. 28, 1998 | 1493.001 | 139 | RTA00001073F.c.16.1 | M00004043C:A06 |
| 9209 | Sep. 28, 1998 | 1493.001 | 140 | RTA00001074F.j.10.1 | M00004422C:A01 |
| 9210 | Sep. 28, 1998 | 1493.001 | 141 | RTA00001063F.n.16.1 | M00004498D:F02 |
| 9211 | Sep. 28, 1998 | 1493.001 | 142 | RTA00001071F.o.16.1 | M00001615A:D01 |
| 9212 | Sep. 28, 1998 | 1493.001 | 143 | RTA00001073F.k.16.1 | M00004165D:H12 |
| 9213 | Sep. 28, 1998 | 1493.001 | 144 | RTA00001062F.e.14.1 | M00003856A:H10 |
| 9214 | Sep. 28, 1998 | 1493.001 | 145 | RTA00001071F.h.22.1 | M00001454D:H09 |
| 9215 | Sep. 28, 1998 | 1493.001 | 146 | RTA00001071F.o.18.1 | M00001618C:E01 |
| 9216 | Sep. 28, 1998 | 1493.001 | 147 | RTA00001062F.p.19.1 | M00004140D:E03 |
| 9217 | Sep. 28, 1998 | 1493.001 | 148 | RTA00001062F.d.04.1 | M00003818C:D02 |
| 9218 | Sep. 28, 1998 | 1493.001 | 149 | RTA00001072F.n.22.3 | M00003933A:B04 |
| 9219 | Sep. 28, 1998 | 1493.001 | 150 | RTA00001063F.c.11.1 | M00004187A:B05 |
| 9220 | Sep. 28, 1998 | 1493.001 | 151 | RTA00001061F.j.22.1 | M00001531B:A03 |
| 9221 | Sep. 28, 1998 | 1493.001 | 152 | RTA00001062F.d.08.1 | M00003820C:E08 |
| 9222 | Sep. 28, 1998 | 1493.001 | 153 | RTA00001062F.f.02.1 | M00003877C:G01 |
| 9223 | Sep. 28, 1998 | 1493.001 | 154 | RTA00001062F.d.24.1 | M00003839D:C03 |
| 9224 | Sep. 28, 1998 | 1493.001 | 155 | RTA00001074F.h.24.1 | M00004391C:F12 |
| 9225 | Sep. 28, 1998 | 1493.001 | 156 | RTA00001071F.a.10.1 | M00001341A:H10 |
| 9226 | Sep. 28, 1998 | 1493.001 | 157 | RTA00001074F.k.13.1 | M00004449B:B05 |
| 9227 | Sep. 28, 1998 | 1493.001 | 158 | RTA00001072F.k.16.2 | M00003884C:G09 |
| 9228 | Sep. 28, 1998 | 1493.001 | 159 | RTA00001073F.k.09.1 | M00004158C:B01 |
| 9229 | Sep. 28, 1998 | 1493.001 | 160 | RTA00001074F.b.14.1 | M00004288D:E07 |
| 9230 | Sep. 28, 1998 | 1493.001 | 161 | RTA00001073F.k.08.1 | M00004157C:E06 |
| 9231 | Sep. 28, 1998 | 1493.001 | 162 | RTA00001074F.i.17.1 | M00004406D:E11 |
| 9232 | Sep. 28, 1998 | 1493.001 | 163 | RTA00001074F.k.10.1 | M00004447A:A10 |
| 9233 | Sep. 28, 1998 | 1493.001 | 164 | RTA00001062F.p.14.1 | M00004135D:D01 |
| 9234 | Sep. 28, 1998 | 1493.001 | 165 | RTA00001071F.m.15.3 | M00001569A:H01 |
| 9235 | Sep. 28, 1998 | 1493.001 | 166 | RTA00001074F.h.15.1 | M00004385D:D06 |
| 9236 | Sep. 28, 1998 | 1493.001 | 167 | RTA00001062F.i.09.1 | M00003935D:E04 |
| 9237 | Sep. 28, 1998 | 1493.001 | 168 | RTA00000611F.e.06.2 | M00004170D:C06 |
| 9238 | Sep. 28, 1998 | 1493.001 | 169 | RTA00001062F.d.19.1 | M00003835B:C05 |
| 9239 | Sep. 28, 1998 | 1493.001 | 170 | RTA00001062F.o.15.1 | M00004107A:E02 |
| 9240 | Sep. 28, 1998 | 1493.001 | 171 | RTA00001071F.a.07.1 | M00001340C:A08 |
| 9241 | Sep. 28, 1998 | 1493.001 | 172 | RTA00001062F.d.07.1 | M00003820B:G04 |
| 9242 | Sep. 28, 1998 | 1493.001 | 173 | RTA00001074F.j.11.1 | M00004423A:B05 |
| 9243 | Sep. 28, 1998 | 1493.001 | 174 | RTA00001071F.m.11.3 | M00001565C:F06 |
| 9244 | Sep. 28, 1998 | 1493.001 | 175 | RTA00001062F.i.01.1 | M00003926A:D01 |
| 9245 | Sep. 28, 1998 | 1493.001 | 176 | RTA00001072F.g.08.2 | M00003804D:F12 |
| 9246 | Sep. 28, 1998 | 1493.001 | 177 | RTA00001071F.n.16.1 | M00001594A:H01 |
| 9247 | Sep. 28, 1998 | 1493.001 | 178 | RTA00001062F.a.09.1 | M00003756D:B09 |
| 9248 | Sep. 28, 1998 | 1493.001 | 179 | RTA00001073F.h.08.1 | M00004114C:B09 |
| 9249 | Sep. 28, 1998 | 1493.001 | 180 | RTA00001073F.e.03.1 | M00004064B:G03 |
| 9250 | Sep. 28, 1998 | 1493.001 | 181 | RTA00001073F.c.23.1 | M00004048A:E10 |
| 9251 | Sep. 28, 1998 | 1493.001 | 182 | RTA00001074F.l.15.1 | M00004498D:A11 |
| 9252 | Sep. 28, 1998 | 1493.001 | 183 | RTA00001073F.l.21.1 | M00004176A:H05 |
| 9253 | Sep. 28, 1998 | 1493.001 | 184 | RTA00001071F.d.15.1 | M00001389B:B12 |
| 9254 | Sep. 28, 1998 | 1493.001 | 185 | RTA00001073F.i.08.1 | M00004127C:C08 |
| 9255 | Sep. 28, 1998 | 1493.001 | 186 | RTA00001073F.k.21.1 | M00004167A:H04 |
| 9256 | Sep. 28, 1998 | 1493.001 | 187 | RTA00001072F.j.05.2 | M00003865B:D10 |
| 9257 | Sep. 28, 1998 | 1493.001 | 188 | RTA00001063F.i.15.1 | M00004335A:G05 |
| 9258 | Sep. 28, 1998 | 1493.001 | 189 | RTA00001062F.g.21.1 | M00003907C:D02 |
| 9259 | Sep. 28, 1998 | 1493.001 | 190 | RTA00001073F.b.16.1 | M00004027C:E06 |
| 9260 | Sep. 28, 1998 | 1493.001 | 191 | RTA00001062F.g.06.1 | M00003895C:F05 |
| 9261 | Sep. 28, 1998 | 1493.001 | 192 | RTA00001071F.b.17.1 | M00001360B:B01 |
| 9262 | Sep. 28, 1998 | 1493.001 | 193 | RTA00001073F.f.18.1 | M00004087B:D05 |
| 9263 | Sep. 28, 1998 | 1493.001 | 194 | RTA00001074F.b.04.1 | M00004280D:D10 |

TABLE 69A-continued

| | | | Priority Appln Information | | |
|---|---|---|---|---|---|
| SEQ ID NO: | Filed | Dkt NO. | SEQ ID NO: | Sequence Name | Clone Name |
| 9264 | Sep. 28, 1998 | 1493.001 | 195 | RTA00001072F.d.23.2 | M00003762D:C02 |
| 9265 | Sep. 28, 1998 | 1493.001 | 196 | RTA00001073F.l.14.1 | M00004173A:D03 |
| 9266 | Sep. 28, 1998 | 1493.001 | 197 | RTA00001066F.p.21.1 | M00003747C:G12 |
| 9267 | Sep. 28, 1998 | 1493.001 | 198 | RTA00001071F.n.22.1 | M00001598C:F02 |
| 9268 | Sep. 28, 1998 | 1493.001 | 199 | RTA00001073F.d.22.1 | M00004059D:A09 |
| 9269 | Sep. 28, 1998 | 1493.001 | 200 | RTA00001072F.j.14.2 | M00003876C:G11 |
| 9270 | Sep. 28, 1998 | 1493.001 | 201 | RTA00001071F.k.21.2 | M00001528D:B12 |
| 9271 | Sep. 28, 1998 | 1493.001 | 202 | RTA00001074F.a.09.1 | M00004269C:B10 |
| 9272 | Sep. 28, 1998 | 1493.001 | 203 | RTA00001073F.p.19.1 | M00004253A:E02 |
| 9273 | Sep. 28, 1998 | 1493.001 | 204 | RTA00001061F.b.02.1 | M00001358B:F12 |
| 9274 | Sep. 28, 1998 | 1493.001 | 205 | RTA00001063F.e.10.1 | M00004240C:A06 |
| 9275 | Sep. 28, 1998 | 1493.001 | 206 | RTA00001074F.j.18.1 | M00004427D:H04 |
| 9276 | Sep. 28, 1998 | 1493.001 | 207 | RTA00001073F.f.09.1 | M00004084C:F05 |
| 9277 | Sep. 28, 1998 | 1493.001 | 208 | RTA00001071F.l.19.1 | M00001558D:E02 |
| 9278 | Sep. 28, 1998 | 1493.001 | 209 | RTA00001073F.c.09.1 | M00004036B:C11 |
| 9279 | Sep. 28, 1998 | 1493.001 | 210 | RTA00001074F.a.14.1 | M00004270C:H05 |
| 9280 | Sep. 28, 1998 | 1493.001 | 211 | RTA00001074F.l.03.1 | M00004466A:E04 |
| 9281 | Sep. 28, 1998 | 1493.001 | 212 | RTA00000611F.f.13.2 | M00004175D:G10 |
| 9282 | Sep. 28, 1998 | 1493.001 | 213 | RTA00001074F.e.16.1 | M00004343A:G07 |
| 9283 | Sep. 28, 1998 | 1493.001 | 214 | RTA00001073F.l.05.1 | M00004170C:A12 |
| 9284 | Sep. 28, 1998 | 1493.001 | 215 | RTA00001074F.e.19.1 | M00004347A:F10 |
| 9285 | Sep. 28, 1998 | 1493.001 | 216 | RTA00001073F.e.07.1 | M00004067C:E05 |
| 9286 | Sep. 28, 1998 | 1493.001 | 217 | RTA00001062F.p.22.1 | M00004142C:A06 |
| 9287 | Sep. 28, 1998 | 1493.001 | 218 | RTA00001061F.c.11.1 | M00001382D:F03 |
| 9288 | Sep. 28, 1998 | 1493.001 | 219 | RTA00001062F.f.01.1 | M00003877C:A08 |
| 9289 | Sep. 28, 1998 | 1493.001 | 220 | RTA00001072F.l.09.2 | M00003893A:D03 |
| 9290 | Sep. 28, 1998 | 1493.001 | 221 | RTA00001072F.i.14.2 | M00003847B:H01 |
| 9291 | Sep. 28, 1998 | 1493.001 | 222 | RTA00001063F.g.18.1 | M00004295A:C02 |
| 9292 | Sep. 28, 1998 | 1493.001 | 223 | RTA00001062F.j.18.1 | M00003977C:D01 |
| 9293 | Sep. 28, 1998 | 1493.001 | 224 | RTA00001061F.b.05.1 | M00001360D:C12 |
| 9294 | Sep. 28, 1998 | 1493.001 | 225 | RTA00001074F.e.18.1 | M00004344B:C06 |
| 9295 | Sep. 28, 1998 | 1493.001 | 226 | RTA00001061F.o.20.1 | M00001677B:G01 |
| 9296 | Sep. 28, 1998 | 1493.001 | 227 | RTA00001062F.d.10.1 | M00003822A:D02 |
| 9297 | Sep. 28, 1998 | 1493.001 | 228 | RTA00001062F.h.16.1 | M00003919D:F01 |
| 9298 | Sep. 28, 1998 | 1493.001 | 229 | RTA00001063F.e.19.1 | M00004251B:H12 |
| 9299 | Sep. 28, 1998 | 1493.001 | 230 | RTA00001061F.o.18.1 | M00001675C:F05 |
| 9300 | Sep. 28, 1998 | 1493.001 | 231 | RTA00001072F.j.20.2 | M00003879D:A09 |
| 9301 | Sep. 28, 1998 | 1493.001 | 232 | RTA00001071F.j.15.3 | M00001485A:C04 |
| 9302 | Sep. 28, 1998 | 1493.001 | 233 | RTA00001071F.a.09.1 | M00001340C:D09 |
| 9303 | Sep. 28, 1998 | 1493.001 | 234 | RTA00001074F.j.13.1 | M00004423C:F03 |
| 9304 | Sep. 28, 1998 | 1493.001 | 235 | RTA00001071F.i.15.3 | M00001466C:H11 |
| 9305 | Sep. 28, 1998 | 1493.001 | 236 | RTA00001071F.b.13.1 | M00001358C:D09 |
| 9306 | Sep. 28, 1998 | 1493.001 | 237 | RTA00001061F.g.05.1 | M00001441D:G02 |
| 9307 | Sep. 28, 1998 | 1493.001 | 238 | RTA00001063F.e.16.1 | M00004249A:C09 |
| 9308 | Sep. 28, 1998 | 1493.001 | 239 | RTA00001072F.j.22.2 | M00003880B:B08 |
| 9309 | Sep. 28, 1998 | 1493.001 | 240 | RTA00001063F.i.16.1 | M00004335D:D03 |
| 9310 | Sep. 28, 1998 | 1493.001 | 241 | RTA00000611F.f.05.2 | M00004174B:B12 |
| 9311 | Sep. 28, 1998 | 1493.001 | 242 | RTA00001071F.p.07.1 | M00001631D:G08 |
| 9312 | Sep. 28, 1998 | 1493.001 | 243 | RTA00001061F.c.12.1 | M00001375C:C11 |
| 9313 | Sep. 28, 1998 | 1493.001 | 244 | RTA00001074F.k.15.1 | M00004450A:G07 |
| 9314 | Sep. 28, 1998 | 1493.001 | 245 | RTA00001061F.e.19.1 | M00001419A:E01 |
| 9315 | Sep. 28, 1998 | 1493.001 | 246 | RTA00001073F.g.22.1 | M00004108C:D07 |
| 9316 | Sep. 28, 1998 | 1493.001 | 247 | RTA00001061F.g.01.1 | M00001437D:A12 |
| 9317 | Sep. 28, 1998 | 1493.001 | 248 | RTA00001072F.n.08.2 | M00003923D:A03 |
| 9318 | Sep. 28, 1998 | 1493.001 | 249 | RTA00001074F.b.12.1 | M00004286D:D02 |
| 9319 | Sep. 28, 1998 | 1493.001 | 250 | RTA00001061F.l.18.1 | M00001576C:E03 |
| 9320 | Sep. 28, 1998 | 1493.001 | 251 | RTA00001074F.j.03.1 | M00004414D:A01 |
| 9321 | Sep. 28, 1998 | 1493.001 | 252 | RTA00001072F.h.07.2 | M00003824A:B11 |
| 9322 | Sep. 28, 1998 | 1493.001 | 253 | RTA00001072F.j.18.2 | M00003877C:C11 |
| 9323 | Sep. 28, 1998 | 1493.001 | 254 | RTA00001063F.c.21.1 | M00004198B:G08 |
| 9324 | Sep. 28, 1998 | 1493.001 | 255 | RTA00001073F.m.11.1 | M00004181A:B05 |
| 9325 | Sep. 28, 1998 | 1493.001 | 256 | RTA00001061F.h.16.1 | M00001463C:E12 |
| 9326 | Sep. 28, 1998 | 1493.001 | 257 | RTA00001073F.i.11.1 | M00004128B:H11 |
| 9327 | Sep. 28, 1998 | 1493.001 | 258 | RTA00001062F.k.20.1 | M00003997A:C08 |
| 9328 | Sep. 28, 1998 | 1493.001 | 259 | RTA00001062F.o.05.1 | M00004101A:C12 |
| 9329 | Sep. 28, 1998 | 1493.001 | 260 | RTA00001073F.p.01.1 | M00004237B:G01 |
| 9330 | Sep. 28, 1998 | 1493.001 | 261 | RTA00001072F.a.04.2 | M00001647D:A02 |
| 9331 | Sep. 28, 1998 | 1493.001 | 262 | RTA00001073F.e.12.1 | M00004071D:B06 |
| 9332 | Sep. 28, 1998 | 1493.001 | 263 | RTA00001073F.p.22.1 | M00004253D:D04 |
| 9333 | Sep. 28, 1998 | 1493.001 | 264 | RTA00001072F.i.19.3 | M00003853C:A09 |
| 9334 | Sep. 28, 1998 | 1493.001 | 265 | RTA00001071F.d.06.1 | M00001386D:E01 |
| 9335 | Sep. 28, 1998 | 1493.001 | 266 | RTA00001073F.j.20.1 | M00004149C:D11 |
| 9336 | Sep. 28, 1998 | 1493.001 | 267 | RTA00001074F.l.20.1 | M00004502B:G05 |
| 9337 | Sep. 28, 1998 | 1493.001 | 268 | RTA00001072F.h.14.2 | M00003829C:G07 |
| 9338 | Sep. 28, 1998 | 1493.001 | 269 | RTA00001062F.b.13.1 | M00003788C:C05 |

TABLE 69A-continued

Priority Appln Information

| SEQ ID NO: | Filed | Dkt NO. | SEQ ID NO: | Sequence Name | Clone Name |
|---|---|---|---|---|---|
| 9339 | Sep. 28, 1998 | 1493.001 | 270 | RTA00001061F.j.14.1 | M00001514B:C02 |
| 9340 | Sep. 28, 1998 | 1493.001 | 271 | RTA00001072F.j.11.2 | M00003870C:H03 |
| 9341 | Sep. 28, 1998 | 1493.001 | 272 | RTA00001074F.m.01.1 | M00004507A:F11 |
| 9342 | Sep. 28, 1998 | 1493.001 | 273 | RTA00001063F.f.03.1 | M00004264B:F03 |
| 9343 | Sep. 28, 1998 | 1493.001 | 274 | RTA00001071F.l.21.1 | M00001559D:E02 |
| 9344 | Sep. 28, 1998 | 1493.001 | 275 | RTA00001072F.b.11.2 | M00001669B:H04 |
| 9345 | Sep. 28, 1998 | 1493.001 | 276 | RTA00001074F.i.16.1 | M00004406A:H12 |
| 9346 | Sep. 28, 1998 | 1493.001 | 277 | RTA00001061F.j.03.1 | M00001500A:A02 |
| 9347 | Sep. 28, 1998 | 1493.001 | 278 | RTA00001062F.n.16.1 | M00004085B:D12 |
| 9348 | Sep. 28, 1998 | 1493.001 | 279 | RTA00001073F.j.03.1 | M00004140C:D04 |
| 9349 | Sep. 28, 1998 | 1493.001 | 280 | RTA00001072F.k.01.2 | M00003880C:D06 |
| 9350 | Sep. 28, 1998 | 1493.001 | 281 | RTA00001074F.k.08.1 | M00004445D:A04 |
| 9351 | Sep. 28, 1998 | 1493.001 | 282 | RTA00001062F.k.05.1 | M00003985B:F06 |
| 9352 | Sep. 28, 1998 | 1493.001 | 283 | RTA00001073F.h.01.1 | M00004109A:B07 |
| 9353 | Sep. 28, 1998 | 1493.001 | 284 | RTA00000611F.f.15.2 | M00004176A:E07 |
| 9354 | Sep. 28, 1998 | 1493.001 | 285 | RTA00001073F.b.01.1 | M00003995B:C06 |
| 9355 | Sep. 28, 1998 | 1493.001 | 286 | RTA00001072F.c.16.2 | M00001694B:H12 |
| 9356 | Sep. 28, 1998 | 1493.001 | 287 | RTA00001073F.c.10.1 | M00004036C:E10 |
| 9357 | Sep. 28, 1998 | 1493.001 | 288 | RTA00001062F.g.22.1 | M00003908C:C04 |
| 9358 | Sep. 28, 1998 | 1493.001 | 289 | RTA00001074F.d.15.1 | M00004323B:G12 |
| 9359 | Sep. 28, 1998 | 1493.001 | 290 | RTA00001061F.c.12.1 | M00001383C:C04 |
| 9360 | Sep. 28, 1998 | 1493.001 | 291 | RTA00001073F.k.15.1 | M00004165B:E03 |
| 9361 | Sep. 28, 1998 | 1493.001 | 292 | RTA00001072F.j.23.2 | M00003880B:D03 |
| 9362 | Sep. 28, 1998 | 1493.001 | 293 | RTA00001073F.j.21.1 | M00004150A:B09 |
| 9363 | Sep. 28, 1998 | 1493.001 | 294 | RTA00001073F.h.20.1 | M00004123B:G05 |
| 9364 | Sep. 28, 1998 | 1493.001 | 295 | RTA00001063F.g.05.1 | M00004285C:B06 |
| 9365 | Sep. 28, 1998 | 1493.001 | 296 | RTA00001061F.a.21.1 | M00001352D:A09 |
| 9366 | Sep. 28, 1998 | 1493.001 | 297 | RTA00001061F.d.17.1 | M00001399B:C04 |
| 9367 | Sep. 28, 1998 | 1493.001 | 298 | RTA00001072F.h.04.2 | M00003819D:B02 |
| 9368 | Sep. 29, 1998 | 1494.001 | 1 | RTA00001082F.j.11.1 | M00027137D:F05 |
| 9369 | Sep. 29, 1998 | 1494.001 | 2 | RTA00001082F.h.08.1 | M00027042D:E02 |
| 9370 | Sep. 29, 1998 | 1494.001 | 3 | RTA00001082F.e.15.1 | M00026936D:D01 |
| 9371 | Sep. 29, 1998 | 1494.001 | 4 | RTA00001082F.l.21.1 | M00027204B:A08 |
| 9372 | Sep. 29, 1998 | 1494.001 | 5 | RTA00001082F.e.05.1 | M00026910C:C05 |
| 9373 | Sep. 29, 1998 | 1494.001 | 6 | RTA00001082F.i.07.1 | M00027085C:H12 |
| 9374 | Sep. 29, 1998 | 1494.001 | 7 | RTA00001082F.i.12.1 | M00027096B:A01 |
| 9375 | Sep. 29, 1998 | 1494.001 | 8 | RTA00001082F.m.12.1 | M00027218C:D06 |
| 9376 | Sep. 29, 1998 | 1494.001 | 9 | RTA00001082F.p.16.1 | M00027364D:E08 |
| 9377 | Sep. 29, 1998 | 1494.001 | 10 | RTA00001082F.g.22.1 | M00027028B:C12 |
| 9378 | Sep. 29, 1998 | 1494.001 | 11 | RTA00001069F.e.20.1 | M00026857A:F02 |
| 9379 | Sep. 29, 1998 | 1494.001 | 12 | RTA00001082F.c.05.3 | M00026811A:H01 |
| 9380 | Sep. 29, 1998 | 1494.001 | 13 | RTA00001083F.c.15.1 | M00027529B:B11 |
| 9381 | Sep. 29, 1998 | 1494.001 | 14 | RTA00001082F.f.08.1 | M00026964B:H02 |
| 9382 | Sep. 29, 1998 | 1494.001 | 15 | RTA00001082F.o.01.1 | M00027280D:H01 |
| 9383 | Sep. 29, 1998 | 1494.001 | 16 | RTA00001082F.l.05.1 | M00027190B:F06 |
| 9384 | Sep. 29, 1998 | 1494.001 | 17 | RTA00001082F.l.10.1 | M00027196A:A10 |
| 9385 | Sep. 29, 1998 | 1494.001 | 18 | RTA00001069F.i.06.1 | M00026972A:F04 |
| 9386 | Sep. 29, 1998 | 1494.001 | 19 | RTA00001082F.o.21.1 | M00027339D:E10 |
| 9387 | Sep. 29, 1998 | 1494.001 | 20 | RTA00001069F.c.13.1 | M00023390A:C04 |
| 9388 | Sep. 29, 1998 | 1494.001 | 21 | RTA00001069F.g.11.1 | M00026914C:H10 |
| 9389 | Sep. 29, 1998 | 1494.001 | 22 | RTA00001082F.e.21.1 | M00026945B:C10 |
| 9390 | Sep. 29, 1998 | 1494.001 | 23 | RTA00001083F.a.18.1 | M00027396C:B06 |
| 9391 | Sep. 29, 1998 | 1494.001 | 24 | RTA00001069F.a.21.1 | M00023298B:G07 |
| 9392 | Sep. 29, 1998 | 1494.001 | 25 | RTA00001083F.a.17.1 | M00027393D:F01 |
| 9393 | Sep. 29, 1998 | 1494.001 | 26 | RTA00001083F.a.23.1 | M00027439B:A09 |
| 9394 | Sep. 29, 1998 | 1494.001 | 27 | RTA00001083F.e.18.1 | M00027642C:D11 |
| 9395 | Sep. 29, 1998 | 1494.001 | 28 | RTA00001083F.e.04.1 | M00027618A:B08 |
| 9396 | Sep. 29, 1998 | 1494.001 | 29 | RTA00001069F.j.21.1 | M00027067A:B02 |
| 9397 | Sep. 29, 1998 | 1494.001 | 30 | RTA00001082F.h.20.1 | M00027069D:F02 |
| 9398 | Sep. 29, 1998 | 1494.001 | 31 | RTA00001069F.o.03.1 | M00027386D:C02 |
| 9399 | Sep. 29, 1998 | 1494.001 | 32 | RTA00001082F.l.04.1 | M00027189C:D04 |
| 9400 | Sep. 29, 1998 | 1494.001 | 33 | RTA00001082F.o.05.1 | M00027282D:G01 |
| 9401 | Sep. 29, 1998 | 1494.001 | 34 | RTA00001069F.a.11.1 | M00023284B:G06 |
| 9402 | Sep. 29, 1998 | 1494.001 | 35 | RTA00001069F.n.05.1 | M00027283C:H12 |
| 9403 | Sep. 29, 1998 | 1494.001 | 36 | RTA00001069F.a.22.1 | M00023299B:A01 |
| 9404 | Sep. 29, 1998 | 1494.001 | 37 | RTA00001069F.h.10.1 | M00026942C:A06 |
| 9405 | Sep. 29, 1998 | 1494.001 | 38 | RTA00001082F.h.19.1 | M00027067B:E09 |
| 9406 | Sep. 29, 1998 | 1494.001 | 39 | RTA00001082F.b.05.1 | M00023343B:C08 |
| 9407 | Sep. 29, 1998 | 1494.001 | 40 | RTA00001082F.j.05.1 | M00027131C:E07 |
| 9408 | Sep. 29, 1998 | 1494.001 | 41 | RTA00001082F.b.09.1 | M00027459A:G12 |
| 9409 | Sep. 29, 1998 | 1494.001 | 42 | RTA00001082F.d.07.3 | M00026871C:F12 |
| 9410 | Sep. 29, 1998 | 1494.001 | 43 | RTA00001083F.c.03.1 | M00027499B:G02 |
| 9411 | Sep. 29, 1998 | 1494.001 | 44 | RTA00001082F.f.01.1 | M00026949A:F04 |
| 9412 | Sep. 29, 1998 | 1494.001 | 45 | RTA00001082F.h.12.1 | M00027053C:B06 |
| 9413 | Sep. 29, 1998 | 1494.001 | 46 | RTA00001082F.a.03.1 | M00023282B:H09 |

TABLE 69A-continued

| | | | Priority Appln Information | | |
|---|---|---|---|---|---|
| SEQ ID NO: | Filed | Dkt NO. | SEQ ID NO: | Sequence Name | Clone Name |
| 9414 | Sep. 29, 1998 | 1494.001 | 47 | RTA00001082F.l.03.1 | M00027188A:D12 |
| 9415 | Sep. 29, 1998 | 1494.001 | 48 | RTA00001082F.k.04.1 | M00027154B:D05 |
| 9416 | Sep. 29, 1998 | 1494.001 | 49 | RTA00001069F.b.18.1 | M00023340A:A10 |
| 9417 | Sep. 29, 1998 | 1494.001 | 50 | RTA00001069F.o.21.1 | M00027546B:A11 |
| 9418 | Sep. 29, 1998 | 1494.001 | 51 | RTA00001082F.k.01.1 | M00027152D:H06 |
| 9419 | Sep. 29, 1998 | 1494.001 | 52 | RTA00001083F.a.14.1 | M00027388A:G05 |
| 9420 | Sep. 29, 1998 | 1494.001 | 53 | RTA00001069F.k.01.1 | M00027085A:G10 |
| 9421 | Sep. 29, 1998 | 1494.001 | 54 | RTA00001069F.h.09.1 | M00026941C:E11 |
| 9422 | Sep. 29, 1998 | 1494.001 | 55 | RTA00001069F.o.11.1 | M00027462D:A12 |
| 9423 | Sep. 29, 1998 | 1494.001 | 56 | RTA00001083F.a.22.1 | M00027438D:A03 |
| 9424 | Sep. 29, 1998 | 1494.001 | 57 | RTA00001082F.m.21.1 | M00027231C:D08 |
| 9425 | Sep. 29, 1998 | 1494.001 | 58 | RTA00001083F.f.18.1 | M00027752B:E05 |
| 9426 | Sep. 29, 1998 | 1494.001 | 59 | RTA00001082F.i.03.1 | M00027083C:F06 |
| 9427 | Sep. 29, 1998 | 1494.001 | 60 | RTA00001082F.n.01.1 | M00027234C:B05 |
| 9428 | Sep. 29, 1998 | 1494.001 | 61 | RTA00001082F.l.02.1 | M00027184D:H02 |
| 9429 | Sep. 29, 1998 | 1494.001 | 62 | RTA00001082F.k.18.1 | M00027178B:E04 |
| 9430 | Sep. 29, 1998 | 1494.001 | 63 | RTA00001069F.d.09.1 | M00023413D:F04 |
| 9431 | Sep. 29, 1998 | 1494.001 | 64 | RTA00001069F.p.05.1 | M00027607A:A09 |
| 9432 | Sep. 29, 1998 | 1494.001 | 65 | RTA00001069F.m.14.1 | M00027231A:D01 |
| 9433 | Sep. 29, 1998 | 1494.001 | 66 | RTA00001083F.c.21.1 | M00027557D:B06 |
| 9434 | Sep. 29, 1998 | 1494.001 | 67 | RTA00001069F.i.23.1 | M00027023B:H12 |
| 9435 | Sep. 29, 1998 | 1494.001 | 68 | RTA00001082F.l.07.1 | M00027193B:F07 |
| 9436 | Sep. 29, 1998 | 1494.001 | 69 | RTA00001082F.c.15.3 | M00026850B:F07 |
| 9437 | Sep. 29, 1998 | 1494.001 | 70 | RTA00001082F.f.18.1 | M00026982C:D08 |
| 9438 | Sep. 29, 1998 | 1494.001 | 71 | RTA00001082F.h.17.1 | M00027062C:C04 |
| 9439 | Sep. 29, 1998 | 1494.001 | 72 | RTA00001082F.p.14.1 | M00027363D:A08 |
| 9440 | Sep. 29, 1998 | 1494.001 | 73 | RTA00001069F.j.04.1 | M00027028A:B06 |
| 9441 | Sep. 29, 1998 | 1494.001 | 74 | RTA00001069F.p.21.1 | M00027740C:C05 |
| 9442 | Sep. 29, 1998 | 1494.001 | 75 | RTA00001082F.e.07.1 | M00026913D:G11 |
| 9443 | Sep. 29, 1998 | 1494.001 | 76 | RTA00001082F.d.23.3 | M00026905A:G11 |
| 9444 | Sep. 29, 1998 | 1494.001 | 77 | RTA00001083F.b.18.1 | M00027484A:G03 |
| 9445 | Sep. 29, 1998 | 1494.001 | 78 | RTA00001069F.o.06.1 | M00027396A:F07 |
| 9446 | Sep. 29, 1998 | 1494.001 | 79 | RTA00001082F.p.01.1 | M00027343B:H05 |
| 9447 | Sep. 29, 1998 | 1494.001 | 80 | RTA00001082F.p.11.1 | M00027356A:H02 |
| 9448 | Sep. 29, 1998 | 1494.001 | 81 | RTA00001083F.f.19.1 | M00027759B:E11 |
| 9449 | Sep. 29, 1998 | 1494.001 | 82 | RTA00001082F.i.04.1 | M00027083D:F06 |
| 9450 | Sep. 29, 1998 | 1494.001 | 83 | RTA00001082F.p.12.1 | M00027357D:A02 |
| 9451 | Sep. 29, 1998 | 1494.001 | 84 | RTA00001082F.d.15.3 | M00026882A:E07 |
| 9452 | Sep. 29, 1998 | 1494.001 | 85 | RTA00001082F.i.20.1 | M00027115B:G04 |
| 9453 | Sep. 29, 1998 | 1494.001 | 86 | RTA00001069F.d.03.1 | M00023401C:D12 |
| 9454 | Sep. 29, 1998 | 1494.001 | 87 | RTA00001082F.e.10.1 | M00026928A:B06 |
| 9455 | Sep. 29, 1998 | 1494.001 | 88 | RTA00001082F.a.07.1 | M00023295B:C03 |
| 9456 | Sep. 29, 1998 | 1494.001 | 89 | RTA00001069F.n.15.1 | M00027329A:H04 |
| 9457 | Sep. 29, 1998 | 1494.001 | 90 | RTA00001082F.d.08.3 | M00026872A:C10 |
| 9458 | Sep. 29, 1998 | 1494.001 | 91 | RTA00001083F.f.13.1 | M00027728A:B03 |
| 9459 | Sep. 29, 1998 | 1494.001 | 92 | RTA00001082F.b.03.1 | M00023340B:H12 |
| 9460 | Sep. 29, 1998 | 1494.001 | 93 | RTA00001069F.b.09.1 | M00023321B:F06 |
| 9461 | Sep. 29, 1998 | 1494.001 | 94 | RTA00001082F.l.20.1 | M00027202B:B09 |
| 9462 | Sep. 29, 1998 | 1494.001 | 95 | RTA00001083F.c.14.1 | M00027528A:G03 |
| 9463 | Sep. 29, 1998 | 1494.001 | 96 | RTA00001069F.c.07.1 | M00023369D:C05 |
| 9464 | Sep. 29, 1998 | 1494.001 | 97 | RTA00001083F.d.16.1 | M00027598C:D06 |
| 9465 | Sep. 29, 1998 | 1494.001 | 98 | RTA00001069F.e.22.1 | M00026858C:H05 |
| 9466 | Sep. 29, 1998 | 1494.001 | 99 | RTA00001082F.j.10.1 | M00027137C:A03 |
| 9467 | Sep. 29, 1998 | 1494.001 | 100 | RTA00001069F.b.01.1 | M00023301B:C01 |
| 9468 | Sep. 29, 1998 | 1494.001 | 101 | RTA00001069F.j.20.1 | M00027066A:A04 |
| 9469 | Sep. 29, 1998 | 1494.001 | 102 | RTA00001069F.e.24.1 | M00026861A:B05 |
| 9470 | Sep. 29, 1998 | 1494.001 | 103 | RTA00001069F.b.08.1 | M00023321A:F07 |
| 9471 | Sep. 29, 1998 | 1494.001 | 104 | RTA00001069F.k.16.1 | M00027131A:H02 |
| 9472 | Sep. 29, 1998 | 1494.001 | 105 | RTA00001069F.j.22.1 | M00027072C:A11 |
| 9473 | Sep. 29, 1998 | 1494.001 | 106 | RTA00001069F.j.07.1 | M00027036B:D07 |
| 9474 | Sep. 29, 1998 | 1494.001 | 107 | RTA00001083F.c.20.1 | M00027551C:B07 |
| 9475 | Sep. 29, 1998 | 1494.001 | 108 | RTA00001069F.l.11.1 | M00027169D:H06 |
| 9476 | Sep. 29, 1998 | 1494.001 | 109 | RTA00001069F.c.03.1 | M00023363C:A04 |
| 9477 | Sep. 29, 1998 | 1494.001 | 110 | RTA00001069F.l.14.1 | M00027175D:A05 |
| 9478 | Sep. 29, 1998 | 1494.001 | 111 | RTA00001083F.c.10.1 | M00027518B:B07 |
| 9479 | Sep. 29, 1998 | 1494.001 | 112 | RTA00001082F.a.04.1 | M00023287A:D08 |
| 9480 | Sep. 29, 1998 | 1494.001 | 113 | RTA00001069F.m.13.1 | M00027225B:D03 |
| 9481 | Sep. 29, 1998 | 1494.001 | 114 | RTA00001082F.n.08.1 | M00027250A:C04 |
| 9482 | Sep. 29, 1998 | 1494.001 | 115 | RTA00001069F.e.09.1 | M00026819B:E02 |
| 9483 | Sep. 29, 1998 | 1494.001 | 116 | RTA00001082F.p.18.1 | M00027369A:B03 |
| 9484 | Sep. 29, 1998 | 1494.001 | 117 | RTA00001082F.d.24.3 | M00026906B:G03 |
| 9485 | Sep. 29, 1998 | 1494.001 | 118 | RTA00001069F.c.23.1 | M00023398D:F10 |
| 9486 | Sep. 29, 1998 | 1494.001 | 119 | RTA00001069F.b.19.1 | M00023340B:B07 |
| 9487 | Sep. 29, 1998 | 1494.001 | 120 | RTA00001082F.n.03.1 | M00027237C:D04 |
| 9488 | Sep. 29, 1998 | 1494.001 | 121 | RTA00001069F.a.13.1 | M00023289D:E06 |

TABLE 69A-continued

Priority Appln Information

| SEQ ID NO: | Filed | Dkt NO. | SEQ ID NO: | Sequence Name | Clone Name |
|---|---|---|---|---|---|
| 9489 | Sep. 29, 1998 | 1494.001 | 122 | RTA00001069F.e.16.1 | M00026846C:B01 |
| 9490 | Sep. 29, 1998 | 1494.001 | 123 | RTA00001069F.p.04.1 | M00027603C:E02 |
| 9491 | Sep. 29, 1998 | 1494.001 | 124 | RTA00001069F.m.21.1 | M00027248D:D01 |
| 9492 | Sep. 29, 1998 | 1494.001 | 125 | RTA00001082F.h.14.1 | M00027056B:H07 |
| 9493 | Sep. 29, 1998 | 1494.001 | 126 | RTA00001069F.p.03.1 | M00027592D:C05 |
| 9494 | Sep. 29, 1998 | 1494.001 | 127 | RTA00001069F.n.02.1 | M00027266C:G12 |
| 9495 | Sep. 29, 1998 | 1494.001 | 128 | RTA00001082F.m.01.1 | M00027209D:B09 |
| 9496 | Sep. 29, 1998 | 1494.001 | 129 | RTA00001083F.e.09.1 | M00027628D:D08 |
| 9497 | Sep. 29, 1998 | 1494.001 | 130 | RTA00001069F.d.18.1 | M00023432D:F09 |
| 9498 | Sep. 29, 1998 | 1494.001 | 131 | RTA00001069F.e.06.1 | M00026810A:H04 |
| 9499 | Sep. 29, 1998 | 1494.001 | 132 | RTA00001069F.e.05.1 | M00026809C:D10 |
| 9500 | Sep. 29, 1998 | 1494.001 | 133 | RTA00001083F.c.05.1 | M00027502C:H02 |
| 9501 | Sep. 29, 1998 | 1494.001 | 134 | RTA00001069F.c.10.1 | M00023373A:D01 |
| 9502 | Sep. 29, 1998 | 1494.001 | 135 | RTA00001082F.k.10.1 | M00027164A:A09 |
| 9503 | Sep. 29, 1998 | 1494.001 | 136 | RTA00001083F.c.07.1 | M00027507C:C06 |
| 9504 | Sep. 29, 1998 | 1494.001 | 137 | RTA00001082F.j.15.1 | M00027142A:C01 |
| 9505 | Oct. 8, 1998 | 1495.001 | 1 | RTA00001079F.j.08.1 | M00022217B:E03 |
| 9506 | Oct. 8, 1998 | 1495.001 | 2 | RTA00001081F.h.04.1 | M00022854D:C04 |
| 9507 | Oct. 8, 1998 | 1495.001 | 3 | RTA00001078F.h.08.1 | M00021624B:D03 |
| 9508 | Oct. 8, 1998 | 1495.001 | 4 | RTA00001079F.b.12.1 | M00022056C:D12 |
| 9509 | Oct. 8, 1998 | 1495.001 | 5 | RTA00001066F.o.03.1 | M00022074A:F05 |
| 9510 | Oct. 8, 1998 | 1495.001 | 6 | RTA00001067F.p.05.1 | M00022640B:G10 |
| 9511 | Oct. 8, 1998 | 1495.001 | 7 | RTA00001079F.l.05.1 | M00022260C:H07 |
| 9512 | Oct. 8, 1998 | 1495.001 | 8 | RTA00001078F.f.17.1 | M00008083A:H11 |
| 9513 | Oct. 8, 1998 | 1495.001 | 9 | RTA00001079F.l.04.1 | M00022259A:D04 |
| 9514 | Oct. 8, 1998 | 1495.001 | 10 | RTA00001079F.m.19.1 | M00022368C:C11 |
| 9515 | Oct. 8, 1998 | 1495.001 | 11 | RTA00001081F.f.08.1 | M00022831C:F11 |
| 9516 | Oct. 8, 1998 | 1495.001 | 12 | RTA00001079F.e.13.1 | M00022113B:A12 |
| 9517 | Oct. 8, 1998 | 1495.001 | 13 | RTA00001081F.f.21.1 | M00022838B:E05 |
| 9518 | Oct. 8, 1998 | 1495.001 | 14 | RTA00001079F.g.11.1 | M00022152A:G05 |
| 9519 | Oct. 8, 1998 | 1495.001 | 15 | RTA00001067F.i.05.1 | M00022392C:H06 |
| 9520 | Oct. 8, 1998 | 1495.001 | 16 | RTA00001067F.n.01.1 | M00022561B:B09 |
| 9521 | Oct. 8, 1998 | 1495.001 | 17 | RTA00001080F.i.20.1 | M00022569D:H03 |
| 9522 | Oct. 8, 1998 | 1495.001 | 18 | RTA00001081F.p.04.1 | M00023096A:F03 |
| 9523 | Oct. 8, 1998 | 1495.001 | 19 | RTA00001078F.d.04.1 | M00008023A:B03 |
| 9524 | Oct. 8, 1998 | 1495.001 | 20 | RTA00001080F.h.09.1 | M00022546B:F12 |
| 9525 | Oct. 8, 1998 | 1495.001 | 21 | RTA00000631F.a.10.3 | M00022362D:G11 |
| 9526 | Oct. 8, 1998 | 1495.001 | 22 | RTA00001078F.f.15.1 | M00008082B:H10 |
| 9527 | Oct. 8, 1998 | 1495.001 | 23 | RTA00001078F.a.11.1 | M00007948D:F08 |
| 9528 | Oct. 8, 1998 | 1495.001 | 24 | RTA00001078F.e.08.1 | M00008052C:G11 |
| 9529 | Oct. 8, 1998 | 1495.001 | 25 | RTA00001078F.c.08.1 | M00008012D:E07 |
| 9530 | Oct. 8, 1998 | 1495.001 | 26 | RTA00001078F.b.18.1 | M00008001B:E11 |
| 9531 | Oct. 8, 1998 | 1495.001 | 27 | RTA00001078F.d.08.1 | M00008023C:A06 |
| 9532 | Oct. 8, 1998 | 1495.001 | 28 | RTA00001080F.p.19.1 | M00022711B:A05 |
| 9533 | Oct. 8, 1998 | 1495.001 | 29 | RTA00001078F.a.17.1 | M00007965C:B02 |
| 9534 | Oct. 8, 1998 | 1495.001 | 30 | RTA00001078F.n.22.2 | M00021958A:A04 |
| 9535 | Oct. 8, 1998 | 1495.001 | 31 | RTA00001079F.d.12.1 | M00022090D:B03 |
| 9536 | Oct. 8, 1998 | 1495.001 | 32 | RTA00001078F.j.16.1 | M00021696C:E02 |
| 9537 | Oct. 8, 1998 | 1495.001 | 33 | RTA00001080F.n.06.1 | M00022655A:F09 |
| 9538 | Oct. 8, 1998 | 1495.001 | 34 | RTA00001067F.d.16.1 | M00022214A:D01 |
| 9539 | Oct. 8, 1998 | 1495.001 | 35 | RTA00001078F.l.03.2 | M00021865B:F06 |
| 9540 | Oct. 8, 1998 | 1495.001 | 36 | RTA00001080F.o.02.1 | M00022684B:F11 |
| 9541 | Oct. 8, 1998 | 1495.001 | 37 | RTA00001067F.p.15.1 | M00022652B:G06 |
| 9542 | Oct. 8, 1998 | 1495.001 | 38 | RTA00001079F.d.16.1 | M00022094A:A09 |
| 9543 | Oct. 8, 1998 | 1495.001 | 39 | RTA00001068F.c.17.1 | M00022826A:C08 |
| 9544 | Oct. 8, 1998 | 1495.001 | 40 | RTA00001080F.g.05.1 | M00022527D:A09 |
| 9545 | Oct. 8, 1998 | 1495.001 | 41 | RTA00001081F.e.07.1 | M00022813C:B09 |
| 9546 | Oct. 8, 1998 | 1495.001 | 42 | RTA00001066F.g.16.1 | M00021653C:B06 |
| 9547 | Oct. 8, 1998 | 1495.001 | 43 | RTA00001066F.l.05.1 | M00021972A:C10 |
| 9548 | Oct. 8, 1998 | 1495.001 | 44 | RTA00001066F.h.16.1 | M00021691B:E04 |
| 9549 | Oct. 8, 1998 | 1495.001 | 45 | RTA00001081F.g.13.1 | M00022844C:A01 |
| 9550 | Oct. 8, 1998 | 1495.001 | 46 | RTA00001067F.p.07.1 | M00022641C:H03 |
| 9551 | Oct. 8, 1998 | 1495.001 | 47 | RTA00001080F.g.02.1 | M00022525C:E09 |
| 9552 | Oct. 8, 1998 | 1495.001 | 48 | RTA00001080F.i.02.1 | M00022559D:F10 |
| 9553 | Oct. 8, 1998 | 1495.001 | 49 | RTA00001080F.g.22.1 | M00022541D:G06 |
| 9554 | Oct. 8, 1998 | 1495.001 | 50 | RTA00001067F.d.20.1 | M00022216C:H02 |
| 9555 | Oct. 8, 1998 | 1495.001 | 51 | RTA00001079F.k.17.1 | M00022252A:C01 |
| 9556 | Oct. 8, 1998 | 1495.001 | 52 | RTA00001068F.d.04.1 | M00022838A:H05 |
| 9557 | Oct. 8, 1998 | 1495.001 | 53 | RTA00001079F.n.11.1 | M00022377A:E02 |
| 9558 | Oct. 8, 1998 | 1495.001 | 54 | RTA00001066F.d.22.1 | M00008053D:E09 |
| 9559 | Oct. 8, 1998 | 1495.001 | 55 | RTA00001068F.f.08.1 | M00023002A:C02 |
| 9560 | Oct. 8, 1998 | 1495.001 | 56 | RTA00001081F.o.16.1 | M00023038D:D04 |
| 9561 | Oct. 8, 1998 | 1495.001 | 57 | RTA00001080F.f.18.1 | M00022518C:C04 |
| 9562 | Oct. 8, 1998 | 1495.001 | 58 | RTA00001080F.a.16.1 | M00022434D:B06 |
| 9563 | Oct. 8, 1998 | 1495.001 | 59 | RTA00001080F.j.18.1 | M00022590D:E08 |

TABLE 69A-continued

| | | | Priority Appln Information | | |
|---|---|---|---|---|---|
| SEQ ID NO: | Filed | Dkt NO. | SEQ ID NO: | Sequence Name | Clone Name |
| 9564 | Oct. 8, 1998 | 1495.001 | 60 | RTA00001080F.n.11.1 | M00022659B:C01 |
| 9565 | Oct. 8, 1998 | 1495.001 | 61 | RTA00001078F.e.01.1 | M00008048C:A08 |
| 9566 | Oct. 8, 1998 | 1495.001 | 62 | RTA00001078F.b.07.1 | M00007992A:G04 |
| 9567 | Oct. 8, 1998 | 1495.001 | 63 | RTA00001078F.b.01.1 | M00007985C:G07 |
| 9568 | Oct. 8, 1998 | 1495.001 | 64 | RTA00001080F.n.14.1 | M00022664A:E04 |
| 9569 | Oct. 8, 1998 | 1495.001 | 65 | RTA00001078F.o.21.2 | M00021980A:F03 |
| 9570 | Oct. 8, 1998 | 1495.001 | 66 | RTA00001078F.c.06.1 | M00008012B:C05 |
| 9571 | Oct. 8, 1998 | 1495.001 | 67 | RTA00001080F.o.15.1 | M00022695D:B02 |
| 9572 | Oct. 8, 1998 | 1495.001 | 68 | RTA00001080F.o.16.1 | M00022696A:H03 |
| 9573 | Oct. 8, 1998 | 1495.001 | 69 | RTA00001081F.a.07.2 | M00022720A:C01 |
| 9574 | Oct. 8, 1998 | 1495.001 | 70 | RTA00001078F.f.22.1 | M00008089C:B08 |
| 9575 | Oct. 8, 1998 | 1495.001 | 71 | RTA00001078F.g.02.1 | M00008093C:G08 |
| 9576 | Oct. 8, 1998 | 1495.001 | 72 | RTA00001078F.j.13.2 | M00021689A:G05 |
| 9577 | Oct. 8, 1998 | 1495.001 | 73 | RTA00001078F.l.02.2 | M00021864C:C07 |
| 9578 | Oct. 8, 1998 | 1495.001 | 74 | RTA00001078F.i.14.2 | M00021667C:G10 |
| 9579 | Oct. 8, 1998 | 1495.001 | 75 | RTA00001079F.d.04.1 | M00022087A:D01 |
| 9580 | Oct. 8, 1998 | 1495.001 | 76 | RTA00001079F.l.09.1 | M00022263A:C01 |
| 9581 | Oct. 8, 1998 | 1495.001 | 77 | RTA00001067F.o.19.1 | M00022627B:D01 |
| 9582 | Oct. 8, 1998 | 1495.001 | 78 | RTA00001068F.b.01.1 | M00022714B:D04 |
| 9583 | Oct. 8, 1998 | 1495.001 | 79 | RTA00001079F.f.07.1 | M00022128A:C05 |
| 9584 | Oct. 8, 1998 | 1495.001 | 80 | RTA00001068F.a.03.1 | M00022669D:G07 |
| 9585 | Oct. 8, 1998 | 1495.001 | 81 | RTA00001066F.f.03.1 | M00008088D:B01 |
| 9586 | Oct. 8, 1998 | 1495.001 | 82 | RTA00001067F.o.18.1 | M00022627A:A02 |
| 9587 | Oct. 8, 1998 | 1495.001 | 83 | RTA00001079F.k.12.1 | M00022249C:G09 |
| 9588 | Oct. 8, 1998 | 1495.001 | 84 | RTA00001081F.g.07.1 | M00022843A:D02 |
| 9589 | Oct. 8, 1998 | 1495.001 | 85 | RTA00001079F.j.01.1 | M00022214A:H05 |
| 9590 | Oct. 8, 1998 | 1495.001 | 86 | RTA00001067F.p.10.1 | M00022648D:G11 |
| 9591 | Oct. 8, 1998 | 1495.001 | 87 | RTA00001081F.f.16.1 | M00022836C:A07 |
| 9592 | Oct. 8, 1998 | 1495.001 | 88 | RTA00001080F.i.05.1 | M00022561D:E06 |
| 9593 | Oct. 8, 1998 | 1495.001 | 89 | RTA00001067F.l.02.1 | M00022490B:G12 |
| 9594 | Oct. 8, 1998 | 1495.001 | 90 | RTA00001068F.a.23.1 | M00022709A:G02 |
| 9595 | Oct. 8, 1998 | 1495.001 | 91 | RTA00001067F.d.18.1 | M00022214C:E09 |
| 9596 | Oct. 8, 1998 | 1495.001 | 92 | RTA00001066F.o.05.1 | M00022077D:A12 |
| 9597 | Oct. 8, 1998 | 1495.001 | 93 | RTA00001066F.m.08.1 | M00022015D:C11 |
| 9598 | Oct. 8, 1998 | 1495.001 | 94 | RTA00001066F.b.12.1 | M00007978B:C04 |
| 9599 | Oct. 8, 1998 | 1495.001 | 95 | RTA00001066F.c.08.1 | M00008002B:F09 |
| 9600 | Oct. 8, 1998 | 1495.001 | 96 | RTA00001081F.p.05.1 | M00023096C:A03 |
| 9601 | Oct. 8, 1998 | 1495.001 | 97 | RTA00001081F.c.01.1 | M00022746D:D05 |
| 9602 | Oct. 8, 1998 | 1495.001 | 98 | RTA00001079F.m.23.1 | M00022370A:G07 |
| 9603 | Oct. 8, 1998 | 1495.001 | 99 | RTA00001079F.m.09.1 | M00022300A:A05 |
| 9604 | Oct. 8, 1998 | 1495.001 | 100 | RTA00001081F.c.21.1 | M00022785C:B10 |
| 9605 | Oct. 8, 1998 | 1495.001 | 101 | RTA00001079F.o.04.1 | M00022383C:F05 |
| 9606 | Oct. 8, 1998 | 1495.001 | 102 | RTA00001080F.b.10.1 | M00022449D:B05 |
| 9607 | Oct. 8, 1998 | 1495.001 | 103 | RTA00001078F.c.09.1 | M00008012D:H04 |
| 9608 | Oct. 8, 1998 | 1495.001 | 104 | RTA00001078F.d.19.1 | M00008044C:A05 |
| 9609 | Oct. 8, 1998 | 1495.001 | 105 | RTA00001081F.a.11.2 | M00022722D:C07 |
| 9610 | Oct. 8, 1998 | 1495.001 | 106 | RTA00001080F.n.15.1 | M00022664C:G10 |
| 9611 | Oct. 8, 1998 | 1495.001 | 107 | RTA00001078F.a.09.1 | M00007941D:D07 |
| 9612 | Oct. 8, 1998 | 1495.001 | 108 | RTA00001078F.g.20.1 | M00021614A:C09 |
| 9613 | Oct. 8, 1998 | 1495.001 | 109 | RTA00001066F.h.23.1 | M00021841A:E11 |
| 9614 | Oct. 8, 1998 | 1495.001 | 110 | RTA00001081F.l.11.2 | M00022922D:G06 |
| 9615 | Oct. 8, 1998 | 1495.001 | 111 | RTA00001079F.d.18.1 | M00022096B:D10 |
| 9616 | Oct. 8, 1998 | 1495.001 | 112 | RTA00001066F.f.21.1 | M00008100D:C08 |
| 9617 | Oct. 8, 1998 | 1495.001 | 113 | RTA00001078F.j.06.1 | M00021680D:H08 |
| 9618 | Oct. 8, 1998 | 1495.001 | 114 | RTA00001067F.d.08.1 | M00022205A:C02 |
| 9619 | Oct. 8, 1998 | 1495.001 | 115 | RTA00001068F.b.05.1 | M00022717C:F05 |
| 9620 | Oct. 8, 1998 | 1495.001 | 116 | RTA00001079F.c.05.1 | M00022071D:C08 |
| 9621 | Oct. 8, 1998 | 1495.001 | 117 | RTA00001078F.k.10.2 | M00021852C:D12 |
| 9622 | Oct. 8, 1998 | 1495.001 | 118 | RTA00001081F.i.18.2 | M00022884D:A07 |
| 9623 | Oct. 8, 1998 | 1495.001 | 119 | RTA00001066F.b.21.1 | M00007996C:B11 |
| 9624 | Oct. 8, 1998 | 1495.001 | 120 | RTA00001066F.i.08.1 | M00021851D:H06 |
| 9625 | Oct. 8, 1998 | 1495.001 | 121 | RTA00001068F.e.08.1 | M00022915C:C09 |
| 9626 | Oct. 8, 1998 | 1495.001 | 122 | RTA00001079F.j.15.1 | M00022220B:B06 |
| 9627 | Oct. 8, 1998 | 1495.001 | 123 | RTA00001078F.j.18.2 | M00021698A:H03 |
| 9628 | Oct. 8, 1998 | 1495.001 | 124 | RTA00001066F.b.09.1 | M00007977B:C11 |
| 9629 | Oct. 8, 1998 | 1495.001 | 125 | RTA00001079F.i.20.1 | M00022207C:C01 |
| 9630 | Oct. 8, 1998 | 1495.001 | 126 | RTA00001080F.e.15.1 | M00022506D:B03 |
| 9631 | Oct. 8, 1998 | 1495.001 | 127 | RTA00001080F.l.03.1 | M00022617B:A01 |
| 9632 | Oct. 8, 1998 | 1495.001 | 128 | RTA00001080F.e.10.1 | M00022501D:A09 |
| 9633 | Oct. 8, 1998 | 1495.001 | 129 | RTA00001067F.c.22.1 | M00022184D:F07 |
| 9634 | Oct. 8, 1998 | 1495.001 | 130 | RTA00001081F.p.11.1 | M00023097A:C03 |
| 9635 | Oct. 8, 1998 | 1495.001 | 131 | RTA00001081F.p.08.1 | M00023096D:B11 |
| 9636 | Oct. 8, 1998 | 1495.001 | 132 | RTA00001080F.c.19.1 | M00022471D:A05 |
| 9637 | Oct. 8, 1998 | 1495.001 | 133 | RTA00001081F.b.06.1 | M00022736B:B03 |
| 9638 | Oct. 8, 1998 | 1495.001 | 134 | RTA00001081F.m.22.1 | M00022983A:H04 |

TABLE 69A-continued

| | | | Priority Appln Information | | |
|---|---|---|---|---|---|
| SEQ ID NO: | Filed | Dkt NO. | SEQ ID NO: | Sequence Name | Clone Name |
| 9639 | Oct. 8, 1998 | 1495.001 | 135 | RTA00001081F.d.11.1 | M00022801A:G04 |
| 9640 | Oct. 8, 1998 | 1495.001 | 136 | RTA00001081F.n.13.1 | M00023002D:C12 |
| 9641 | Oct. 8, 1998 | 1495.001 | 137 | RTA00001067F.d.17.1 | M00022214C:C11 |
| 9642 | Oct. 8, 1998 | 1495.001 | 138 | RTA00001081F.c.13.1 | M00022772A:A06 |
| 9643 | Oct. 8, 1998 | 1495.001 | 139 | RTA00001078F.b.19.1 | M00008001D:F11 |
| 9644 | Oct. 8, 1998 | 1495.001 | 140 | RTA00001078F.a.04.1 | M00007931A:B07 |
| 9645 | Oct. 8, 1998 | 1495.001 | 141 | RTA00001078F.b.16.1 | M00008000D:G11 |
| 9646 | Oct. 8, 1998 | 1495.001 | 142 | RTA00001078F.b.04.1 | M00007987A:D10 |
| 9647 | Oct. 8, 1998 | 1495.001 | 143 | RTA00001078F.d.18.1 | M00008044B:F07 |
| 9648 | Oct. 8, 1998 | 1495.001 | 144 | RTA00001068F.e.05.1 | M00022904D:D04 |
| 9649 | Oct. 8, 1998 | 1495.001 | 145 | RTA00001078F.i.18.1 | M00021674A:B07 |
| 9650 | Oct. 8, 1998 | 1495.001 | 146 | RTA00001066F.e.01.1 | M00008054C:C03 |
| 9651 | Oct. 8, 1998 | 1495.001 | 147 | RTA00001078F.n.14.2 | M00021949D:A05 |
| 9652 | Oct. 8, 1998 | 1495.001 | 148 | RTA00001067F.i.17.1 | M00022413B:D07 |
| 9653 | Oct. 8, 1998 | 1495.001 | 149 | RTA00001079F.l.19.1 | M00022278C:E04 |
| 9654 | Oct. 8, 1998 | 1495.001 | 150 | RTA00001081F.l.12.2 | M00022923A:A09 |
| 9655 | Oct. 8, 1998 | 1495.001 | 151 | RTA00001067F.j.03.1 | M00022420B:C08 |
| 9656 | Oct. 8, 1998 | 1495.001 | 152 | RTA00001068F.d.19.1 | M00022898B:H07 |
| 9657 | Oct. 8, 1998 | 1495.001 | 153 | RTA00001081F.g.23.1 | M00022853D:C05 |
| 9658 | Oct. 8, 1998 | 1495.001 | 154 | RTA00001081F.h.16.1 | M00022860A:A07 |
| 9659 | Oct. 8, 1998 | 1495.001 | 155 | RTA00001079F.i.05.1 | M00022192B:H07 |
| 9660 | Oct. 8, 1998 | 1495.001 | 156 | RTA00001068F.f.12.1 | M00023012A:C06 |
| 9661 | Oct. 8, 1998 | 1495.001 | 157 | RTA00001067F.e.09.1 | M00022235D:F07 |
| 9662 | Oct. 8, 1998 | 1495.001 | 158 | RTA00001066F.m.10.1 | M00022018B:E09 |
| 9663 | Oct. 8, 1998 | 1495.001 | 159 | RTA00001080F.j.19.1 | M00022591C:F03 |
| 9664 | Oct. 8, 1998 | 1495.001 | 160 | RTA00001080F.f.07.1 | M00022513B:G04 |
| 9665 | Oct. 8, 1998 | 1495.001 | 161 | RTA00001080F.e.09.1 | M00022500B:D01 |
| 9666 | Oct. 8, 1998 | 1495.001 | 162 | RTA00001080F.e.19.1 | M00022509D:A12 |
| 9667 | Oct. 8, 1998 | 1495.001 | 163 | RTA00001066F.a.13.1 | M00007948B:B07 |
| 9668 | Oct. 8, 1998 | 1495.001 | 164 | RTA00001079F.p.14.1 | M00022407D:G07 |
| 9669 | Oct. 8, 1998 | 1495.001 | 165 | RTA00001079F.p.03.1 | M00022399C:B02 |
| 9670 | Oct. 8, 1998 | 1495.001 | 166 | RTA00001079F.n.22.1 | M00022381B:C12 |
| 9671 | Oct. 8, 1998 | 1495.001 | 167 | RTA00001078F.a.06.1 | M00007937C:E08 |
| 9672 | Oct. 8, 1998 | 1495.001 | 168 | RTA00001078F.a.19.1 | M00007973D:B03 |
| 9673 | Oct. 8, 1998 | 1495.001 | 169 | RTA00001078F.b.15.1 | M00008000D:B06 |
| 9674 | Oct. 8, 1998 | 1495.001 | 170 | RTA00001079F.c.15.1 | M00022078B:B04 |
| 9675 | Oct. 8, 1998 | 1495.001 | 171 | RTA00001079F.d.06.1 | M00022088B:E05 |
| 9676 | Oct. 8, 1998 | 1495.001 | 172 | RTA00001067F.a.05.1 | M00022118A:D08 |
| 9677 | Oct. 8, 1998 | 1495.001 | 173 | RTA00001078F.i.15.2 | M00021668D:G09 |
| 9678 | Oct. 8, 1998 | 1495.001 | 174 | RTA00001066F.a.11.1 | M00007947B:F07 |
| 9679 | Oct. 8, 1998 | 1495.001 | 175 | RTA00001078F.k.02.2 | M00021846B:F05 |
| 9680 | Oct. 8, 1998 | 1495.001 | 176 | RTA00001066F.h.04.1 | M00021669B:G02 |
| 9681 | Oct. 8, 1998 | 1495.001 | 177 | RTA00001066F.c.21.1 | M00008015B:D08 |
| 9682 | Oct. 8, 1998 | 1495.001 | 178 | RTA00001080F.h.06.1 | M00022544C:D08 |
| 9683 | Oct. 8, 1998 | 1495.001 | 179 | RTA00001067F.c.16.1 | M00022177D:G02 |
| 9684 | Oct. 8, 1998 | 1495.001 | 180 | RTA00001080F.f.21.1 | M00022522B:A05 |
| 9685 | Oct. 8, 1998 | 1495.001 | 181 | RTA00001080F.a.10.1 | M00022425A:F11 |
| 9686 | Oct. 8, 1998 | 1495.001 | 182 | RTA00001081F.o.10.1 | M00023034B:B10 |
| 9687 | Oct. 8, 1998 | 1495.001 | 183 | RTA00001078F.b.17.1 | M00008001A:G11 |
| 9688 | Oct. 8, 1998 | 1495.001 | 184 | RTA00001078F.g.04.1 | M00008094D:C02 |
| 9689 | Oct. 8, 1998 | 1495.001 | 185 | RTA00001080F.p.05.1 | M00022704A:H08 |
| 9690 | Oct. 8, 1998 | 1495.001 | 186 | RTA00001067F.f.04.1 | M00022256D:G11 |
| 9691 | Oct. 8, 1998 | 1495.001 | 187 | RTA00001066F.c.11.1 | M00008003B:F09 |
| 9692 | Oct. 8, 1998 | 1495.001 | 188 | RTA00001081F.b.19.1 | M00022743C:G05 |
| 9693 | Oct. 8, 1998 | 1495.001 | 189 | RTA00001081F.p.14.1 | M00023097C:D10 |
| 9694 | Oct. 8, 1998 | 1495.001 | 190 | RTA00001067F.k.16.1 | M00022467C:H07 |
| 9695 | Oct. 8, 1998 | 1495.001 | 191 | RTA00001081F.b.11.1 | M00022737D:B02 |
| 9696 | Oct. 8, 1998 | 1495.001 | 192 | RTA00001080F.k.12.1 | M00022601A:A09 |
| 9697 | Oct. 8, 1998 | 1495.001 | 193 | RTA00001066F.a.08.1 | M00007943C:B02 |
| 9698 | Oct. 8, 1998 | 1495.001 | 194 | RTA00001081F.b.10.1 | M00022737B:F12 |
| 9699 | Oct. 8, 1998 | 1495.001 | 195 | RTA00001080F.d.15.1 | M00022488C:H02 |
| 9700 | Oct. 8, 1998 | 1495.001 | 196 | RTA00001079F.p.04.1 | M00022399D:A07 |
| 9701 | Oct. 8, 1998 | 1495.001 | 197 | RTA00001067F.e.23.1 | M00022251A:F07 |
| 9702 | Oct. 8, 1998 | 1495.001 | 198 | RTA00001068F.a.08.1 | M00022684C:C12 |
| 9703 | Oct. 8, 1998 | 1495.001 | 199 | RTA00001078F.h.16.1 | M00021628C:B09 |
| 9704 | Oct. 8, 1998 | 1495.001 | 200 | RTA00001081F.g.18.1 | M00022848D:H09 |
| 9705 | Oct. 8, 1998 | 1495.001 | 201 | RTA00001081F.m.15.1 | M00022968D:G06 |
| 9706 | Oct. 8, 1998 | 1495.001 | 202 | RTA00001067F.k.09.1 | M00022459C:G05 |
| 9707 | Oct. 8, 1998 | 1495.001 | 203 | RTA00001080F.g.04.1 | M00022527B:H05 |
| 9708 | Oct. 8, 1998 | 1495.001 | 204 | RTA00001081F.j.19.2 | M00022902C:F11 |
| 9709 | Oct. 8, 1998 | 1495.001 | 205 | RTA00001081F.o.03.1 | M00023023B:A05 |
| 9710 | Oct. 8, 1998 | 1495.001 | 206 | RTA00001079F.b.23.1 | M00022067A:B03 |
| 9711 | Oct. 8, 1998 | 1495.001 | 207 | RTA00001078F.n.16.2 | M00021951B:A01 |
| 9712 | Oct. 8, 1998 | 1495.001 | 208 | RTA00001067F.b.01.1 | M00022134D:D12 |
| 9713 | Oct. 8, 1998 | 1495.001 | 209 | RTA00001080F.a.17.1 | M00022435C:C05 |

TABLE 69A-continued

Priority Appln Information

| SEQ ID NO: | Filed | Dkt NO. | SEQ ID NO: | Sequence Name | Clone Name |
|---|---|---|---|---|---|
| 9714 | Oct. 8, 1998 | 1495.001 | 210 | RTA00001080F.c.17.1 | M00022469A:A05 |
| 9715 | Oct. 8, 1998 | 1495.001 | 211 | RTA00001068F.f.10.1 | M00023003C:C10 |
| 9716 | Oct. 8, 1998 | 1495.001 | 212 | RTA00001081F.h.18.1 | M00022861C:B04 |
| 9717 | Oct. 8, 1998 | 1495.001 | 213 | RTA00001066F.p.19.1 | M00022106D:B06 |
| 9718 | Oct. 8, 1998 | 1495.001 | 214 | RTA00001080F.c.09.1 | M00022464D:F12 |
| 9719 | Oct. 8, 1998 | 1495.001 | 215 | RTA00001078F.c.12.1 | M00008014C:H01 |
| 9720 | Oct. 8, 1998 | 1495.001 | 216 | RTA00001080F.l.10.1 | M00022622A:E08 |
| 9721 | Oct. 8, 1998 | 1495.001 | 217 | RTA00001078F.g.11.1 | M00008099A:C12 |
| 9722 | Oct. 8, 1998 | 1495.001 | 218 | RTA00001068F.f.09.1 | M00023003A:H01 |
| 9723 | Oct. 8, 1998 | 1495.001 | 219 | RTA00001067F.f.10.1 | M00022261C:D06 |
| 9724 | Oct. 8, 1998 | 1495.001 | 220 | RTA00001080F.o.05.1 | M00022687C:C11 |
| 9725 | Oct. 8, 1998 | 1495.001 | 221 | RTA00001078F.h.04.1 | M00021620D:B06 |
| 9726 | Oct. 8, 1998 | 1495.001 | 222 | RTA00001078F.p.03.2 | M00021981D:A11 |
| 9727 | Oct. 8, 1998 | 1495.001 | 223 | RTA00001080F.e.20.1 | M00022510A:B09 |
| 9728 | Oct. 8, 1998 | 1495.001 | 224 | RTA00001078F.k.19.2 | M00021861C:B08 |
| 9729 | Oct. 8, 1998 | 1495.001 | 225 | RTA00001078F.d.20.1 | M00008045A:B05 |
| 9730 | Oct. 8, 1998 | 1495.001 | 226 | RTA00001078F.b.22.1 | M00008006A:H02 |
| 9731 | Oct. 8, 1998 | 1495.001 | 227 | RTA00001068F.a.13.1 | M00022701C:A05 |
| 9732 | Oct. 8, 1998 | 1495.001 | 228 | RTA00001080F.m.16.1 | M00022641D:F08 |
| 9733 | Oct. 8, 1998 | 1495.001 | 229 | RTA00001080F.o.22.1 | M00022702A:D10 |
| 9734 | Oct. 8, 1998 | 1495.001 | 230 | RTA00001080F.k.16.1 | M00022604A:F06 |
| 9735 | Oct. 8, 1998 | 1495.001 | 231 | RTA00001067F.d.04.1 | M00022199A:F09 |
| 9736 | Oct. 8, 1998 | 1495.001 | 232 | RTA00001067F.k.10.1 | M00022460C:E12 |
| 9737 | Oct. 8, 1998 | 1495.001 | 233 | RTA00001078F.n.04.2 | M00021931B:F04 |
| 9738 | Oct. 8, 1998 | 1495.001 | 234 | RTA00001078F.n.07.2 | M00021945A:B04 |
| 9739 | Oct. 8, 1998 | 1495.001 | 235 | RTA00001081F.a.16.1 | M00022725D:G05 |
| 9740 | Oct. 8, 1998 | 1495.001 | 236 | RTA00001078F.l.13.2 | M00021879B:C11 |
| 9741 | Oct. 8, 1998 | 1495.001 | 237 | RTA00001078F.f.13.1 | M00008082B:C05 |
| 9742 | Oct. 8, 1998 | 1495.001 | 238 | RTA00001079F.d.05.1 | M00022087D:F12 |
| 9743 | Oct. 8, 1998 | 1495.001 | 239 | RTA00001067F.i.13.1 | M00022406C:G03 |
| 9744 | Oct. 8, 1998 | 1495.001 | 240 | RTA00001068F.d.23.1 | M00022902B:F10 |
| 9745 | Oct. 8, 1998 | 1495.001 | 241 | RTA00001078F.c.13.1 | M00008014D:A11 |
| 9746 | Oct. 8, 1998 | 1495.001 | 242 | RTA00001078F.a.18.1 | M00007969B:E10 |
| 9747 | Oct. 8, 1998 | 1495.001 | 243 | RTA00001068F.b.23.1 | M00022765B:E03 |
| 9748 | Oct. 8, 1998 | 1495.001 | 244 | RTA00001078F.f.21.1 | M00008085B:G01 |
| 9749 | Oct. 8, 1998 | 1495.001 | 245 | RTA00001067F.b.15.1 | M00022144D:D09 |
| 9750 | Oct. 8, 1998 | 1495.001 | 246 | RTA00001078F.o.04.2 | M00021963C:H04 |
| 9751 | Oct. 8, 1998 | 1495.001 | 247 | RTA00001081F.e.14.1 | M00022817D:B09 |
| 9752 | Oct. 8, 1998 | 1495.001 | 248 | RTA00001078F.k.04.2 | M00021847B:A09 |
| 9753 | Oct. 8, 1998 | 1495.001 | 249 | RTA00001079F.g.15.2 | M00022158C:C08 |
| 9754 | Oct. 8, 1998 | 1495.001 | 250 | RTA00001067F.k.23.1 | M00022477C:C07 |
| 9755 | Oct. 8, 1998 | 1495.001 | 251 | RTA00001079F.h.08.2 | M00022176A:F02 |
| 9756 | Oct. 8, 1998 | 1495.001 | 252 | RTA00001078F.d.17.1 | M00008028D:B01 |
| 9757 | Oct. 8, 1998 | 1495.001 | 253 | RTA00001067F.d.07.1 | M00022203B:A05 |
| 9758 | Oct. 8, 1998 | 1495.001 | 254 | RTA00001068F.e.04.1 | M00022903D:H02 |
| 9759 | Oct. 8, 1998 | 1495.001 | 255 | RTA00001068F.a.06.1 | M00022682A:F10 |
| 9760 | Oct. 8, 1998 | 1495.001 | 256 | RTA00001078F.e.10.1 | M00008054C:E07 |
| 9761 | Oct. 8, 1998 | 1495.001 | 257 | RTA00001079F.b.11.1 | M00022056B:G12 |
| 9762 | Oct. 8, 1998 | 1495.001 | 258 | RTA00001066F.h.11.1 | M00021676B:B12 |
| 9763 | Oct. 8, 1998 | 1495.001 | 259 | RTA00001079F.d.01.1 | M00022084B:C03 |
| 9764 | Oct. 8, 1998 | 1495.001 | 260 | RTA00001067F.g.14.1 | M00022363B:D03 |
| 9765 | Oct. 8, 1998 | 1495.001 | 261 | RTA00001066F.g.06.1 | M00021625B:G07 |
| 9766 | Oct. 8, 1998 | 1495.001 | 262 | RTA00001081F.j.09.2 | M00022893D:C06 |
| 9767 | Oct. 8, 1998 | 1495.001 | 263 | RTA00001068F.e.19.1 | M00022963A:E07 |
| 9768 | Oct. 8, 1998 | 1495.001 | 264 | RTA00001079F.l.21.1 | M00022282A:A11 |
| 9769 | Oct. 8, 1998 | 1495.001 | 265 | RTA00001078F.h.09.1 | M00021624B:E11 |
| 9770 | Oct. 8, 1998 | 1495.001 | 266 | RTA00001078F.d.16.1 | M00008027D:H09 |
| 9771 | Oct. 8, 1998 | 1495.001 | 267 | RTA00001079F.g.22.2 | M00022167B:H02 |
| 9772 | Oct. 8, 1998 | 1495.001 | 268 | RTA00001066F.e.15.1 | M00008075D:B01 |
| 9773 | Oct. 8, 1998 | 1495.001 | 269 | RTA00001080F.g.16.1 | M00022538D:B02 |
| 9774 | Oct. 8, 1998 | 1495.001 | 270 | RTA00001080F.b.07.1 | M00022447A:H06 |
| 9775 | Oct. 8, 1998 | 1495.001 | 271 | RTA00001078F.n.21.2 | M00021958A:A03 |
| 9776 | Oct. 8, 1998 | 1495.001 | 272 | RTA00001078F.b.12.1 | M00007998C:B04 |
| 9777 | Oct. 8, 1998 | 1495.001 | 273 | RTA00001066F.p.01.2 | M00022099C:A10 |
| 9778 | Oct. 8, 1998 | 1495.001 | 274 | RTA00001066F.o.22.1 | M00022095C:F03 |
| 9779 | Oct. 8, 1998 | 1495.001 | 275 | RTA00001080F.i.19.1 | M00022568B:D03 |
| 9780 | Oct. 8, 1998 | 1495.001 | 276 | RTA00001079F.g.01.1 | M00022138C:B07 |
| 9781 | Oct. 8, 1998 | 1495.001 | 277 | RTA00001079F.e.02.1 | M00022102D:A10 |
| 9782 | Oct. 8, 1998 | 1495.001 | 278 | RTA00001079F.k.01.1 | M00022233C:D11 |
| 9783 | Oct. 8, 1998 | 1495.001 | 279 | RTA00001079F.o.11.1 | M00022386D:C04 |
| 9784 | Oct. 8, 1998 | 1495.001 | 280 | RTA00001068F.d.02.1 | M00022834A:H02 |
| 9785 | Oct. 8, 1998 | 1495.001 | 281 | RTA00001078F.a.07.1 | M00007939A:F06 |
| 9786 | Oct. 8, 1998 | 1495.001 | 282 | RTA00001081F.b.20.1 | M00022743C:G06 |
| 9787 | Oct. 8, 1998 | 1495.001 | 283 | RTA00001067F.f.20.1 | M00022273A:B03 |
| 9788 | Oct. 8, 1998 | 1495.001 | 284 | RTA00001079F.c.06.1 | M00022072D:E12 |

TABLE 69A-continued

Priority Appln Information

| SEQ ID NO: | Filed | Dkt NO. | SEQ ID NO: | Sequence Name | Clone Name |
|---|---|---|---|---|---|
| 9789 | Oct. 8, 1998 | 1495.001 | 285 | RTA00001068F.b.24.1 | M00022768A:A10 |
| 9790 | Oct. 8, 1998 | 1495.001 | 286 | RTA00001080F.o.08.1 | M00022691A:G01 |
| 9791 | Oct. 8, 1998 | 1495.001 | 287 | RTA00001078F.j.10.2 | M00021687C:A04 |
| 9792 | Oct. 8, 1998 | 1495.001 | 288 | RTA00001080F.b.03.1 | M00022444B:C04 |
| 9793 | Oct. 8, 1998 | 1495.001 | 289 | RTA00001067F.e.13.1 | M00022240C:B03 |
| 9794 | Oct. 8, 1998 | 1495.001 | 290 | RTA00001081F.h.05.1 | M00022856A:B09 |
| 9795 | Oct. 8, 1998 | 1495.001 | 291 | RTA00001067F.f.01.1 | M00022252C:A04 |
| 9796 | Oct. 8, 1998 | 1495.001 | 292 | RTA00001080F.g.23.1 | M00022542A:B06 |
| 9797 | Oct. 8, 1998 | 1495.001 | 293 | RTA00001080F.h.16.1 | M00022548A:F02 |
| 9798 | Oct. 8, 1998 | 1495.001 | 294 | RTA00001080F.f.15.1 | M00022517C:B01 |
| 9799 | Oct. 8, 1998 | 1495.001 | 295 | RTA00001080F.f.06.1 | M00022513C:E10 |
| 9800 | Oct. 8, 1998 | 1495.001 | 296 | RTA00001081F.a.04.2 | M00022716A:C01 |
| 9801 | Oct. 8, 1998 | 1495.001 | 297 | RTA00001078F.p.16.2 | M00022001B:H10 |
| 9802 | Oct. 8, 1998 | 1495.001 | 298 | RTA00001081F.b.03.1 | M00022734C:A03 |
| 9803 | Oct. 8, 1998 | 1495.001 | 299 | RTA00001080F.a.21.1 | M00022441B:A06 |
| 9804 | Oct. 8, 1998 | 1495.001 | 300 | RTA00001079F.f.05.1 | M00022127C:E01 |
| 9805 | Oct. 8, 1998 | 1495.001 | 301 | RTA00001080F.n.23.1 | M00022681D:H10 |
| 9806 | Oct. 8, 1998 | 1495.001 | 302 | RTA00001078F.c.18.1 | M00008016C:E06 |
| 9807 | Oct. 8, 1998 | 1495.001 | 303 | RTA00001068F.a.11.1 | M00022697A:C08 |
| 9808 | Oct. 8, 1998 | 1495.001 | 304 | RTA00001068F.g.09.1 | M00023095C:A09 |
| 9809 | Oct. 8, 1998 | 1495.001 | 305 | RTA00001068F.a.22.1 | M00022709A:C01 |
| 9810 | Oct. 8, 1998 | 1495.001 | 306 | RTA00001079F.h.09.2 | M00022176D:F05 |
| 9811 | Oct. 8, 1998 | 1495.001 | 307 | RTA00001079F.h.01.2 | M00022169A:E11 |
| 9812 | Oct. 8, 1998 | 1495.001 | 308 | RTA00001078F.g.07.1 | M00008097C:E04 |
| 9813 | Oct. 8, 1998 | 1495.001 | 309 | RTA00001078F.m.08.2 | M00021908B:F03 |
| 9814 | Oct. 8, 1998 | 1495.001 | 310 | RTA00001080F.a.03.1 | M00022417B:C01 |
| 9815 | Oct. 8, 1998 | 1495.001 | 311 | RTA00001079F.o.06.1 | M00022384B:E06 |
| 9816 | Oct. 8, 1998 | 1495.001 | 312 | RTA00001079F.p.06.1 | M00022401C:G07 |
| 9817 | Oct. 8, 1998 | 1495.001 | 313 | RTA00001078F.p.18.2 | M00022001D:E06 |
| 9818 | Oct. 8, 1998 | 1495.001 | 314 | RTA00001068F.a.17.1 | M00022705B:F08 |
| 9819 | Oct. 8, 1998 | 1495.001 | 315 | RTA00001078F.a.10.1 | M00007948C:G01 |
| 9820 | Oct. 8, 1998 | 1495.001 | 316 | RTA00001079F.h.20.2 | M00022184D:H07 |
| 9821 | Oct. 8, 1998 | 1495.001 | 317 | RTA00001081F.n.03.1 | M00022986B:C02 |
| 9822 | Oct. 8, 1998 | 1495.001 | 318 | RTA00001080F.c.04.1 | M00022460D:C07 |

Example 46

Results of Public Database Search to Identify Function of Gene Products

SEQ ID NOS:8841-9919 were translated in all three reading frames, and the nucleotide sequences and translated amino acid sequences used as query sequences to search for homologous sequences in either the GenBank (nucleotide sequences) or Non-Redundant Protein (amino acid sequences) databases. Query and individual sequences were aligned using the BLAST 2.0 programs, available over the world wide web. (see also Altschul, et al. *Nucleic Acids Res*. (1997) 25:3389-3402). The sequences were masked to various extents to prevent searching of repetitive sequences or poly-A sequences, using the XBLAST program for masking low complexity as described above.

Tables 70A and 70B (inserted before the claims) provide the alignment summaries having a p value of $1 \times 10^{-2}$ or less indicating substantial homology between the sequences of the present invention and those of the indicated public databases. Table 70A provides the SEQ ID NO of the query sequence, the accession number of the GenBank database entry of the homologous sequence, and the p value of the alignment. Table 70A provides the SEQ ID NO of the query sequence, the accession number of the Non-Redundant Protein database entry of the homologous sequence, and the p value of the alignment. The alignments provided in Tables 70A and 70B are the best available alignment to a DNA or amino acid sequence at a time just prior to filing of the present specification. The activity of the polypeptide encoded by the SEQ ID NOS listed in Tables 70A and 70B can be extrapolated to be substantially the same or substantially similar to the activity of the reported nearest neighbor or closely related sequence. The accession number of the nearest neighbor is reported, providing a publicly available reference to the activities and functions exhibited by the nearest neighbor. The public information regarding the activities and functions of each of the nearest neighbor sequences is incorporated by reference in this application. Also incorporated by reference is all publicly available information regarding the sequence, as well as the putative and actual activities and functions of the nearest neighbor sequences listed in Table 70 and their related sequences. The search program and database used for the alignment, as well as the calculation of the p value are also indicated.

Full length sequences or fragments of the polynucleotide sequences of the nearest neighbors can be used as probes and primers to identify and isolate the full length sequence of the corresponding polynucleotide. The nearest neighbors can indicate a tissue or cell type to be used to construct a library for the full-length sequences of the corresponding polynucleotides.

Example 47

Identification of Contiguous Sequences Having a Polynucleotide of the Invention

The novel polynucleotides were used to screen publicly available and proprietary databases to determine if any of the polynucleotides of SEQ ID NOS:8841-9785 would facilitate identification of a contiguous sequence, e.g., the polynucleotides would provide sequence that would result in 5' extension of another DNA sequence, resulting in production of a longer contiguous sequence composed of the provided polynucleotide and the other DNA sequence(s). Contiging was performed using the Gelmerge application (default settings) of GCG from the Univ. of Wisconsin.

Using these parameters, 83 contiged sequences were generated. These contiged sequences are provided as SEQ ID NOS:9800-9882 (see Table 69C). Table 69C provides the SEQ ID NO of the contig sequence, the name of the sequence used to create the contig, and the accession number of the publicly available tentative human consensus (THC) sequence used with the sequence of the corresponding sequence name to provide the contig. The sequence name of Table 69C can be correlated with the SEQ ID NO: of the polynucleotide used to generate the contig by referring to Tables 69A and 69B.

The contiged sequences (SEQ ID NOS: 9800-9882) represent longer sequences that encompass another of the polynucleotide sequence of the invention. The contiged sequences were then translated in all three reading frames to determine the best alignment with individual sequences using the BLAST programs as described above. The sequences were masked using the XBLAST program for masking low complexity as described above. As described in more detail below, several of the contiged sequences were found to encode polypeptides having characteristics of a polypeptide belonging to a known protein families (and thus represent new members of these protein families) and/or comprising a known functional domain (see Example 4 and Table 71 below). Thus the invention encompasses fragments, fusions, and variants of such polynucleotides that retain biological activity associated with the protein family and/or functional domain identified herein.

Example 48

Members of Protein Families

SEQ ID NOS:8841-9919 were used to conduct a profile search as described in the specification above. Several of the polynucleotides of the invention were found to encode polypeptides having characteristics of a polypeptide belonging to a known protein family (and thus represent members of these protein families) and/or comprising a known functional domain. Table 71 (inserted before claims) provides the SEQ ID NO: of the query sequence, a brief description of the profile hit, the position of the query sequence within the individual sequence (indicated as "start" and "stop"), and the orientation (Direction, "Dir") of the query sequence with respect to the individual sequence, where forward (for) indicates that the alignment is in the same direction (left to right) as the sequence provided in the Sequence Listing and reverse (rev) indicates that the alignment is with a sequence complementary to the sequence provided in the Sequence Listing.

Some polynucleotides exhibited multiple profile hits where the query sequence contains overlapping profile regions, and/or where the sequence contains two different functional domains. Each of the profile hits of Table 71 are described in more detail below. The acronyms for the profiles (provided in parentheses) are those used to identify the profile in the Pfam and Prosite databases. The public information available on the Pfam and Prosite databases regarding the various profiles, including but not limited to the activities, function, and consensus sequences of various proteins families and protein domains, is incorporated herein by reference.

TABLE 71

| SEQ ID NO: | Profilename | Start | Stop | Direction |
|---|---|---|---|---|
| 8937 | Kazal | 25 | 243 | for |
| 9067 | helicase_C | 212 | 389 | for |
| 9082 | EFhand | 275 | 310 | for |
| 9290 | SH3 | 44 | 226 | for |
| 9313 | Zincfing_C2H2 | 211 | 273 | for |
| 9345 | WD_domain | 80 | 178 | for |
| 9352 | Zincfing_C2H2 | 147 | 209 | for |
| 9363 | PDZ | 168 | 395 | for |
| 9367 | ras | 18 | 395 | for |
| 9385 | ANK | 311 | 393 | for |
| 9387 | Ets_Nterm | 7 | 237 | for |
| 9446 | WW_domain | 120 | 209 | for |
| 9475 | protkinase | 47 | 400 | for |
| 9475 | mkk | 41 | 394 | for |
| 9476 | trypsin | 147 | 381 | for |
| 9480 | Zincfing_C2H2 | 122 | 184 | for |
| 9533 | Zincfing_CCHC | 135 | 185 | for |
| 9561 | WD_domain | 18 | 116 | for |
| 9645 | Zincfing_C3HC4 | 263 | 406 | for |
| 9758 | BZIP | 51 | 224 | for |
| 9759 | Zincfing_C2H2 | 125 | 187 | for |
| 9765 | FKH | 9 | 230 | for |
| 9811 | Zincfing_C2H2 | 202 | 264 | for |
| 9813 | Zincfing_CCHC | 262 | 309 | for |
| 9820 | PDZ | 241 | 468 | for |
| 9832 | mkk | 0 | 708 | for |
| 9832 | protkinase | 121 | 711 | for |
| 9835 | trypsin | 202 | 760 | for |
| 9824 | trypsin | 202 | 760 | for |
| 9858 | WD_domain | 18 | 116 | for |
| 9868 | pr55 | 24 | 1293 | for |
| 9875 | ATPases | 74 | 616 | for |
| 9876 | Zincfing_C2H2 | 122 | 184 | for |
| 9893 | 14_3_3 | 63 | 619 | for |
| 9898 | helicase_C | 212 | 448 | for |
| 9898 | ATPases | 59 | 442 | for |
| 9903 | Zincfing_C2H2 | 211 | 273 | for |
| 9906 | Zincfing_C2H2 | 125 | 187 | for |
| 9912 | ATPases | 808 | 1284 | for |
| 9918 | protkinase | 309 | 1022 | rev |
| 9918 | neur_chan | 12 | 508 | rev |
| 9918 | Zincfing_CCHC | 262 | 309 | for |
| 9918 | Zincfing_C3HC4 | 557 | 679 | for |

14-3-3 Family (14_3_3; Pfam Pfam Accession No. PF00244). One SEQ ID NO corresponds to a sequence encoding a 14-3-3 protein family member. The 14-3-3 protein family includes a group of closely related acidic homodimeric proteins of about 30 kD first identified as very abundant in mammalian brain tissues and located preferentially in neurons (Aitken et al. *Trends Biochem. Sci.* (1995) 20:95-97; Morrison *Science* (1994) 266:56-57; and Xiao et al. *Nature* (1995) 376:188-191). The 14-3-3 proteins have multiple biological activities, including a key role in signal transduction pathways and the cell cycle. 14-3-3 proteins interact with kinases (e.g., PKC or Raf-1), and can also function as protein-kinase dependent activators of tyrosine and tryptophan hydroxylases. The 14-3-3 protein sequences are extremely well conserved, and include two highly conserved regions: the first is a peptide of 11 residues located in the N-terminal section; the second, a 20 amino acid region located in the C-terminal section.

Ank Repeats (ANK; Pfam Accession No. PF0023). One SEQ ID NO represents a polynucleotide encoding an Ank repeat-containing protein. The ankyrin motif is a 33 amino acid sequence named after the protein ankyrin which has 24 tandem 33-amino-acid motifs. Ank repeats were originally identified in the cell-cycle-control protein cdc10 (Breeden et al., *Nature* (1987) 329:651). Proteins containing ankyrin repeats include ankyrin, myotropin, I-kappaB proteins, cell cycle protein cdc10, the Notch receptor (Matsuno et al.,

*Development* (1997) 124(21):4265); G9a (or BAT8) of the class III region of the major histocompatibility complex (Biochem J. 290:811-818, 1993), FABP, GABP, 53BP2, Lin12, glp-1, SW14, and SW16. The functions of the ankyrin repeats are compatible with a role in protein-protein interactions (Bork, *Proteins* (1993) 17(4):363; Lambert and Bennet, *Eur. J. Biochem.* (1993) 211:1; Kerr et al., *Current Op. Cell Biol.* (1992) 4:496; Bennet et al., *J. Biol. Chem.* (1980) 255:6424).

ATPases Associated with Various Cellular Activities (ATPases; Pfam Accession No. PF0004). Some SEQ ID NOS correspond to a sequence that encodes a member of a family of ATPases Associated with diverse cellular Activities (AAA). The AAA protein family is composed of a large number of ATPases that share a conserved region of about 220 amino acids containing an ATP-binding site (Froehlich et al, *J. Cell Biol.* (1991) 114:443; Erdmann et al. *Cell* (1991) 64:499; Peters et al., *EMBO J.* (1990) 9:1757; Kunau et al., *Biochimie* (1993) 75:209-224; Confalonieri et al., *BioEssays* (1995) 17:639). The AAA domain, which can be present in one or two copies, acts as an ATP-dependent protein clamp (Confalonieri et al. (1995) *BioEssays* 17:639) and contains a highly conserved region located in the central part of the domain.

Basic Region Plus Leucine Zipper Transcription Factors (BZIP; Pfam Accession No. PF00170). One SEQ ID NO represents a polynucleotide encoding a novel member of the family of basic region plus leucine zipper transcription factors. The bZIP superfamily (Hurst, *Protein Prof.* (1995) 2:105; and Ellenberger, *Curr. Opin. Struct. Biol.* (1994) 4:12) of eukaryotic DNA-binding transcription factors encompasses proteins that contain a basic region mediating sequence-specific DNA-binding followed by a leucine zipper required for dimerization.

EF Hand (Efhand; Pfam Accession No. PF00036). One SEQ ID NO corresponds to a polynucleotide encoding a member of the EF-hand protein family, a calcium binding domain shared by many calcium-binding proteins belonging to the same evolutionary family (Kawasaki et al., *Protein. Prof.* (1995) 2:305-490). The domain is a twelve residue loop flanked on both sides by a twelve residue alpha-helical domain, with a calcium ion coordinated in a pentagonal bipyramidal configuration. The six residues involved in the binding are in positions 1, 3, 5, 7, 9 and 12; these residues are denoted by X, Y, Z, −Y, −X and −Z. The invariant Glu or Asp at position 12 provides two oxygens for liganding Ca (bidentate ligand).

Ets Domain (Ets_Nterm; Pfam Accession No. PF110178). One SEQ ID NO, and thus the sequence it validates, represents a polynucleotide encoding a polypeptide with N-terminal homology in ETS domain. Proteins of this family contain a conserved domain, the "ETS-domain," that is involved in DNA binding. The domain appears to recognize purine-rich sequences; it is about 85 to 90 amino acids in length, and is rich in aromatic and positively charged residues (Wasylyk, et al., *Eur. J. Biochem.* (1993) 211:718). The ets gene family encodes a novel class of DNA-binding proteins, each of which binds a specific DNA sequence and comprises an ets domain that specifically interacts with sequences containing the common core tri-nucleotide sequence GGA. In addition to an ets domain, native ets proteins comprise other sequences which can modulate the biological specificity of the protein. Ets genes and proteins are involved in a variety of essential biological processes including cell growth, differentiation and development, and three members are implicated in oncogenic process.

(FKH; Pfam Accession No. PF00250). One SEQ. ID NO corresponds to a gene encoding a polypeptide comprising a forkhead domain. The forkhead domain (also known as a "winged helix") is present in a family of eukaryotic transcription factors, and is a conserved domain of about 100 amino acid residues that is involved in DNA-binding (Weigel et al. *Cell* (1990) 63:455-456; Clark et al. *Nature* (1993) 364:412-420). Mammalian genes that comprise a forkhead domain include those encoding: 1) transcriptional activators (e.g., HNF-3-alpha, -beta, and -gamma proteins, which interact with the cis-acting regulatory regions of a number of liver genes); 2) interleukin-enhancer binding factor (ILF), which binds to purine-rich NFAT-like motifs in the HIV-1 LTR and the interleukin-2 promoter and is involved in both positive and negative regulation of important viral and cellular promoter elements; 3) transcription factor BF-1, which plays an important role in the establishment of the regional subdivision of the developing-brain and in the development of the telencephalon; 4) human HTLF, which binds to the purine-rich region in human T-cell leukemia virus long terminal repeat (HTLV-I LTR); 5) transcription factors FREAC-1 (FKHL5, HFH-8), FREAC-2 (FKHL6), FREAC-3 (FKHL7, FKH-1), FREAC-4 (FKHL8), FREAC-5 (FKHL9, FKH-2, HFH-6), FREAC-6 (FKHL10, HFH-5), FREAC-7 (FKHL11), FREAC-8 (FKHL12, HFH-7), FKH-3, FKH-4, FKH-5, HFH-1 and HFH-4; 6) human AFX1 which is involved in a chromosomal translocation that causes acute leukemia; and 7) human FKHR which is involved in a chromosomal translocation that causes rhabdomyosarcoma. The fork domain is highly conserved, and is detected by two consensus patterns: the first corresponding to the N-terminal section of the domain; the second corresponding to a heptapeptide located in the central section of the domain.

Helicases conserved C-terminal domain (helicase C; Pfam Accession No. PF00271). Some SEQ ID NOS represent polynucleotides encoding novel members of the DEAD/H helicase family. The DEAD box family comprises a number of eukaryotic and prokaryotic proteins involved in ATP-dependent, nucleic-acid unwinding. All DEAD box family members of the above proteins share a number of conserved sequence motifs, some of which are specific to the DEAD family while others are shared by other ATP-binding proteins or by proteins belonging to the helicases 'superfamily' (Hodgman, Nature (1988) 333:22 and Nature (1988) 333:578; see worldwide web site at expasy.ch/www/linder/-HELICASES_TEXT.html). One of these motifs, called the 'D-E-A-D-box', represents a special version of the B motif of ATP-binding proteins. Some other proteins belong to a subfamily which have His instead of the second Asp and are thus said to be 'D-E-A-H-box' proteins (Wassarman D. A., et al., Nature (1991) 349:463; Harosh I., et al., Nucleic Acids Res. (1991) 19:6331; Koonin E. V., et al., J. Gen. Virol. (1992) 73:989).

Kazal serine protease inhibitors family signature (Kazal; Pfam Accession No. PF00050). One SEQ ID NO corresponds to a polynucleotide of a gene encoding a serine protease inhibitor of the Kazal inhibitor family (Laskowski et al. *Annu. Rev. Biochem.* (1980) 49:593-626). The basic structure of Kazal serine protease inhibitors such a type of inhibitor is described at Pfam Accession No. PF00050. Exemplary proteins known to belong to this family include: pancreatic secretory trypsin inhibitor (PSTI), whose physiological function is to prevent the trypsin-catalyzed premature activation of zymogens within the pancreas; mammalian seminal acrosin inhibitors; canidae and felidae submandibular gland double-headed protease inhibitors, which contain two Kazal-type domains, the first one inhibits trypsin and the second one elastase; a mouse prostatic secretory glycoprotein, induced by androgens, and which exhibits anti-trypsin activity; avian ovomucoids; chicken ovoinhibitor; and the leech trypsin inhibitor Bdellin B-3.

MAP kinase kinase (mkk). Some SEQ ID NOS represent members of the MAP kinase kinase (mkk) family. MAP kinases (MAPK) are involved in signal transduction, and are important in cell cycle and cell growth controls. The MAP kinase kinases (MAPKK) are dual-specificity protein kinases which phosphorylate and activate MAP kinases. MAPKK homologues have been found in yeast, invertebrates, amphibians, and mammals. Moreover, the MAPKK/MAPK phosphorylation switch constitutes a basic module activated in distinct pathways in yeast and in vertebrates. MAPKKs are essential transducers through which signals must pass before reaching the nucleus. For review, see, e.g., Biologique Biol Cell (1993) 79:193-207; Nishida et al., Trends Biochem Sci (1993) 18:128-31; Ruderman Curr Opin Cell Biol (1993) 5:207-13; Dhanasekaran et al., Oncogene (1998) 17:1447-55; Kiefer et al., Biochem Soc Trans (1997) 25:491-8; and Hill, Cell Signal (1996) 8:533-44.

Neurotransmitter-Gated Ion-Channel (neur_chan, Pfam Accession No. PF00065). One SEQ ID NO corresponds to a sequence encoding a neurotransmitter-gated ion channel. Neurotransmitter-gated ion-channels, which provide the molecular basis for rapid signal transmission at chemical synapses, are post-synaptic oligomeric transmembrane complexes that transiently form a ionic channel upon the binding of a specific neurotransmitter. Five types of neurotransmitter-gated receptors are known: 1) nicotinic acetylcholine receptor (AchR); 2) glycine receptor; 3) gamma-aminobutyric-acid (GABA) receptor; 4) serotonin 5HT3 receptor; and 5) glutamate receptor. All known sequences of subunits from neurotransmitter-gated ion-channels are structurally related, and are composed of a large extracellular glycosylated N-terminal ligand-binding domain, followed by three hydrophobic transmembrane regions that form the ionic channel, followed by an intracellular region of variable length. A fourth hydrophobic region is found at the C-terminal of the sequence.

PDZ Domain (PDZ; Pfam Accession No. PF00595.) Some SEQ ID NOS correspond to a gene comprising a PDZ domain (also known as DHR or GLGF domain). PDZ domains comprise 80-100 residue repeats, several of which interact with the C-terminal tetrapeptide motifs X-Ser/Thr-X-Val-COO- of ion channels and/or receptors, and are found in mammalian proteins as well as in bacteria, yeast, and plants (Pontig et al. Protein Sci (1997) 6(2):464-8). Proteins comprising one or more PDZ domains are found in diverse membrane-associated proteins, including members of the MAGUK family of guanylate kinase homologues, several protein phosphatases and kinases, neuronal nitric oxide synthase, and several dystrophin-associated proteins, collectively known as syntrophins (Ponting et al. Bioessays (1997) 19(6):469-79). Many PDZ domain-containing proteins are localised to highly specialised submembranous sites, suggesting their participation in cellular junction formation, receptor or channel clustering, and intracellular signalling events. For example, PDZ domains of several MAGUKs interact with the C-terminal polypeptides of a subset of NMDA receptor subunits and/or with Shaker-type K+ channels. Other PDZ domains have been shown to bind similar ligands of other transmembrane receptors. In cell junction-associated proteins, the PDZ mediates the clustering of membrane ion channels by binding to their C-terminus. The X-ray crystallographic structure of some proteins comrpising PDZ domains have been solved (see, e.g., Doyle et al. Cell (1996) 85(7):1067-76).

Protein phosphatase 2A regulatory subunit PR55 signatures (PR55; Pfam Accession No. PF01240). One SEQ ID NO corresponds to a gene encoding a protine phosphatase 2A regulatory subunit. Protein phosphatase 2A (PP2A) is a serine/threonine phosphatase involved in many aspects of cellular function including the regulation of metabolic enzymes and proteins involved in signal transduction. PP2A is a trimeric enzyme that consists of a core composed of a catalytic subunit associated with a 65 Kd regulatory subunit (PR65), also called subunit A; this complex then associates with a third variable subunit (subunit B), which confers distinct properties to the holoenzyme (Mayer et al. Trends Cell Biol. (1994) 4:287-291). One of the forms of the variable subunit is a 55 Kd protein (PR55) which is highly conserved in mammals (where three isoforms are known to exist). This subunit may perform a substrate recognition function or be responsible for targeting the enzyme complex to the appropriate subcellular compartment.

Protein Kinase (protkinase; Pfam Accession No. PF00069). Some SEQ ID NOS represent polynucleotides encoding protein kinases, which catalyze phosphorylation of proteins in a variety of pathways, and are implicated in cancer. Eukaryotic protein kinases (Hanks, et al., FASEB J. (1995) 9:576; Hunter, Meth. Enzymol. (1991) 200:3; Hanks, et al., Meth. Enzymol. (1991) 200:38; Hanks, Curr. Opin. Struct. Biol. (1991) 1:369; Hanks et al., Science (1988) 241: 42) belong to a very extensive family of proteins that share a conserved catalytic core common to both serine/threonine and tyrosine protein kinases. There are a number of conserved regions in the catalytic domain of protein kinases. The first region, located in the N-terminal extremity of the catalytic domain, is a glycine-rich stretch of residues in the vicinity of a lysine residue, which has been shown to be involved in ATP binding. The second region, located in the central part of the catalytic domain, contains a conserved an aspartic acid residue that is important for the catalytic activity of the enzyme (Knighton, et al., Science (1991) 253:407).

The protein kinase profile includes two signature patterns for this second region: one specific for serine/threonine kinases and the other for tyrosine kinases. A third profile is based on the alignment in (Hanks, et al., FASEB J. (1995) 9:576) and covers the entire catalytic domain.

Ras family proteins (ras; Pfam Accession No. PF00071). One SEQ ID NO represents polynucleotides encoding the ras family of small GTP/GDP-binding proteins (Valencia et al., 1991, Biochemistry 30:4637-4648). Ras family members generally require a specific guanine nucleotide exchange factor (GEF) and a specific GTPase activating protein (GAP) as stimulators of overall GTPase activity. Among ras-related proteins, the highest degree of sequence conservation is found in four regions that are directly involved in guanine nucleotide binding. The first two constitute most of the phosphate and Mg2+ binding site (PM site) and are located in the first half of the G-domain. The other two regions are involved in guanosine binding and are located in the C-terminal half of the molecule. Motifs and conserved structural features of the ras-related proteins are described in Valencia et al., 1991, Biochemistry 30:4637-4648.

Src homology domain 3 (SH3; Pfam Accession No. PF00018). One SEQ ID NO corresponds to a gene comprising a Src homology domain. The Src homology 3 (SH3) domain is a small protein domain of about 60 amino acid residues first identified as a conserved sequence in the non-catalytic part of several cytoplasmic protein tyrosine kinases (e.g. Src, Abl, Lck) (Mayer et al. Nature (1988) 332:272-275). Since then, it has been found in a great variety of other intracellular or membrane-associated proteins (Musacchio et al. FEBS Lett. (1992) 307:55-61; Pawson et al. Curr. Biol. (1993) 3:434-442; Mayer et al. Trends Cell Biol. (1993) 3:8-

13; Pawson *Nature* (1995) 373:573-580). The SH3 domain has a characteristic fold which consists of five or six beta-strands arranged as two tightly packed anti-parallel beta sheets. The linker regions may contain short helices (Kuriyan et al. *Curr. Opin. Struct. Biol.* (1993) 3:828-837). The SH3 domain is thought to mediate assembly of specific protein complexes via binding to proline-rich peptides (Morton et al. *Curr. Biol.* (1994) 4:615-617). In general SH3 domains are found as single copies in a given protein, but there a significant number of proteins comprise two SH3 domains and a few comprise 3 or 4 copies. The profile to detect SH3 domains is based on a structural alignment consisting of 5 gap-free blocks and 4 linker regions totaling 62 match positions.

Trypsin (trypsin; Pfam Accession No. PF00089). Some SEQ ID NOS correspond to novel serine proteases of the trypsin family. The catalytic activity of the serine proteases from the trypsin family is provided by a charge relay system involving an aspartic acid residue hydrogen-bonded to a histidine, which itself is hydrogen-bonded to a serine. The sequences in the vicinity of the active site serine and histidine residues are well conserved (Brenner *Nature* (1988) 334: 528).

WD Domain, G-Beta Repeats (WD_domain; Pfam Accession No. PF00400). Some SEQ ID NOS represent a members of the WD domain/G-beta repeat family. Beta-transducin (G-beta) is one of the three subunits (alpha, beta, and gamma) of the guanine nucleotide-binding proteins (G proteins) which act as intermediaries in the transduction of signals generated by transmembrane receptors (Gilman, *Annu. Rev. Biochem.* (1987) 56:615). The alpha subunit binds to and hydrolyzes GTP; the beta and gamma subunits are required for the replacement of GDP by GTP as well as for membrane anchoring and receptor recognition. In higher eukaryotes, G-beta exists as a small multigene family of highly conserved proteins of about 340 amino acid residues. Structurally, G-beta has eight tandem repeats of about 40 residues, each containing a central Trp-Asp motif (this type of repeat is sometimes called a WD-40 repeat).

WW/rsp5/WWP domain signature and profile (WW domain; Pfam Accession No. PF00397). One SEQ ID NO corresponds to a gene encoding a protein comprising a WW domain. The WW domain (Bork et al. *Trends Biochem. Sci.* (1994) 19:531-533; Andre et al. *Biochem. Biophys. Res. Commun.* (1994) 205:1201-1205; Hofmann et al. *FEBS Lett.* (1995) 358:153-157; Sudol et al. *FEBS Lett.* (1995) 369:67-71 (also known as rsp5 or WWP) was discovered as a short conserved region in a number of unrelated proteins, among them dystrophin, the gene responsible for Duchenne muscular dystrophy. The domain, which spans about 35 residues, is repeated up to 4 times in some proteins. It has been shown (Chen et al. *Proc. Natl. Acad. Sci. U.S.A.* (1995) 92:7819-7823) to bind proteins with particular proline-motifs, [AP]-P-P-[AP]-Y, and thus resembles somewhat SH3 domains. The WW domain conatins beta-strands grouped around four conserved aromatic positions, generally tryptophan. The name WW or WWP derives from the presence of two tryptophane as well as a conserved proline. The WW domain is frequently associated with other domains typical for proteins in signal transduction processes.

Zinc Finger, C2H2 Type (Zincfing_C2H2; Pfam Accession No. PF00096). Several sequences corresponded to polynucleotides encoding members of the C2H2 type zinc finger protein family, which contain zinc finger domains that facilitate nucleic acid binding (Klug et al., *Trends Biochem. Sci.* (1987) 12:464; Evans et al., *Cell* (1988) 52:1; Payre et al., *FEBS Lett.* (1988) 234:245; Miller et al., *EMBO J.* (1985) 4:1609; and Berg, *Proc. Natl. Acad. Sci. USA* (1988) 85:99).

In addition to the conserved zinc ligand residues, a number of other positions are also important for the structural integrity of the C2H2 zinc fingers. (Rosenfeld et al., *J. Biomol. Struct. Dyn.* (1993) 11:557) The best conserved position, which is generally an aromatic or aliphatic residue, is located four residues after the second cysteine.

Zinc finger, C3HC4 type (RING finger), signature (Zincfing_C3H4; Pfam Accession No. PF00097). Some SEQ ID NOS represent polynucleotides encoding a polypeptide having a C3HC4 type zinc finger signature. A number of eukaryotic and viral proteins contain this signature, which is primarily a conserved cysteine-rich domain of 40 to 60 residues (Borden K. L. B., et al., *Curr. Opin. Struct. Biol.* (1996) 6:395) that binds two atoms of zinc, and is probably involved in mediating protein-protein interactions. The 3D structure of the zinc ligation system is unique to the RING domain and is referred to as the "cross-brace" motif.

Zinc finger CCHC type (Zincfing_CCHC; Pfam Accession No. PF00098). Some SEQ ID NOS correspond to genes encoding a member of the family of CCHC zinc fingers. Because the prototype CCHC type zinc finger structure is from an HIV protein, this domain is also referred to as a retrovrial-type zinc finger domain. The family also contains proteins involved in eukaryotic gene regulation, such as *C. elegans* GLH-1. The structure is an 18-residue zinc finger; no examples of indels in the alignment. The motif that defines a CCHC type zinc finger domain is: C-X2-C-X4-H-X4-C (Summers J Cell Biochem 1991 January; 45(1):41-8). The domain is found in, for example, HIV-1 nucleocapsid protein, Moloney murine leukemia virus nucleocapsid protine NCp10 (De Rocquigny et al. *Nucleic Acids Res*. (1993) 21:823-9), and myelin transcription factor 1 (Myt1) (Kim et al. *J. Neurosci. Res*. (1997) 50:272-90).

Example 49

Differential Expression of Polynucleotides of the Invention: Description of Libraries and Detection of Differential Expression The relative expression levels of the polynucleotides of the invention was assessed in several libraries prepared from various sources, including cell lines and patient tissue samples. Table 72 provides a summary of these libraries, including the shortened library name (used hereafter), the mRNA source used to prepared the cDNA library, the "nickname" of the library that is used in the tables below (in quotes), and the approximate number of clones in the library.

TABLE 72

Description of cDNA Libraries

| Library (lib #) | Description | Number of Clones in Library |
|---|---|---|
| 1 | Human Colon Cell Line Km12 L4: High Metastatic Potential (derived from Km12C) | 308731 |
| 2 | Human Colon Cell Line Km12C: Low Metastatic Potential | 284771 |
| 3 | Human Breast Cancer Cell Line MDA-MB-231: High Metastatic Potential; micro-mets in lung | 326937 |
| 4 | Human Breast Cancer Cell Line MCF7: Non Metastatic | 318979 |
| 8 | Human Lung Cancer Cell Line MV-522: High Metastatic Potential | 223620 |

TABLE 72-continued

Description of cDNA Libraries

| Library (lib #) | Description | Number of Clones in Library |
|---|---|---|
| 9 | Human Lung Cancer Cell Line UCP-3: Low Metastatic Potential | 312503 |
| 12 | Human microvascular endothelial cells (HMVEC) - UNTREATED (PCR (OligodT) cDNA library) | 41938 |
| 13 | Human microvascular endothelial cells (HMVEC) - bFGF TREATED (PCR (OligodT) cDNA library) | 42100 |
| 14 | Human microvascular endothelial cells (HMVEC) - VEGF TREATED (PCR (OligodT) cDNA library) | 42825 |
| 15 | Normal Colon - UC#2 Patient (MICRODISSECTED PCR (OligodT) cDNA library) | 282722 |
| 16 | Colon Tumor - UC#2 Patient (MICRODISSECTED PCR (OligodT) cDNA library) | 298831 |
| 17 | Liver Metastasis from Colon Tumor of UC#2 Patient (MICRODISSECTED PCR (OligodT) cDNA library) | 303467 |
| 18 | Normal Colon - UC#3 Patient (MICRODISSECTED PCR (OligodT) cDNA library) | 36216 |
| 19 | Colon Tumor - UC#3 Patient (MICRODISSECTED PCR (OligodT) cDNA library) | 41388 |
| 20 | Liver Metastasis from Colon Tumor of UC#3 Patient (MICRODISSECTED PCR (OligodT) cDNA library) | 30956 |
| 21 | GRRpz Cells derived from normal prostate epithelium | 164801 |
| 22 | WOca Cells derived from Gleason Grade 4 prostate cancer epithelium | 162088 |
| 23 | Normal Lung Epithelium of Patient #1006 (MICRODISSECTED PCR (OligodT) cDNA library) | 306198 |
| 24 | Primary tumor, Large Cell Carcinoma of Patient #1006 (MICRODISSECTED PCR (OligodT) cDNA library) | 309349 |

The KM12L4, KM12C, and MDA-MB-231 cell lines are described in example 45 above. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., *Cancer Res.* (1979) 39:870 (MDA-MB-231 and MCF-7); Gastpar et al., *J Med Chem* (1998) 41:4965 (MDA-MB-231 and MCF-7); Ranson et al., *Br J Cancer* (1998) 77:1586 (MDA-MB-231 and MCF-7); Kuang et al., *Nucleic Acids Res* (1998) 26:1116 (MDA-MB-231 and MCF-7); Varki et al., *Int J Cancer* (1987) 40:46 (UCP-3); Varki et al., *Tumour Biol.* (1990) 11:327; (MV-522 and UCP-3); Varki et al., *Anticancer Res.* (1990) 10:637; (MV-522); Kelner et al., *Anticancer Res* (1995) 15:867 (MV-522); and Zhang et al., *Anticancer Drugs* (1997) 8:696 (MV522)). The samples of libraries 15-20 are derived from two different patients (UC#2, and UC#3). The bFGF-treated HMVEC were prepared by incubation with bFGF at 10 ng/ml for 2 hrs; the VEGF-treated HMVEC were prepared by incubation with 20 ng/ml VEGF for 2 hrs. Following incubation with the respective growth factor, the cells were washed and lysis buffer added for RNA preparation. The GRRpz and WOca cell lines were provided by Dr. Donna M. Peehl, Department of Medicine, Stanford University School of Medicine. GRRpz was derived from normal prostate epithelium. The WOca cell line is a Gleason Grade 4 cell line.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., *Genomics* (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences between Proportions," pp 296-298 (1974).

Examples 50-54

Differential Expression of Polynucleotides of the Invention

A number of polynucleotide sequences have been identified that are differentially expressed between, for example, cells derived, from high metastatic potential cancer tissue and low metastatic cancer cells, and between cells derived from metastatic cancer tissue and normal tissue. Evaluation of the levels of expression of the genes corresponding to these sequences can be valuable in diagnosis, prognosis, and/or treatment (e.g., to facilitate rationale design of therapy, monitoring during and after therapy, etc.). Moreover, the genes corresponding to differentially expressed sequences described herein can be therapeutic targets due to their involvement in regulation (e.g., inhibition or promotion) of development of, for example, the metastatic phenotype. For example, sequences that correspond to genes that are increased in expression in high metastatic potential cells relative to normal or non-metastatic tumor cells may encode genes or regulatory sequences involved in processes such as angiogenesis, differentiation, cell replication, and metastasis.

Detection of the relative expression levels of differentially expressed polynucleotides described herein can provide valuable information to guide the clinician in the choice of therapy. For example, a patient sample exhibiting an expression level of one or more of these polynucleotides that corresponds to a gene that is increased in expression in metastatic or high metastatic potential cells may warrant more aggressive treatment for the patient. In contrast, detection of expression levels of a polynucleotide sequence that corresponds to expression levels associated with that of low metastatic potential cells may warrant a more positive prognosis than the gross pathology would suggest.

A number of polynucleotide sequences of the present invention are differentially expressed between human microvascular endothelial cells (HMVEC) that have been treated with growth factors relative to untreated HMVEC. Sequences that are differentially expressed between growth factor-treated HMVEC and untreated HMVEC can represent sequences encoding gene products involved in angiogenesis, metastasis (cell migration), and other development and oncogenic processes. For example, sequences that are more highly expressed in HMVEC treated with growth factors (such as bFGF or VEGF) relative to untreated HMVEC can serve as drug targets for chemotherapeutics, e.g., decreasing expression of such up-regulated genes or inhibiting the activity of the encoded gene product would serve to inhibit tumor cell angiogenesis. Detection of expression of these sequences in colon cancer tissue can be valuable in determining diagnostic, prognostic and/or treatment information associated with the prevention of achieving the malignant state in these tissues, and can be important in risk assessment for a patient. A patient sample displaying an increased level of one or more of these polynucleotides may thus warrant closer attention or more frequent screening procedures to catch the malignant state as early as possible.

The differential expression of the polynucleotides described herein can thus be used as, for example, diagnostic markers, prognostic markers, for risk assessment, patient treatment and the like. These polynucleotide sequences can also be used in combination with other known molecular and/or biochemical markers. The following examples provide relative expression levels of polynucleotides from specified cell lines and patient tissue samples.

Example 50

High Metastatic Potential Breast Cancer Versus Low Metastatic Breast Cancer Cells The tables bellow summarize the data for polynucleotides that represent genes differentially expressed between high metastatic potential and low metastatic potential breast cancer cells.

TABLE 73

High metastatic potential breast (lib3) > low metastatic potential breast cancer cells (lib4)

| SEQ ID NO: | Lib 3 Clones | Lib4 Clones | Lib3/Lib4 |
|---|---|---|---|
| 9621 | 13 | 0 | 12.68 |
| 9618 | 9 | 0 | 8.78 |
| 9596 | 8 | 0 | 7.81 |
| 9619 | 7 | 0 | 6.83 |
| 9531 | 7 | 0 | 6.83 |
| 9526 | 7 | 0 | 6.83 |
| 9756 | 6 | 0 | 5.85 |

TABLE 74

Low metastatic potential breast (lib4) > high metastatic potential breast cancer cells (lib3)

| SEQ ID NO: | Lib 3 Clones | Lib4 Clones | Lib4/Lib3 |
|---|---|---|---|
| 9398 | 0 | 340 | 348.48 |
| 9496 | 0 | 64 | 65.6 |
| 9501 | 0 | 57 | 58.42 |
| 9487 | 0 | 43 | 44.07 |
| 9387 | 0 | 41 | 42.02 |
| 9488 | 0 | 40 | 41 |
| 9432 | 4 | 115 | 29.47 |
| 9494 | 0 | 28 | 28.7 |
| 9486 | 0 | 21 | 21.52 |
| 9476 | 3 | 61 | 20.84 |
| 9373 | 1 | 17 | 17.42 |
| 9389 | 0 | 17 | 17.42 |
| 9490 | 3 | 50 | 17.08 |
| 9429 | 0 | 16 | 16.4 |
| 8950 | 0 | 16 | 16.4 |
| 9497 | 0 | 16 | 16.4 |
| 9464 | 0 | 16 | 16.4 |
| 9477 | 0 | 13 | 13.32 |
| 9376 | 0 | 12 | 12.3 |
| 9493 | 1 | 11 | 11.27 |
| 9402 | 1 | 11 | 11.27 |
| 9427 | 1 | 11 | 11.27 |
| 9449 | 1 | 11 | 11.27 |
| 9430 | 0 | 10 | 10.25 |
| 9481 | 0 | 10 | 10.25 |
| 9372 | 1 | 10 | 10.25 |
| 9463 | 0 | 9 | 9.22 |
| 9431 | 0 | 8 | 8.2 |
| 9361 | 0 | 8 | 8.2 |
| 9054 | 0 | 7 | 7.17 |
| 9447 | 0 | 7 | 7.17 |
| 9394 | 0 | 7 | 7.17 |
| 9395 | 0 | 7 | 7.17 |
| 9422 | 0 | 7 | 7.17 |
| 9424 | 0 | 7 | 7.17 |
| 9439 | 0 | 7 | 7.17 |
| 9401 | 0 | 6 | 6.15 |
| 9412 | 0 | 6 | 6.15 |
| 9199 | 0 | 6 | 6.15 |
| 9475 | 0 | 6 | 6.15 |
| 8953 | 0 | 6 | 6.15 |
| 9443 | 0 | 6 | 6.15 |

Example 51

High Metastatic Potential Lung Cancer Versus Low Metastatic Lung Cancer Cells

The following summarizes polynucleotides that represent genes differentially expressed between high metastatic potential lung cancer cells and low metastatic potential lung cancer cells:

TABLE 75

High metastatic potential lung (lib8) > low metastatic potential lung cancer cells (lib9)

| SEQ ID NO: | Lib 8 Clones | Lib 9 Clones | Lib8/Lib9 |
|---|---|---|---|
| 9411 | 35 | 1 | 48.91 |
| 9809 | 8 | 0 | 11.18 |
| 9190 | 5 | 0 | 6.99 |

Example 52

High Metastatic Potential Colon Cancer Versus Low Metastatic Colon Cancer Cells Table 76 summarizes polynucleotides that represent genes differentially expressed between high metastatic potential and low metastatic potential colon cancer cells:

TABLE 76

Low metastatic potential colon (lib2) > high metastatic potential colon cancer cells (lib1)

| SEQ ID NO: | Lib1 Clones | Lib2 Clones | Lib2/Lib1 |
|---|---|---|---|
| 8897 | 0 | 8 | 8.67 |
| 8943 | 0 | 6 | 6.5 |
| 9029 | 0 | 6 | 6.5 |

Example 53

High Tumor Potential Colon Tissue Vs. Metastasized Colon Cancer Tissue

The following table summarizes polynucleotides that represent genes differentially expressed between high tumor potential colon cancer cells and cells derived from high metastatic potential colon cancer cells of a patient.

TABLE 77

High tumor potential colon tissue (lib16) vs. high metastatic colon tissue (lib17)

| SEQ ID NO: | Lib 16 | Lib 17 | Lib17/Lib16 |
|---|---|---|---|
| 8940 | 0 | 7 | 6.89 |
| 9210 | 3 | 12 | 3.94 |

Example 54

Differential Expression Across Multiple Libraries

A number of polynucleotide sequences have been identified that represent genes that are differentially expressed across multiple libraries. Expression of these sequences in a tissue or any origin can be valuable in determining diagnostic, prognostic and/or treatment information associated with the prevention of achieving the malignant state in these tissues, and can be important in risk assessment for a patient. These polynucleotides can also serve as non-tissue specific markers of, for example, risk of metastasis of a tumor. The differential expression data for these sequences is provided in Table 78 below.

TABLE 78

Genes Differentially Expressed Across Multiple Library Comparisons

| SEQ ID NO: | Cell or Tissue Sample and Cancer State Compared | RATIO |
|---|---|---|
| 8874 | Low Met Colon (lib2) > High Met Colon (lib1) | 8.67 |
| 8874 | High Met Breast (lib3) > Low Met Breast (Lib4) | 5.85 |
| 9049 | Low Met Lung (lib9) > High Met Lung (lib8) | 17.44 |
| 9049 | Colon Tumor Tissue (lib16) > Normal Colon Tissue (lib15) | 3.42 |
| 9049 | Colon Tumor Tissue (lib19) > Normal Colon Tissue (lib18) | 66.5 |
| 9049 | High Met Colon Tissue (lib20) > Normal Colon Tissue (lib18) | 14.04 |
| 9049 | Colon Tumor Tissue (lib19) > High Met Colon Tissue (lib20) | 4.74 |
| 9156 | High Met Colon (lib1) > Low Met Colon (lib2) | 5.76 |
| 9156 | Low Met Breast (lib4) > High Met Breast (Lib3) | 17.28 |
| 9485 | Low Met Breast (lib4) > High Met Breast (Lib3) | 6.15 |
| 9485 | High Met Lung (lib8) > Low Met Lung (lib9) | 19.56 |
| 9694 | High Met Breast (lib3) > Low Met Breast (Lib4) | 9.76 |
| 9694 | HMVEC-bFGF (lib13) > HMVEC (lib12) | 4.98 |
| 9694 | Lung Tumor Tissue (lib24) > Normal Lung Tissue (lib23) | 5.94 |

Key for Table 78:
High Met = high metastatic potential;
Low Met = low metastatic potential;
met = metastasized;
tumor = non-metastasized tumor;
HMVEC = human microvascular endothelial cell;
bFGF = bFGF treated.

Detection of expression of genes that correspond to the above polynucleotides may be of particular interest in diagnosis, prognosis, risk assesment, and monitoring of treatment. Furthermore, differential expression of a specific gene across multiple libraries can also be indicative of a gene whose expression is associated with, for example, suppression of the metastatic phenotype or with development of the cell toward a metastatic phenotype. For example, SEQ ID NO:9012 corresponds to a gene that is expressed at relatively higher levels in colon tumor tissue than in high metastatic potential colon tumor tissue, and at relatively higher levels in high metastatic potential colon tumor tissue than in normal colon tissue. Thus a relatively increased level of expression of the gene corresponding to SEQ ID NO:9012 may be used as marker of a pre-metastatic colon cells either alone or in combination with other markers.

Some polynucleotides exhibited opposite differential expression trends in libraries of different origin (see, e.g., SEQ ID NO:9119). These data suggest that the differential expression patterns of some gene associated with development of metastases indicate a unique role for those genes specific for the tissue of origin.

Those skilled in the art will recognize, or be able to ascertain, using not more than routine experimentation, many equivalents to the specific embodiments of the invention described herein. Such specific embodiments and equivalents are intended to be encompassed by the following claims.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

Deposit Information. The following materials were deposited with the American Type Culture Collection (CMCC=Chiron Master Culture Collection).

TABLE 79

Cell Lines Deposited Deposited with ATCC

| Cell Line | Deposit Date | ATCC Accession No. | CMCC Accession No. |
|---|---|---|---|
| KM12L4-A | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

In addition, pools of selected clones, as well as libraries containing specific clones, were assigned an "ES" number (internal reference) and deposited with the ATCC. Table 80 below provides the ATCC Accession Nos. of the ES deposits, all of which were deposited on or before May 13, 1999. The names of the clones contained within each of these deposits are provided in the tables 81 and 82.

TABLE 80

Pools of Clones and Libraries Deposited with ATCC on or before Sep. 23, 1999

| Library No. | CMCC No. | ATCC Deposit No. |
|---|---|---|
| ES55 | 5058 | PTA-739 |
| ES56 | 5059 | PTA-740 |
| ES57 | 5060 | PTA-741 |
| ES58 | 5061 | PTA-742 |
| ES59 | 5062 | PTA-743 |
| ES60 | 5063 | PTA-744 |
| ES61 | 5064 | PTA-745 |
| ES62 | 5065 | PTA-746 |
| ES63 | 5066 | PTA-747 |
| ES64 | 5067 | PTA-748 |
| ES65 | 5068 | PTA-749 |
| ES66 | 5069 | PTA-750 |
| ES67 | 5070 | PTA-751 |
| ES68 | 5071 | PTA-752 |
| ES69 | 5072 | PTA-753 |
| ES70 | 5073 | PTA-754 |
| ES71 | 5074 | PTA-755 |
| ES72 | 5075 | PTA-756 |
| ES73 | 5076 | PTA-757 |
| ES74 | 5077 | PTA-758 |

TABLE 81

| ES55 | ES56 | ES57 | ES58 |
|---|---|---|---|
| M00004170C:H06 | M00004036B:C11 | M00004288D:E07 | M00023298B:G07 |
| M00004170D:C06 | M00004064B:G03 | M00004318D:D07 | M00026819B:E02 |
| M00004171D:H10 | M00004067C:E05 | M00004356C:D02 | M00026914C:H10 |
| M00004174B:B12 | M00004099C:F04 | M00004391C:F12 | M00027023B:H12 |
| M00004175D:G10 | M00004103A:E06 | M00004386C:C03 | M00027085A:G10 |
| M00004176A:E07 | M00004128B:H11 | M00004414D:C11 | M00027248D:D01 |
| M00001352D:A09 | M00004167A:H04 | M00004422C:A01 | M00027546B:A11 |
| M00001345C:B10 | M00004158C:B01 | M00004427D:H04 | M00023299B:A01 |
| M00001382D:F03 | M00004165B:E03 | M00004502B:G05 | M00026857A:F02 |
| M00001419A:E01 | M00004181A:B05 | M00004495D:A05 | M00026858C:H05 |
| M00001437D:A12 | M00003993C:G11 | M00005364C:A02 | M00026861A:B05 |
| M00001441D:G02 | M00004046C:A04 | M00005375B:H03 | M00026846C:B01 |
| M00001601D:A03 | M00004034A:G03 | M00005420C:E10 | M00027131A:H02 |
| M00001677B:G01 | M00004036C:E10 | M00005413B:B02 | M00027396A:F07 |
| M00001678A:B10 | M00004043C:A06 | M00005438D:A08 | M00023301B:C01 |
| M00001675C:F05 | M00004067C:C10 | M00005453B:B06 | M00023321B:F06 |
| M00001360D:C12 | M00004068A:A03 | M00005446B:D10 | M00023401C:D12 |
| M00001389C:E01 | M00004069A:E04 | M00005493D:H12 | M00026941C:E11 |
| M00001390C:H05 | M00004071C:B06 | M00005476D:A11 | M00027067A:B02 |
| M00001399B:C04 | M00004127C:C08 | M00005482A:D08 | M00027036B:D07 |
| M00001507A:H06 | M00004157C:E06 | M00005485C:F09 | M00027329A:H04 |
| M00003747C:G12 | M00004165D:H12 | M00005563C:D05 | M00027740C:C05 |
| M00001358B:F12 | M00003995B:C06 | M00005569B:E04 | M00023340A:A10 |
| M00001360B:F09 | M00004090A:B11 | M00005621B:C09 | M00026942C:A06 |
| M00001392A:F02 | M00004084C:F05 | M00005628D:A10 | M00027066A:A04 |
| M00001397D:G04 | M00004087A:H06 | M00005629B:G06 | M00027072C:A11 |
| M00001463C:E12 | M00004110A:G03 | M00004866C:H08 | M00027028A:B06 |
| M00001531B:A03 | M00004117D:F06 | M00004872C:G03 | M00023282B:H09 |
| M00001507D:F09 | M00004150A:B09 | M00005358B:D10 | M00023295B:C03 |
| M00001513B:F05 | M00004140C:D04 | M00005385D:B08 | M00026811A:H01 |
| M00001514B:C02 | M00004175D:D05 | M00005392C:B03 | M00026850B:F07 |
| M00001576C:E03 | M00004176A:H05 | M00005395C:C11 | M00026913D:G11 |
| M00003756D:B09 | M00004170C:A12 | M00005396A:C01 | M00026936D:D01 |
| M00003907C:D02 | M00004237B:G01 | M00005435B:F01 | M00027083C:F06 |
| M00003926A:D01 | M00004253A:E02 | M00005464B:B08 | M00027152D:H06 |
| M00003928D:A04 | M00003997D:G03 | M00005505B:D10 | M00027209D:B09 |
| M00003935D:E04 | M00003998C:D04 | M00005509D:G05 | M00027339D:E10 |
| M00003985B:F06 | M00004027C:E06 | M00005614A:B07 | M00027282D:G01 |
| M00004063B:B12 | M00004059D:A09 | M00005721C:A12 | M00023287A:D08 |
| M00004101A:C12 | M00004087B:D05 | M00005705D:G09 | M00026928A:B06 |
| M00004104C:F06 | M00004114C:B09 | M00005709D:H05 | M00027028B:C12 |
| M00004107A:E02 | M00004140B:C02 | M00004859D:D01 | M00027115B:G04 |
| M00004108B:D04 | M00004149C:D11 | M00005342D:E04 | M00027096B:A01 |
| M00003856A:H10 | M00004168D:F05 | M00005363C:C05 | M00027154B:D05 |
| M00003908C:C04 | M00004176B:H09 | M00005353C:H01 | M00027164A:A09 |
| M00003895C:F05 | M00004173A:D03 | M00005386C:G01 | M00027218C:D06 |

TABLE 81-continued

| ES55 | ES56 | ES57 | ES58 |
|---|---|---|---|
| M00003939B:C02 | M00004209B:G01 | M00005388B:B02 | M00023343B:C08 |
| M00003997A:C08 | M00004253D:D04 | M00005396C:H04 | M00026871C:F12 |
| M00004066D:C02 | M00004275A:H07 | M00005434A:F11 | M00026882A:E07 |
| M00004105C:C05 | M00004269C:B10 | M00005434C:E02 | M00027067B:E09 |
| M00003788B:C08 | M00004298A:H09 | M00005473C:F02 | M00027062C:C04 |
| M00003788B:C05 | M00004347A:F10 | M00005459B:A01 | M00027131C:E07 |
| M00003835B:C05 | M00004337A:A07 | M00005469A:D10 | M00027137D:F05 |
| M00003820B:G04 | M00004372A:A08 | M00005505D:H08 | M00027204B:A08 |
| M00003888C:G08 | M00004406D:E11 | M00005509B:E10 | M00027188A:D12 |
| M00003977D:H04 | M00004449B:B05 | M00005616B:E11 | M00027190B:F06 |
| M00004029D:H03 | M00004507A:F11 | M00005589B:H12 | M00027193A:F07 |
| M00004034A:A05 | M00004276A:C06 | M00005721D:B03 | M00022362D:G11 |
| M00004140D:E03 | M00004270C:H05 | M00005698A:H12 | M00007947B:F07 |
| M00003775C:C01 | M00004343A:G07 | M00006613C:C02 | M00007948B:B07 |
| M00003776B:F08 | M00004344B:C06 | M00006617A:A06 | M00008003B:F09 |
| M00003839D:C03 | M00004373D:G10 | M00006584D:D01 | M00008054C:C03 |
| M00003818C:D02 | M00004368A:G11 | M00006594B:D05 | M00008075D:B01 |
| M00003820C:E08 | M00004371B:A05 | M00006600D:G07 | M00022074A:F05 |
| M00003822A:D02 | M00004403A:A02 | M00006631D:G09 | M00007943C:B02 |
| M00003877C:G01 | M00004445D:A04 | M00006635A:C01 | M00008002B:F09 |
| M00003880A:G10 | M00004447A:A10 | M00006726D:H10 | M00021653C:B06 |
| M00003919D:F01 | M00004603D:D09 | M00006874D:E01 | M00021851D:H06 |
| M00003960D:E09 | M00004326D:D06 | M00006882C:D03 | M00022015D:C11 |
| M00004081A:E11 | M00004323B:G12 | M00006925B:B02 | M00022018B:E09 |
| M00004085B:D12 | M00004350A:C04 | M00006946B:C08 | M00022095C:F03 |
| M00004142C:A06 | M00004357A:B10 | M00006949B:C07 | M00007996C:B11 |
| M00004135D:D01 | M00004360B:B08 | M00007026A:A03 | M00007977B:C11 |
| M00004198B:G08 | M00004385D:D06 | M00006712A:F01 | M00008088D:B01 |
| M00004185B:H03 | M00004414D:A01 | M00006727A:H12 | M00021676B:B12 |
| M00004187A:B05 | M00004415A:A01 | M00006815D:D11 | M00021972A:C10 |
| M00004251B:H12 | M00004423A:B05 | M00006805D:H12 | M00022099C:A10 |
| M00004232D:G11 | M00004423C:F03 | M00006934B:B11 | M00022106D:B06 |
| M00004240A:D03 | M00004426B:H06 | M00007019B:G01 | M00007978B:C04 |
| M00004285C:B06 | M00004504C:G07 | M00007038D:D01 | M00008053D:E09 |
| M00004292A:C08 | M00004466A:E04 | M00007041C:C05 | M00021669B:G02 |
| M00004335A:G05 | M00004498D:A11 | M00006630A:E05 | M00022118A:D08 |
| M00004240C:A06 | M00004292A:F03 | M00006623C:G07 | M00022251A:F07 |
| M00004249A:C09 | M00004280D:D10 | M00006694B:G06 | M00022235D:F07 |
| M00004335D:D03 | M00004286D:D02 | M00006668D:B10 | M00022240C:B03 |
| M00004378A:H10 | M00004870D:E05 | M00006688A:F09 | M00022406C:G03 |
| M00004381A:E10 | M00004871C:C04 | M00006745B:C05 | M00022459C:G05 |
| M00004444C:H11 | M00004872C:D07 | M00006846A:B03 | M00022627B:D01 |
| M00004225A:E03 | M00005395C:D11 | M00006823A:H06 | M00022184D:F07 |
| M00004284A:C09 | M00005395D:B12 | M00006925A:B09 | M00022177D:G02 |
| M00004264B:F03 | M00005412D:G07 | M00006894D:A07 | M00022460C:E12 |
| M00004404A:B03 | M00005413D:G12 | M00006895D:A02 | M00022627A:A02 |
| M00004410A:F06 | M00005513C:H01 | M00006991B:E05 | M00022144D:D09 |
| M00004412A:G05 | M00005515D:G02 | M00006994B:C12 | M00022203B:A05 |
| M00001340C:A08 | M00005607A:C08 | M00007046D:E10 | M00022214C:C11 |
| M00001340C:D09 | M00005366D:E12 | M00006577A:B01 | M00022252D:A04 |
| M00001395D:B04 | M00005618C:H11 | M00006630A:E09 | M00022420B:C08 |
| M00001466C:H11 | M00005708C:D11 | M00006619A:G11 | M00022640B:G10 |
| M00001528D:B12 | M00005810B:C07 | M00006704A:C11 | M00022641C:H03 |
| M00001517C:A10 | M00006795B:B12 | M00022127C:E01 | M00022652B:G06 |
| M00001561A:G10 | M00006755C:C03 | M00022128A:C05 | M00022216C:H02 |
| M00001565C:F06 | M00006756D:G07 | M00022176D:F05 | M00022199A:F09 |
| M00001569A:H01 | M00006779D:F03 | M00022214A:H05 | M00022214A:D01 |
| M00001341A:H10 | M00004821C:C03 | M00022220B:B06 | M00022273A:B03 |
| M00001375C:C11 | M00005358A:H03 | M00022278D:E04 | M00022256D:G11 |
| M00001397C:F01 | M00005480C:A04 | M00022282A:A11 | M00022261C:D06 |
| M00001431A:F03 | M00005481C:H05 | M00022260C:H07 | M00022490B:G12 |
| M00001457D:E08 | M00005490B:B02 | M00022263A:C01 | M00022648D:G11 |
| M00001505C:C10 | M00005820A:H11 | M00022377A:E02 | M00022709B:G02 |
| M00001615A:D01 | M00006621B:B06 | M00022399C:B02 | M00022701C:A05 |
| M00001618C:E01 | M00006752C:D04 | M00022056C:D12 | M00022826A:C08 |
| M00001358C:D09 | M00006757D:H04 | M00022087A:D01 | M00022963A:E07 |
| M00001360B:B01 | M00005000A:H05 | M00022088B:E05 | M00022904B:D04 |
| M00001391C:B05 | M00005296D:G03 | M00022090B:B03 | M00023095C:A09 |
| M00001389B:B12 | M00005378B:B04 | M00022094A:A09 | M00022684C:C12 |
| M00001485A:C04 | M00005461C:D11 | M00022096D:D10 | M00022765B:E03 |
| M00001559D:E02 | M00005464C:D07 | M00022176A:F02 | M00022898C:H07 |
| M00001545D:F12 | M00005657B:F11 | M00022217B:E03 | M00022902B:F10 |
| M00001549C:F10 | M00006596B:H02 | M00022259A:D04 | M00023003A:H01 |
| M00001579C:E07 | M00005826B:F10 | M00022381B:C12 | M00022768A:A10 |
| M00001630A:E08 | M00006577B:F01 | M00022399D:A07 | M00022834A:H02 |
| M00001386B:E01 | M00006582A:F12 | M00022401C:G07 | M00023002A:C02 |
| M00001389A:F03 | M00006664A:C05 | M00022407D:G07 | M00023003C:C10 |
| M00001418C:F06 | M00006678C:B07 | M00022417B:C01 | M00023012A:C06 |

TABLE 81-continued

| ES55 | ES56 | ES57 | ES58 |
|---|---|---|---|
| M00001454D:H09 | M00006840A:A12 | M00022435C:C05 | M00007973D:B03 |
| M00001442D:D09 | M00005020B:D10 | M00022471D:A05 | M00007939A:F06 |
| M00001450D:H12 | M00005296B:H07 | M00022464D:F12 | M00007941D:D07 |
| M00001479D:B10 | M00005403A:D12 | M00022469A:A05 | M00007948D:F08 |
| M00001598C:F02 | M00005376B:E08 | M00022500B:D01 | M00008012D:H04 |
| M00001594A:H01 | M00005378B:B12 | M00022506B:B03 | M00008014D:A11 |
| M00001657D:D07 | M00005397A:G08 | M00022542A:B06 | M00008048C:A08 |
| M00003772C:F12 | M00005449D:D04 | M00022527D:A09 | M00008099A:C12 |
| M00003844D:B02 | M00005465A:A07 | M00022568B:D03 | M00021668D:G09 |
| M00003845B:A04 | M00005648C:C11 | M00022561D:E06 | M00021861C:B08 |
| M00003845C:F08 | M00006595C:B08 | M00022687C:C11 | M00021980A:F03 |
| M00003848A:E08 | M00006816B:D08 | M00022695D:B02 | M00007931A:B07 |
| M00003880C:D06 | M00006835D:C08 | M00022425A:F11 | M00007948C:G01 |
| M00001647D:A02 | M00006914C:D07 | M00022434D:B06 | M00007969B:E10 |
| M00001655C:F07 | M00007177A:G07 | M00022460C:C07 | M00008012B:C05 |
| M00003804D:F12 | M00006920B:H07 | M00022510A:B09 | M00008012D:E07 |
| M00003884C:G09 | M00007161C:D12 | M00022501D:A09 | M00008014C:H01 |
| M00003916D:A10 | M00006968D:H02 | M00022541D:G06 | M00008016C:E06 |
| M00003943B:C12 | M00006936C:G11 | M00022527B:H05 | M00008052C:G11 |
| M00003935A:C04 | M00006945D:A07 | M00022538D:B02 | M00008054C:E07 |
| M00003937D:F09 | M00007047C:H04 | M00022559D:F10 | M00008093C:G08 |
| M00001683B:F12 | M00007065D:A03 | M00022569D:H03 | M00021614A:C09 |
| M00001669B:H04 | M00007079D:H01 | M00022601A:A09 | M00008094D:C02 |
| M00003762D:C02 | M00006968A:H05 | M00022604A:F06 | M00021667C:G10 |
| M00003788D:E06 | M00007078B:H04 | M00022684B:F11 | M00021674A:B07 |
| M00003824A:B11 | M00007186A:A12 | M00022702A:D10 | M00021846B:F05 |
| M00003865B:D10 | M00004852A:H08 | M00022691A:G01 | M00021847B:A09 |
| M00003870C:H03 | M00005382A:G09 | M00022696A:H03 | M00021963C:H04 |
| M00003901B:C02 | M00005418C:B09 | M00022444A:C04 | M00007985C:G07 |
| M00003893A:D03 | M00005420A:E03 | M00022447A:H06 | M00008001D:F11 |
| M00003931A:G01 | M00005450C:G09 | M00022488C:H02 | M00007992A:G04 |
| M00003973A:D09 | M00005444D:D01 | M00022522B:A05 | M00008000D:B06 |
| M00001660A:B10 | M00005494C:F08 | M00022513C:G04 | M00008001A:G11 |
| M00003761C:C05 | M00005479C:A05 | M00022517C:B01 | M00008044C:A05 |
| M00003829C:G07 | M00005486A:F07 | M00022546B:F12 | M00008085B:G01 |
| M00003833D:F11 | M00005538C:H11 | M00022591C:F03 | M00008082B:C05 |
| M00003879D:A09 | M00005648C:E10 | M00022617B:A01 | M00008083A:H11 |
| M00003880B:B08 | M00005621A:B05 | M00022681D:H10 | M00021624B:E11 |
| M00003861D:G10 | M00004847D:G01 | M00022659B:C01 | M00021689A:G05 |
| M00003876C:G11 | M00005342B:G01 | M00022664C:G10 | M00021865B:F06 |
| M00003877C:C11 | M00005305A:H01 | M00022711B:A05 | M00021879B:C11 |
| M00003902C:D02 | M00026906B:G03 | M00022704A:H08 | M00021958A:A03 |
| M00003933A:B04 | M00026872A:C10 | M00022449D:B05 | M00021945A:B04 |
| M00003923D:A03 | M00026964C:H02 | M00022548A:F02 | M00021981D:A11 |
| M00003989A:A02 | M00026982C:D08 | M00022590D:E08 | M00007987A:D10 |
| M00003991A:D05 | M00027069D:F02 | M00022622A:E08 | M00007998C:B04 |
| M00004030C:E05 | M00027042D:E02 | M00022655A:F09 | M00008001B:E11 |
| M00004048A:E10 | M00027056B:H07 | M00022664A:E04 | M00008045A:B05 |
| M00006680D:A01 | M00027137C:A03 | M00022720A:C01 | M00008023A:B03 |
| M00006688C:C12 | M00027184B:H02 | M00022722C:C07 | M00008027D:H09 |
| M00006740A:A06 | M00027189C:D04 | M00022746D:D05 | M00008044B:F07 |
| M00006757A:C09 | M00027196A:A10 | M00022772A:A06 | M00008089C:B08 |
| M00006859D:E11 | M00027357D:A02 | M00022813C:B09 | M00021620D:B06 |
| M00006917B:C05 | M00027369A:B03 | M00022853D:C05 | M00021624B:D03 |
| M00006919A:H12 | M00027439B:A09 | M00022843A:D02 | M00021628C:B09 |
| M00006993B:F02 | M00027393D:F01 | M00022844C:A01 | M00021680D:H08 |
| M00007093C:C11 | M00027557D:B06 | M00022968D:G06 | M00021687C:A04 |
| M00007047B:C02 | M00027502C:H02 | M00023023B:A05 | M00021696C:E02 |
| M00007064B:E09 | M00027507C:C06 | M00022716A:C01 | M00021698A:H03 |
| M00007121A:G04 | M00027529B:B11 | M00022725D:G05 | M00021864C:C07 |
| M00007107C:D02 | M00027438D:A03 | M00022817D:B09 | M00021958A:A04 |
| M00007178D:A10 | M00027388A:G05 | M00022848D:H09 | M00021949D:A05 |
| M00007156D:E11 | M00027396C:B06 | M00022884D:A07 | M00021951B:A01 |
| M00007172D:H03 | M00027551C:B07 | M00022983A:H04 | M00022001B:H10 |
| M00007175D:G02 | M00027518B:B07 | M00023034B:B10 | M00022001D:E06 |
| M00007121D:A11 | M00027528A:G03 | M00023038D:D04 | M00022071D:C08 |
| M00007101C:H01 | M00027759B:E11 | M00022743C:G05 | M00022078B:B04 |
| M00007104D:D10 | M00027728A:B03 | M00022734C:A03 | M00022113B:A12 |
| M00007116A:C08 | M00027484A:G03 | M00022737D:B02 | M00022138C:B07 |
| M00007152A:A10 | M00027752B:E05 | M00022801A:G04 | M00022152A:G05 |
| M00007179B:H04 | | M00022838B:E05 | M00022158C:C08 |
| M00007157B:B04 | | M00022856A:B09 | M00022192B:H07 |
| M00007167C:B10 | | M00022902C:F11 | M00022233C:D11 |
| M00007175B:B11 | | M00022893D:C06 | M00022252A:C01 |
| M00007177B:C02 | | M00022922D:G06 | M00022370A:G07 |
| M00007141A:G08 | | M00022986B:C02 | M00022300A:A05 |
| M00007196D:D02 | | M00023002D:C12 | M00022386D:C04 |
| M00007145C:B05 | | M00023096C:A03 | M00022072D:E12 |

TABLE 81-continued

| ES55 | ES56 | ES57 | ES58 |
|---|---|---|---|
| M00007126D:H01 | | M00023097A:C03 | M00022102D:A10 |
| M00007140C:G12 | | M00022743C:G06 | M00022207C:C01 |
| M00007200A:B12 | | M00022736B:B03 | M00022249C:G09 |
| M00007203C:E06 | | M00022737B:F12 | M00022383C:F05 |
| | | M00022831C:F11 | M00022384B:E06 |
| | | M00022836C:A07 | M00022067A:B03 |
| | | M00022854D:C04 | M00022056B:G12 |
| | | M00022860A:A07 | M00022084B:C03 |
| | | M00022861C:B04 | M00022087D:F12 |
| | | M00023096A:F03 | |
| | | M00023096D:B11 | |
| | | M00023097C:D10 | |

TABLE 82

| ES59 | ES60 | ES61 | ES62 |
|---|---|---|---|
| M00001418A:A02 | M00001477A:G02 | M00004450A:G07 | M00005515B:B08 |
| M00003877C:A08 | M00003853C:A09 | M00004353D:C06 | M00005385B:A10 |
| M00003977C:D01 | M00001694B:H12 | M00004406A:H12 | M00005516D:F12 |
| M00004295A:C02 | M00001664D:E02 | M00004048C:C02 | M00005822D:C05 |
| M00001383C:C04 | M00003847B:H01 | M00004170B:G04 | M00004841C:H03 |
| M00001500A:A02 | M00001631D:G08 | M00004108C:D07 | M00005810B:G02 |
| M00003880B:D03 | M00004498D:F02 | M00004125B:A02 | M00007107A:H08 |
| M00003803B:G12 | M00001563A:F04 | M00004109A:B07 | M00004825A:G12 |
| M00003819D:B02 | M00001558D:E02 | M00004123B:G05 | M00005327C:G08 |
| M00004178B:F07 | M00004278C:H11 | M00004152A:F03 | M00005390C:E05 |

| ES63 | ES64 | ES65 | ES66 |
|---|---|---|---|
| M00005520A:H11 | M00006790D:F10 | M00027175D:A05 | M00026949A:F04 |
| M00006814D:D09 | M00006627C:C02 | M00026910C:C05 | M00023432D:F09 |
| M00006918D:G08 | M00027462D:A12 | M00027280D:H01 | M00027178B:E04 |
| M00007197D:D12 | M00026972A:F04 | M00023289D:E06 | M00027225B:D03 |
| M00005497C:G08 | M00027592D:C05 | M00023373A:D01 | M00023340B:B07 |
| M00007109D:G01 | M00026945B:C10 | M00027231A:D01 | M00027283C:H12 |
| M00005377C:F07 | M00027231C:D08 | M00023321A:F07 | M00027085C:H12 |
| M00006813B:E04 | M00027083D:F06 | M00027266C:G12 | M00027234C:B05 |
| M00005825A:A10 | M00027142A:C01 | M00023398D:F10 | M00023390A:C04 |
| M00005416B:A01 | M00027607A:A09 | M00027603C:E02 | M00026810A:H04 |

| ES67 | ES68 | ES69 | ES70 |
|---|---|---|---|
| M00023340B:H12 | M00027642C:D11 | M00022714B:D04 | M00022709A:C01 |
| M00027237C:D04 | M00027202B:B09 | M00022838A:H05 | M00022413B:D07 |
| M00026809C:D10 | M00027459A:G12 | M00022392C:H06 | M00022467C:H07 |
| M00027386D:C02 | M00027250A:C04 | M00022363C:D03 | M00022561B:B09 |
| M00027343D:H05 | M00027499B:G02 | M00022205A:C02 | M00022214C:E09 |
| M00027356A:H02 | M00027053C:B06 | M00022717C:F05 | M00022697A:C08 |
| M00027363D:A08 | M00027598C:D06 | M00008015B:D08 | M00022682A:F10 |
| M00027364D:E08 | M00006989C:B01 | M00021625B:G07 | M00021841A:E11 |
| M00027618A:B08 | M00006837B:H12 | M00008100D:C08 | M00021691B:E04 |
| M00027628D:D08 | M00007202A:A09 | M00022669D:G07 | M00022477C:C07 |

| ES71 | ES72 | ES73 | ES74 |
|---|---|---|---|
| M00022134D:D12 | M00008028D:B01 | M00022513C:E10 | M00023363C:A04 |
| M00022705B:F08 | M00021931B:F04 | M00022518C:C04 | M00001401B:A02 |
| M00022903D:H02 | M00008097C:E04 | M00022544C:D08 | M00008023C:A06 |
| M00022915C:C09 | M00008082B:H10 | M00022785C:B10 | M00022077D:A12 |
| M00007965C:B02 | M00008006A:H02 | M00022525C:E09 | M00023284B:G06 |
| M00022368C:C11 | M00022167B:H02 | M00022641D:F08 | M00023369D:C05 |
| M00007937C:E08 | M00022509D:A12 | M00022923A:A09 | M00023413D:F04 |
| M00021852C:D12 | M00022169A:E11 | | M00026905A:G11 |
| M00008000D:G11 | M00022184D:H07 | | M00027169D:H06 |
| M00021908B:F03 | M00022441B:A06 | | M00005434D:H02 |

The deposits described herein are provided merely as convenience to those of skill in the art, and is not an admission that a deposit is required under 35 U.S.C. §112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby.

Retrieval of Individual Clones from Deposit of Pooled Clones. Where the ATCC deposit is composed of a pool of cDNA clones or a library of cDNA clones, the deposit was prepared by first transfecting each of the clones into separate bacterial cells. The clones in the pool or library were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

Example 55

Source of Biological Materials and Overview of Novel Polynucleotides Expressed by the Biological Materials Cell lines and human normal and tumor tissue were used to construct cDNA libraries from mRNA isolated from the cells and tissues. Most sequences were about 275-300 nucleotides in length. The cells lines include Km12L4-A cell line, a high metastatic colon cancer cell line (Morika, W. A. K. et al., *Cancer Research* (1988) 48:6863). The KM12L4-A cell line is derived from the KM12C cell line. The KM12C cell line, which is poorly metastatic (low metastatic) was established in culture from a Dukes' stage B2 surgical specimen (Morikawa et al. *Cancer Res.* (1988) 48:6863). The KML4-A is a highly metastatic subline derived from KM12C (Yeatman et al. *Nucl. Acids. Res.* (1995) 23:4007; Bao-Ling et al. *Proc. Annu. Meet. Am. Assoc. Cancer. Res.* (1995) 21:3269). The KM12C and KM 12C-derived cell lines (e.g., KM12L4, KM12L4-A, etc.) are well-recognized in the art as model cell lines for the study of colon cancer (see, e.g., Moriakawa et al., supra; Radinsky et al. *Clin. Cancer Res.* (1995) 1:19; Yeatman et al., (1995) supra; Yeatman et al., *Clin. Exp. Metastasis* (1996) 14:246). These and other cell lines and tissue are described in Table 88.

The sequences of the isolated polynucleotides were first masked to eliminate low complexity sequences using the XBLAST masking program (Claverie "Effective Large-Scale. Sequence Similarity Searches," In: *Computer Methods for Macromolecular Sequence Analysis*, Doolittle, ed., *Meth. Enzymol.* 266:212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem.* (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. The sequences remaining after masking were then used in a BLASTN vs. Genbank search; sequences that exhibited greater than 70% overlap, 99% identity, and a p value of less than $1 \times 10^{-40}$ were discarded. Sequences from this search also were discarded if the inclusive parameters were met, but the sequence was ribosomal or vector-derived.

The resulting sequences from the previous search were classified into three groups (1, 2 and 3 below) and searched in a BLASTX vs. NRP (non-redundant proteins) database search: (1) unknown (no hits in the Genbank search), (2) weak similarity (greater than 45% identity and p value of less than $1 \times 10^{-5}$), and (3) high similarity (greater than 60% overlap, greater than 80% identity, and p value less than $1 \times 10^{-5}$). Sequences having greater than 70% overlap, greater than 99% identity, and p value of less than $1 \times 10^{-40}$ were discarded.

The remaining sequences were classified as unknown (no hits), weak similarity, and high similarity (parameters as above). Two searches were performed on these sequences. First, a BLAST vs. EST database search was performed and sequences with greater than 99% overlap, greater than 99% similarity and a p value of less than $1 \times 10^{-40}$ were discarded. Sequences with a p value of less than $1 \times 10^{-65}$ when compared to a database sequence of human origin were also excluded. Second, a BLASTN vs. Patent GeneSeq database was performed and sequences having greater than 99% identity, p valueless than $1 \times 10^{-40}$, and greater than 99% overlap were discarded.

The remaining sequences were subjected to screening using other rules and redundancies in the dataset. Sequences with a p value of less than $1 \times 10^{-111}$ in relation to a database sequence of human origin were specifically excluded. The final result provided the 3351 sequences listed in the accompanying Sequence Listing. Each identified polynucleotide represents sequence from at least a partial mRNA transcript. Polynucleotides that were determined to be novel were assigned a sequence identification number.

The novel polynucleotides were assigned sequence identification numbers SEQ ID NOs:9920-12191. The DNA sequences corresponding to the novel polynucleotides are provided in the Sequence Listing. Tables 83 and 84 and 2 provide: 1) the SEQ ID NO assigned to each sequence for use in the present specification or a corresponding number; 2) the sequence name used as an internal identifier of the sequence; 3) the name assigned to the clone from which the sequence was isolated; and 4) the number of the cluster to which the sequence is assigned (Cluster ID; where the cluster ID is 0, the sequence was not assigned to any cluster).

Because the provided polynucleotides represent partial mRNA transcripts, two or more polynucleotides of the invention may represent different regions of the same mRNA transcript and the same gene. Thus, if two or more SEQ ID NOs: are identified as belonging to the same clone, then either sequence can be used to obtain the full-length mRNA or gene.

Example 56

Results of Public Database Search to Identify Function of Gene Products

SEQ ID NOs:9920-13270 were translated in all three reading frames to determine the best alignment with the individual sequences. These amino acid sequences and nucleotide sequences are referred to, generally, as query sequences, which are aligned with the individual sequences. Query and individual sequences were aligned using the BLAST programs, available over the world wide web at the web site ncbi.nlm.nih.gov/BLAST/. Again the sequences were masked to various extents to prevent searching of repetitive sequences or poly-A sequences, using the XBLAST program for masking low complexity as described above.

Tables 85 and 86 (inserted before the claims) show the results of the alignments. Tables 85 and 86 refer to each sequence by its SEQ ID NO or a corresponding number, the accession numbers and descriptions of nearest neighbors from the Genbank and Non-Redundant Protein searches, and the p values of the search results.

The activity of the polypeptide encoded by SEQ ID NOs: 9920-13270 is the same or similar to the nearest neighbor reported in Table 85 or 86. The accession number of the nearest neighbor is reported, providing a reference to the activities exhibited by the nearest neighbor. The search program and database used for the alignment also are indicated as well as a calculation of the p value.

Full length sequences or fragments of the polynucleotide sequences of the nearest neighbors can be used as probes and primers to identify and isolate the full length sequence of SEQ ID NOs: 9920-13270. The nearest neighbors can indicate a tissue or cell type to be used to construct a library for the full-length sequences of SEQ ID NOs: 9920-132701.

Example 57

Members of Protein Families

The sequences were used to conduct a profile search as described in the specification above. Several of the polynucleotides of the invention were found to encode polypeptides having characteristics of a polypeptide belonging to a known protein families (and thus represent new members of these protein families) and/or comprising a known functional domain (Table 87). "Start" and "stop" in Table 3 indicate the position within the individual sequences that align with the query sequence having the indicated SEQ ID NO. The direction indicates the orientation of the query sequence with respect to the individual sequence, where forward (for) indicates that the alignment is in the same direction (left to right) as the sequence provided in the Sequence Listing and reverse (rev) indicates that the alignment is with a sequence complementary to the sequence provided in the Sequence Listing.

Some polynucleotides exhibited multiple profile hits because, for example, the particular sequence contains overlapping profile regions, and/or the sequence contains two different functional domains. These profile hits are described in more detail below.

Ank Repeats (ANK). Some SEQ ID NOs represent polynucleotides encoding an Ank repeat-containing protein. The ankyrin motif is a 33 amino acid sequence named for the protein ankyrin which has 24 tandem 33-amino-acid motifs. Ank repeats were originally identified in the cell-cycle-control protein cdc10 (Breeden et al., Nature (1987) 329:651). Proteins containing ankyrin repeats include ankyrin, myotropin, I-kappaB proteins, cell cycle protein cdc10, the Notch receptor (Matsuno et al., Development (1997) 124(21):4265); G9a (or BAT8) of the class III region of the major histocompatibility complex (Biochem J. 290:811-818, 1993), FABP, GABP, 53BP2, Lin12, glp-1, SW14, and SW16. The functions of the ankyrin repeats are compatible with a role in protein-protein interactions (Bork, Proteins (1993) 17(4):363; Lambert and Bennet, Eur. J. Biochem. (1993) 211: 1; Kerr et al., Current Op. Cell Biol. (1992) 4:496; Bennet et al., J. Biol. Chem. (1980) 255:6424).

ATPases Associated with Various Cellular Activities (ATPases). Some SEQ ID NOs correspond to a sequence that encodes a novel member of the "ATPases Associated with diverse cellular Activities" (AAA) protein family. The AAA protein family is composed of a large number of ATPases that share a conserved region of about 220 amino acids that contains an ATP-binding site (Froehlich et al., J. Cell Biol. (1991) 114:443; Erdmann et al., Cell (1991) 64:499; Peters et al., EMBO J. (1990) 9:1757; Kunau et al., Biochimie (1993) 75:209-224; Confalonieri et al., BioEssays (1995) 17:639; see internet website at yeamob.pci.chemie.uni-tuebingen.de/ AAA/Description.-html). The proteins that belong to this family either contain one or two AAA domains. In general, the AAA domains in these proteins act as ATP-dependent protein clamps (Confalonieri et al. (1995) BioEssays 17:639). In addition to the ATP-binding 'A' and 'B' motifs, which are located in the N-terminal half of this domain, there is a highly conserved region located in the central part of the domain which was used in the development of the signature pattern.

Bromodomain (bromodomain). One SEQ ID NO represents a polynucleotide encoding a polypeptide having a bromodomain region (Haynes et al., 1992, Nucleic Acids Res. 20:2693-2603, Tamkun et al., 1992, Cell 68:561-572, and Tamkun, 1995, Curr. Opin. Genet. Dev. 5:473-477), which is a conserved region of about 70 amino acids. The bromodomain is thought to be involved in protein-protein interactions and may be important for the assembly or activity of multicomponent complexes involved in transcriptional activation.

Basic Region Plus Leucine Zipper Transcription Factors (BZIP). Some SEQ ID NOs represent polynucleotides encoding a novel member of the family of basic region plus leucine zipper transcription factors. The bZIP superfamily (Hurst, Protein Prof. (1995) 2:105; and Ellenberger, Curr. Opin. Struct. Biol. (1994) 4:12) of eukaryotic DNA-binding transcription factors encompasses proteins that contain a basic region mediating sequence-specific DNA-binding followed by a leucine zipper required for dimerization.

EF Hand (EFhand). Some SEQ ID NOs correspond to polynucleotides encoding a novel protein in the family of EF-hand proteins. Many calcium-binding proteins belong to the same evolutionary family and share a type of calcium-binding domain known as the EF-hand (Kawasaki et al., Protein. Prof. (1995) 2:305-490). This type of domain consists of a twelve residue loop flanked on both sides by a twelve residue alpha-helical domain. In an EF-hand loop the calcium ion is coordinated in a pentagonal bipyramidal configuration. The six residues involved in the binding are in positions 1, 3, 5, 7, 9 and 12; these residues are denoted by X, Y, Z, −Y, −X and −Z. The invariant Glu or Asp at position 12 provides two oxygens for liganding Ca (bidentate ligand).

Ets Domain (Ets_Nterm). One SEQ ID NO represents a polynucleotide encoding a polypeptide with N-terminal homology in ETS domain. Proteins of this family contain a conserved domain, the "ETS-domain," that is involved in DNA binding. The domain appears to recognize purine-rich sequences; it is about 85 to 90 amino acids in length, and is rich in aromatic and positively charged residues (Wasylyk, et al., Eur. J. Biochem. (1993) 211:718). The ets gene family encodes a novel class of DNA-binding proteins, each of which binds a specific DNA sequence and comprises an ets domain that specifically interacts with sequences containing the common core tri-nucleotide sequence GGA. In addition to an ets domain, native ets proteins comprise other sequences which can modulate the biological specificity of the protein. Ets genes and proteins are involved in a variety of essential biological processes including cell growth, differentiation and development, and three members are implicated in oncogenic process.

G-Protein Alpha Subunit (G-alpha). One SEQ ID NO represents a polynucleotide encoding a novel polypeptide of the G-protein alpha subunit family. Guanine nucleotide binding proteins (G-proteins) are a family of membrane-associated proteins that couple extracellularly-activated integral-membrane receptors to intracellular effectors, such as ion channels and enzymes that vary the concentration of second messenger molecules. G-proteins are composed of 3 subunits (alpha, beta and gamma) which, in the resting state, associate as a trimer at the inner face of the plasma membrane. The alpha subunit binds GTP and exhibits GTPase activity. G-protein alpha subunits are 350-400 amino acids in length and have molecular weights in the range 40-45 kDa. Seventeen distinct types of alpha subunit have been identified in mammals, and fall into 4 main groups on the basis of both sequence similarity and function: alpha-s, alpha-q, alpha-i and alpha-12 (Simon et al., *Science* (1993) 252:802). They are often N-terminally acylated, usually with myristate and/or palmitoylate, and these fatty acid modifications can be important for membrane association and high-affinity interactions with other proteins.

Helicases conserved C-terminal domain (helicase_C). Some SEQ ID NOs represent polynucleotides encoding novel members of the DEAD/H helicase family. A number of eukaryotic and prokaryotic proteins have been characterized (Schmid S. R., et al., *Mol. Microbiol.* (1992) 6:283; Linder P., et al., *Nature* (1989) 337:121; Wassarman D. A., et al., *Nature* (1991) 349:463) on the basis of their structural similarity. All are involved in ATP-dependent, nucleic-acid unwinding. All DEAD box family members of the above proteins share a number of conserved sequence motifs, some of which are specific to the DEAD family while others are shared by other ATP-binding proteins or by proteins belonging to the helicases 'superfamily' (Hodgman T. C., *Nature* (1988) 333:22 and *Nature* (1988) 333:578 (Errata). One of these motifs, called the "D-E-A-D-box", represents a special version of the B motif of ATP-binding proteins. Some other proteins belong to a subfamily which have His instead of the second Asp and are thus said to be "D-E-A-H-box" proteins (Wassarman D. A., et al., *Nature* (1991) 349:463; Harosh I., et al., *Nucleic Acids Res.* (1991) 19:6331; Koonin E. V. et al., *J. Gen. Virol.* (1992) 73:989.

Homeobox domain (homeobox). Some SEQ ID NOs represent polynucleotides encoding proteins having a homeobox domain. The homeobox is a protein domain of 60 amino acids (Gehring In: *Guidebook to the Homeobox Genes*, Duboule D., Ed., pp. 1-10, Oxford University Press, Oxford, (1994); Buerglin In: *Guidebook to the Homeobox Genes*, pp 25-72, Oxford University Press, Oxford, (1994); Gehring, *Trends Biochem. Sci.* (1992) 17:277-280; Gehring et al., *Annu. Rev. Genet.* (1986) 20:147-173; Schofield, *Trends Neurosci.* (1987) 10:3-6) first identified in a number of *Drosophila* homeotic and segmentation proteins. It is extremely well conserved in many other animals, including vertebrates. This domain binds DNA through a helix-turn-helix type of structure. Several proteins that contain a homeobox domain play an important role in development. Most of these proteins are sequence-specific DNA-binding transcription factors. The homeobox domain is also very similar to a region of the yeast mating type proteins. These are sequence-specific DNA-binding proteins that act as master switches in yeast differentiation by controlling gene expression in a cell type-specific fashion.

A schematic representation of the homeobox domain is shown below. The helix-turn-helix region is shown by the symbols 'H' (for helix), and 't' (for turn).

```
xxxxxxxxxxxxxxxxxxxxxxxxxxxxxxxxxHHHHHHHHtttHHHHHHHHHxxxxxxxxx
1                                                           60
```

The pattern detects homeobox sequences 24 residues long and spans positions 34 to 57 of the homeobox domain.

MAP kinase kinase (mkk). Some SEQ ID NOs represent novel members of the MAP kinase kinase family. MAP kinases (MAPK) are involved in signal transduction, and are important in cell cycle and cell growth controls. The MAP kinase kinases (MAPKK) are dual-specificity protein kinases which phosphorylate and activate MAP kinases. MAPKK homologues have been found in yeast, invertebrates, amphibians, and mammals. Moreover, the MAPKK/MAPK phosphorylation switch constitutes a basic module activated in distinct pathways in yeast and in vertebrates. MAPKKs are essential transducers through which signals must pass before reaching the nucleus. For review, see, e.g., Biologique *Biol Cell* (1993) 79:193-207; Nishida et al., *Trends Biochem Sci* (1993) 18:128-31; Ruderman, *Curr Opin Cell Biol* (1993) 5:207-13; Dhanasekaran et al., *Oncogene* (1998) 17:1447-55; Kiefer et al., *Biochem Soc Trans* (1997) 25:491-8; and Hill, *Cell Signal* (1996) 8:533-44.

Protein Kinase (protkinase). Some SEQ ID NOs represent polynucleotides encoding protein kinases. Protein kinases catalyze phosphorylation of proteins in a variety of pathways, and are implicated in cancer. Eukaryotic protein kinases (Hanks S. K., et al., *FASEB J.* (1995) 9:576; Hunter T., *Meth. Enzymol.* (1991) 200:3; Hanks S. K., et al., *Meth. Enzymol.* (1991) 200:38; Hanks S. K., *Curr. Opin. Struct. Biol.* (1991) 1:369; Hanks S. K. et al., *Science* (1988) 241:42) are enzymes that belong to a very extensive family of proteins which share a conserved catalytic core common to both serine/threonine and tyrosine protein kinases. There are a number of conserved regions in the catalytic domain of protein kinases. The first region, which is located in the N-terminal extremity of the catalytic domain, is a glycine-rich stretch of residues in the vicinity of a lysine residue, which has been shown to be involved in ATP binding. The second region, which is located in the central part of the catalytic domain, contains a conserved aspartic acid residue which is important for the catalytic activity of the enzyme (Knighton D. R. et al., *Science* (1991) 253:407). The protein kinase profile includes two signature patterns for this second region: one specific for serine/threonine kinases and the other for tyrosine kinases. A third profile is based on the alignment in (Hanks S. K. et al., *FASEB J.* (1995) 9:576) and covers the entire catalytic domain.

If a protein analyzed includes two of the above protein kinase signatures, the probability of it being a protein kinase is close to 100%.

Ras family proteins (ras). Some SEQ ID NOs represent polynucleotides encoding novel members of the ras family of small GTP/GDP-binding proteins (Valencia et al., 1991, Biochemistry 30:4637-4648). Ras family members generally require a specific guanine nucleotide exchange factor (GEF) and a specific GTPase activating protein (GAP) as stimulators of overall GTPase activity. Among ras-related proteins, the highest degree of sequence conservation is found in four regions that are directly involved in guanine nucleotide binding. The first two constitute most of the phosphate and Mg2+ binding site (PM site) and are located in the first half of the G-domain. The other two regions are involved in guanosine binding and are located in the C-terminal half of the molecule.

Motifs and conserved structural features of the ras-related proteins are described in Valencia et al., 1991, *Biochemistry* 30:4637-4648.

Thioredoxin family active site (Thioredox). One SEQ ID NO represents a polynucleotide encoding a protein having a thioredoxin family active site. Thioredoxins (Holmgren A., *Annu. Rev. Biochem.* (1985) 54:237; Gleason F. K. et al., *FEMS Microbiol. Rev.* (1988) 54:271; Holmgren, A. *J. Biol. Chem.* (1989) 264:13963; Eklund H. et al., *Proteins* (1991) 11:13) are small proteins of approximately one hundred amino-acid residues which participate in various redox reactions via the reversible oxidation of an active center disulfide bond. They exist in either a reduced form or an oxidized form where the two cysteine residues are linked in an intramolecular disulfide bond. Thioredoxin is present in prokaryotes and eukaryotes and the sequence around the redox-active disulfide bond is well conserved.

Trypsin (trypsin). One SEQ ID NO corresponds to a novel serine protease of the trypsin family. The catalytic activity of the serine proteases from the trypsin family is provided by a charge relay system involving an aspartic acid residue hydrogen-bonded to a histidine, which itself is hydrogen-bonded to a serine. The sequences in the vicinity of the active site serine and histidine residues are well conserved in this family of proteases (Brenner S., *Nature* (1988) 334:528).

WD Domain G-Beta Repeats (WD_domain). Some SEQ ID NOs represent novel members of the WD domain/G-beta repeat family. Beta-transducin (G-beta) is one of the three subunits (alpha, beta, and gamma) of the guanine nucleotide-binding proteins (G proteins) which act as intermediaries in the transduction of signals generated by transmembrane receptors (Gilman, *Annu. Rev. Biochem.* (1987) 56:615). The alpha subunit binds to and hydrolyzes GTP; the functions of the beta and gamma subunits are less clear but they seem to be required for the replacement of GDP by GTP as well as for membrane anchoring and receptor recognition. In higher eukaryotes, G-beta exists as a small multigene family of highly conserved proteins of about 340 amino acid residues. Structurally, G-beta consists of eight tandem repeats of about 40 residues, each containing a central Trp-Asp motif (this type of repeat is sometimes called a WD-40 repeat).

wnt Family of Developmental Signaling Proteins (Wnt_dev_sign). One SEQ ID NO corresponds to a novel member of the wnt family of developmental signaling proteins. Wnt-1 (previously known as int-1), the seminal member of this family, (Nusse R., *Trends Genet.* (1988) 4:291) is thought to play a role in intercellular communication and seems to be a signalling molecule important in the development of the central nervous system (CNS). All wnt family proteins share the following features characteristics of secretory proteins: a signal peptide, several potential N-glycosylation sites and 22 conserved cysteines that are probably involved in disulfide bonds. The Wnt proteins seem to adhere to the plasma membrane of the secreting cells and are therefore likely to signal over only few cell diameters.

Protein Tyrosine Phosphatase (Y_phosphatase). One SEQ ID NO represents a polynucleotide encoding a protein tyrosine kinase. Tyrosine specific protein phosphatases (EC 3.1.3.48) (PTPase) (Fischer et al., *Science* (1991) 253:401; Charbonneau et al., *Annu. Rev. Cell Biol.* (1992) 8:463; Trowbridge, *J. Biol. Chem.* (1991) 266:23517; Tonks et al., *Trends Biochem. Sci.* (1989) 14:497; and Hunter, *Cell* (1989) 58:1013) catalyze the removal of a phosphate group attached to a tyrosine residue. These enzymes are very important in the control of cell growth, proliferation, differentiation and transformation. Multiple forms of PTPase have been characterized and can be classified into two categories: soluble PTPases and transmembrane receptor proteins that contain PTPase domain(s). Structurally, all known receptor PTPases are made up of a variable length extracellular domain, followed by a transmembrane region and a C-terminal catalytic cytoplasmic domain. PTPase domains consist of about 300 amino acids. The search of two conserved cysteines has been shown to be absolutely required for activity. Furthermore, a number of conserved residues in its immediate vicinity have also been shown to be important.

Zinc Finger C2H2 Type (Zincfing_C2H2). Some SEQ ID NOs correspond to polynucleotides encoding novel members of the of the C2H2 type zinc finger protein family. Zinc finger domains (Klug et al., *Trends Biochem. Sci.* (1987) 12:464; Evans et al., *Cell* (1988) 52:1; Payre et al., *FEBS Lett.* (1988) 234:245; Miller et al., *EMBO J.* (1985) 4:1609; and Berg, *Proc. Natl. Acad. Sci. USA* (1988) 85:99) are nucleic acid-binding protein structures. In addition to the conserved zinc ligand residues, it has been shown that a number of other positions are also important for the structural integrity of the C2H2 zinc fingers. (Rosenfeld et al., *J. Biomol. Struct. Dyn.* (1993) 11:557) The best conserved position is found four residues after the second cysteine; it is generally an aromatic or aliphatic residue.

Src homology 2. Some SEQ ID NOs represent polynucleotides encoding novel members of the family of Src homology 2 (SH2) proteins. The Src homology 2 (SH2) domain is a protein domain of about 100 amino acid residues first identified as a conserved sequence region between the oncoproteins Src and Fps (Sadowski I. et al., *Mol. Cell. Biol.* 6:4396-4408 (1986)). Similar sequences are found in many other intracellular signal-transducing proteins (Russel R. B. et al., *FEBS Lett.* 304:15-20 (1992)). SH2 domains function as regulatory modules of intracellular signalling cascades by interacting with high affinity to phosphotyrosine-containing target peptides in a sequence-specific and phosphorylation-dependent manner (Marangere L. E. M., Pawson T., *J. Cell Sci. Suppl.* 18:97-104 (1994); Pawson T., Schlessinger J., *Curr. Biol.* 3:434-442 (1993); Mayer B. J., Baltimore D., *Trends Cell. Biol.* 3:8-13 (1993); Pawson T., *Nature* 373:573-580 (1995)).

The SH2 domain has a conserved 3D structure consisting of two alpha helices and six to seven beta-strands. The core of the domain is formed by a continuous beta-meander composed of two connected beta-sheets (Kuriyan J., Cowburn D., *Curr. Opin. Struct. Biol.* 3:828-837(1993)). The profile to detect SH2 domains is based on a structural alignment consisting of 8 gap-free blocks and 7 linker regions totaling 92 match positions.

Src homology 3. Some SEQ ID NOs represent polynucleotides encoding novel members of the family of Src homology 3 (SH3) proteins. The Src homology 3 (SH3) domain is a small protein domain of about 60 amino acid residues first identified as a conserved sequence in the non-catalytic part of several cytoplasmic protein tyrosine kinases (e.g., Src, Abl, Lck) (Mayer B. J. et al., *Nature* 332:272-275 (1988)). Since then, it has been found in a great variety of other intracellular or membrane-associated proteins (Musacchio A. et al., *FEBS Lett.* 307:55-61 (1992); Pawson T., Schlessinger J., Curr. Biol. 3:434-442 (1993); Mayer B. J., Baltimore D., *Trends Cell Biol.* 3:8-13 (1993); Pawson T., *Nature* 373:573-580 (1995)).

The SH3 domain has a characteristic fold which consists of five or six beta strands arranged as two tightly packed anti-parallel beta sheets. The linker regions may contain short helices (Kuriyan J., Cowburn D., *Curr. Opin. Struct. Biol.* 3:828-837 (1993)).

The function of the SH3 domain may be to mediate assembly of specific protein complexes via binding to proline-rich peptides (Morton C. J., Campbell I. D., Curr. Biol. 4:615-617 (1994)).

In general SH3 domains are found as single copies in a given protein, but there are a significant number of proteins with two SH3 domains and a few with 3 or 4 copies.

Fibronectin type III. Some SEQ ID NOs represent polynucleotides encoding novel members of the family of fibronectin type III proteins. A number of receptors for lymphokines, hematopoeitic growth factors and growth hormone-related molecules have been found to share a common binding domain. (Bazan J. F., Biochem. Biophys. Res. Commun. 164:788-795 (1989); Bazan J. F., Proc. Natl. Acad. Sci. U.S.A. 87:6934-6938 (1990); Cosman D. et al., Trends Biochem. Sci. 15:265-270 (1990); d'Andrea A. D., Fasman G. D., Lodish H. F., Cell 58:1023-1024 (1989); d'Andrea A. D., Fasman G. D., Lodish H. F., Curr. Opin. Cell Biol. 2:648-651 (1990)).

The conserved region constitutes all or part of the extracellular ligand-binding region and is about 200 amino acid residues long. In the N-terminal of this domain there are two pairs of cysteines known, in the growth hormone receptor, to be involved in disulfide bonds.

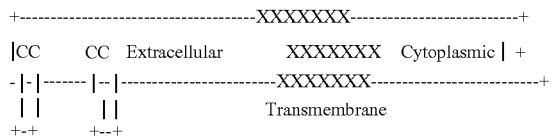

Two patterns detect this family of receptors. The first one is derived from the first N-terminal disulfide loop, the second is a tryptophan-rich pattern located at the C-terminal extremity of the extracellular region.

LIM domain containing proteins. Some SEQ ID NOs represent polynucleotides encoding novel members of the family of LIM domain containing proteins. A number of proteins contain a conserved cysteine-rich domain of about 60 amino-acid residues. (Freyd G. et al., Nature 344:876-879 (1990); Baltz R. et al., Plant Cell 4:1465-1466 (1992); Sanchez-Garcia I., Rabbitts T. H., Trends Genet. 10:315-320 (1994)).

In the LIM domain, there are seven conserved cysteine residues and a histidine.

C2 domain (protein kinase C like). Some SEQ ID NOs represent polynucleotides encoding novel members of the family of C2 domain containing proteins. Some isozymes of protein kinase C (PKC) contain a domain, known as C2, of about 116 amino-acid residues, which is located between the two copies of the C1 domain (that bind phorbol esters and diacylglycerol) and the protein kinase catalytic domain. (Azzi A. et al., Eur. J. Biochem. 208:547-557 (1992); Stabel S., Semin. Cancer Biol. 5:277-284 (1994)).

The C2 domain is involved in calcium-dependent phospholipid binding (Davletov B. A., Suedhof T. C., J. Biol. Chem. 268:26386-26390 (1993)). Since domains related to the C2 domain are also found in proteins that do not bind calcium, other putative functions for the C2 domain include binding to inositol-1,3,5-tetraphosphate. (Fukuda M., et al., J. Biol. Chem. 269:29206-29211 (1994).)

The consensus pattern for the C2 domain is located in a conserved part of that domain, the connecting loop between beta strands 2 and 3. The profile for the C2 domain covers the total domain.

Serine proteases, trypsin family, active sites. One SEQ ID NO represents a polynucleotide encoding a novel member of the family of serine protease, trypsin proteins. The catalytic activity of the serine proteases from the trypsin family is provided by a charge relay system involving an aspartic acid residue hydrogen-bonded to a histidine, which itself is hydrogen-bonded to a serine. The sequences in the vicinity of the active site serine and histidine residues are well conserved in this family of proteases (Brenner S., Nature 334:528-530 (1988)).

RNA Recognition Motif Domain (RRM, RBD, or RNP). Some SEQ ID NOs represent polynucleotides encoding novel members of the family of RNA recognition motif domain proteins (Bandziulis R. J. et al., Genes Dev. 3:431-437 (1989); Dreyfuss G. et al., Trends Biochem. Sci. 13:86-91 (1988)).

Inside the putative RNA-binding domain there are two regions which are highly conserved. The first one is a hydrophobic segment of six residues (which is called the RNP-2 motif); the second one is an octapeptide motif (which is called RNP-1 or RNP-CS). The position of both motifs in the domain is shown in the following schematic representation:

```
xxxxxx#######xxxxxxxxxxxxxxxxxxxxxxxxx########xxxxxxxxxxxxxxxxxxxxxx
       RNP-2                                RNP-1
```

Phosphatidylinositol-specific phospholipase C, Y Domain. One SEQ ID NO represents a polynucleotide encoding a novel member of the phosphatidylinositol-specific phospholipase C, Y domain family of proteins. Phosphatidylinositol-specific phospholipase C (EC3.1.4.11), a eukaryotic intracellular enzyme, plays an important role in signal transduction processes (Meldrum E. et al., Biochim. Biophys. Acta 1092: 49-71 (1991)). It catalyzes the hydrolysis of 1-phosphatidyl-D-myo-inositol-3,4,5-triphosphate into the second messenger molecules diacylglycerol and inositol-1,4,5-triphosphate. This catalytic process is tightly regulated by reversible phosphorylation and binding of regulatory proteins (Rhee S. G., Choi K. D., Adv. Second Messenger Phosphoprotein Res. 26:35-61 (1992); Rhee S. G., Choi K. D., J. Biol. Chem. 267:12393-12396 (1992); Sternweis P. C., Smrcka A. V., Trends Biochem. Sci. 17:502-506 (1992)).

All eukaryotic PI-PLCs contain two regions of homology, referred to as "X-box" and "Y-box". The order of these two regions is the same (NH2-X—Y—COOH), but the spacing is variable. In most isoforms, the distance between these two regions is only 50-100 residues but in the gamma isoforms one PH domain, two SH2 domains, and one SH3 domain are inserted between the two PLC-specific domains. The two conserved regions have been shown to be important for the catalytic activity. At the C-terminal of the Y-box, there is a C2 domain possibly involved in Ca-dependent membrane attachment.

Serine Carboxypeptidases. One SEQ ID NO represents a polynucleotide encoding a novel member of the serine carboxypeptidases family of proteins. Carboxypeptidases may be either metallo carboxypeptidases or serine carboxypeptidases (EC 3.4.16.5 and EC 3.4.16.6). The catalytic activity of the serine carboxypeptidases, like that of the trypsin family serine proteases, is provided by a charge relay system involving an aspartic acid residue hydrogen-bonded to a histidine, which is itself hydrogen-bonded to a serine (Liao D. I., Remington S. J., *J. Biol. Chem.* 265:6528-6531 (1990)).

dsrm Double-Stranded RNA Binding Motif. One SEQ ID NO represents a polynucleotide encoding a novel member of the dsrm double-stranded RNA binding motif proteins. In eukaryotic cells, a multitude of RNA-binding proteins play key roles in the posttranscriptional regulation of gene expression. Characterization of these proteins has led to the identification of several RNA-binding motifs. Several human and other vertebrate genetic disorders are caused by aberrant expression of RNA-binding proteins. (C. G. Burd & G. Dreyfuss, *Science* 265: 615-621 (1994)).

Proteins containing double stranded RNA binding motifs bind to specific RNA targets. Double stranded RNA binding motifs are exemplified by interferon-induced protein kinase in humans, which is part of the cellular response to dsRNA.

Some SEQ ID NOs encode members of the 4 trans-membrane integral membrane protein family. This family consists of type III proteins, which are integral membrane proteins that contain a N-terminal membrane-anchoring domain that is not cleaved during biosynthesis, and which functions as a translocation signal and a membrane anchor. The proteins also have three additional transmembrane regions.

One SEQ ID NO encodes a polypeptide having a calpain large subunit, domain III. Calpains are a family of intracellular proteases that play a variety of biological roles. Calpain 3, also known as p94, is predominantly expressed in skeletal muscle and plays a role in limb-girdle muscular dystrophy type 2A. (Sorimachi, H. et al., Biochem. J. 328:721-732, 1997).

Some SEQ ID NOs encode polypeptides having a C3HC4 type zinc finger domain (RING finger), which is a cysteine-rich domain of 40 to 60 residues that binds two atoms of zinc, and is believed to be involved in mediating protein-protein interactions. Mammalian proteins of this family include V(D)J recombination activating protein, which activates the rearrangement of immunoglobulin and T-cell receptor genes; breast cancer type 1 susceptibility protein (BRCA1); bmi-1 proto-oncogene; cbl proto-oncogene; and mel-18 protein, which is expressed in a variety of tumor cells and is a transcriptional repressor that recognizes and binds a specific DNA sequence.

One SEQ ID NO encodes a eukaryotic transcription factor with a fork head domain, of about 100 amino acid residues. Proteins of this group are transcription factors, including mammalian transcription factors HNF-3-alpha, -beta, and -gamma; interleukin-enhancer binding factor; and HTLF, which binds to a region of human T-cell leukemia virus long terminal repeat.

One SEQ ID NO encodes a polypeptide having a PDZ domain. Several dozen signaling proteins belong to this group of proteins that have 80-100 residue repeats known as PDZ domains. Several of the proteins interact with the C-terminal tetrapeptide motifs X-Ser/Thr/X-Val-COO- of ion channels and/or receptors. (Ponting, C. P., Protein Sci. 6; 464-468, 1997.)

One SEQ ID NO encodes a polypeptide in the family of phorbol esters/glycerol binding proteins. Phorbol esters (PE) are analogues of diacylglycerol (DAG) and potent tumor promoters. DAG activates a family of serine-threonine protein kinases, known as protein kinase C. The N-terminal region of protein kinase C binds PE and DAG, and contains one or two copies of a cysteine-rich domain of about 50 amino acid residues. Other proteins having this domain include diacylglycerol kinase; the vav oncogene; and N-chimaerin, a brain-specific protein. The DAG/PE binding domain binds two zinc ions through the six cysteines and two histidines that are conserved in the domain.

One SEQ ID NO encodes a polypeptide having a WW/rsp5/WWP domain. The protein is named for the presence of conserved aromatic positions, generally tryptophan, as well as a conserved proline. Proteins having the domain include dystrophin, vertebrate YAP protein, and IQGAP, a human GTPase activating protein which acts on ras.

One SEQ ID NO encodes a member of the dual specificity phosphatase family, having a catalytic domain, and some SEQ IDS NOs encode members of the protein tyrosine phosphatase family. These families are related and classified as tyrosine specific protein phosphatases. The enzymes catalyze the removal of a phosphate group from a tyrosine residue, and are important in the control of cell growth, proliferation, differentiation, and transformation.

TABLE 87

| SEQ ID | Start | Stop | Score | Direction | Description |
|---|---|---|---|---|---|
| 9948 | 295 | 421 | 5872 | For | mkk like kinases |
| 9949 | 31 | 182 | 3943 | For | Basic region plus leucine zipper transcription factors |
| 9950 | 298 | 397 | 5625 | For | mkk like kinases |
| 10105 | 175 | 395 | 7660 | For | SH2 Domain |
| 10106 | 358 | 432 | 4320 | For | Ank repeat |
| 10115 | 37 | 322 | 6049 | For | mkk like kinases |
| 10153 | 23 | 121 | 4607 | For | SH3 Domain |
| 10227 | 110 | 172 | 4150 | For | Zinc finger, C2H2 type |
| 10329 | 42 | 191 | 4036 | For | Basic region plus leucine zipper transcription factors |
| 10350 | 71 | 428 | 5538 | Rev | ATPases Associated with Various Cellular Activities |
| 10471 | 116 | 288 | 3930 | Rev | Basic region plus leucine zipper transcription factors |
| 10558 | 157 | 561 | 5797 | For | ATPases Associated with Various Cellular Activities |
| 10665 | 209 | 427 | 5379 | For | Fibronectin type III domain |
| 10687 | 116 | 288 | 3930 | For | Basic region plus leucine zipper transcription factors |
| 10726 | 339 | 392 | 3620 | For | Zinc finger, C2H2 type |

TABLE 87-continued

| SEQ ID | Start | Stop | Score | Direction | Description |
| --- | --- | --- | --- | --- | --- |
| 10739 | 341 | 406 | 2930 | Rev | EF-hand |
| 10741 | 108 | 262 | 4179 | For | Basic region plus leucine zipper transcription factors |
| 10755 | 158 | 353 | 4430 | For | Basic region plus leucine zipper transcription factors |
| 11076 | 41 | 444 | 5279 | Rev | protein kinase |
| 11111 | 186 | 416 | 5469 | For | Fibronectin type III domain |
| 11187 | 238 | 315 | 3540 | For | Ank repeat |
| 11188 | 79 | 240 | 11640 | For | LIM domain containing proteins |
| 11207 | 73 | 234 | 3953 | For | Basic region plus leucine zipper transcription factors |
| 11228 | 248 | 404 | 8226 | for | LIM domain containing proteins |
| 11243 | 294 | 356 | 4690 | for | Zinc finger, C2H2 type |
| 11244 | 1 | 234 | 8981 | for | C2 domain (prot. kinase C like) |
| 11255 | 66 | 164 | 6390 | for | WD domain, G-beta repeats |
| 11279 | 222 | 377 | 8686 | for | LIM domain containing proteins |
| 11284 | 69 | 257 | 5221 | for | Basic region plus leucine zipper transcription factors |
| 11299 | 42 | 140 | 7130 | for | WD domain, G-beta repeats |
| 11305 | 243 | 398 | 8736 | for | LIM domain containing proteins |
| 11329 | 222 | 350 | 10553 | for | Trypsin |
| 11336 | 8 | 354 | 6073 | for | Protein Tyrosine Phosphatase |
| 11373 | 49 | 209 | 3996 | for | Basic region plus leucine zipper transcription factors |
| 11383 | 4 | 180 | 4978 | for | RNA recognition motif. (aka RRM, RBD, or RNP domain) |
| 11397 | 54 | 437 | 5176 | for | protein kinase |
| 11415 | 241 | 520 | 3929 | for | Helicases conserved C-terminal domain |
| 11415 | 40 | 612 | 5187 | for | protein kinase |
| 11422 | 154 | 216 | 4870 | for | Zinc finger, C2H2 type |
| 11433 | 2 | 252 | 4662 | for | RNA recognition motif. (aka RRM, RBD, or RNP domain) |
| 11446 | 156 | 212 | 3520 | for | Zinc finger, C2H2 type |
| 11457 | 9 | 635 | 11087 | for | wnt family of developmental signaling proteins |
| 11459 | 289 | 471 | 4107 | for | Basic region plus leucine zipper transcription factors |
| 11468 | 200 | 391 | 4118 | for | Basic region plus leucine zipper transcription factors |
| 11475 | 163 | 354 | 3958 | for | Basic region plus leucine zipper transcription factors |
| 11476 | 207 | 398 | 4038 | for | Basic region plus leucine zipper transcription factors |
| 11482 | 107 | 298 | 3978 | for | Basic region plus leucine zipper transcription factors |
| 11541 | 180 | 365 | 4022 | for | Basic region plus leucine zipper transcription factors |
| 11549 | 100 | 291 | 3998 | for | Basic region plus leucine zipper transcription factors |
| 11593 | 196 | 258 | 4880 | for | Zinc finger, C2H2 type |
| 11595 | 9 | 86 | 6610 | for | Homeobox Domain |
| 11596 | 316 | 369 | 5780 | rev | Thioredoxins |
| 11607 | 109 | 410 | 17414 | for | Ras family |
| 11623 | 184 | 372 | 3977 | for | Basic region plus leucine zipper transcription factors |
| 11626 | 92 | 439 | 24100 | rev | Phosphatidylinositol-specific phospholipase C, Y domain |
| 11630 | 263 | 361 | 6400 | for | WD domain, G-beta repeats |
| 11663 | 238 | 433 | 10572 | rev | Serine carboxypeptidases |
| 11674 | 281 | 367 | 2580 | for | EF-hand |
| 11681 | 236 | 334 | 5880 | for | WD domain, G-beta repeats |
| 11698 | 64 | 126 | 4790 | for | Zinc finger, C2H2 type. |
| 11720 | 295 | 351 | 4030 | for | Zinc finger, C2H2 type |
| 11723 | 301 | 378 | 3460 | for | Ank repeat |
| 11727 | 36 | 161 | 4170 | for | Basic region plus leucine zipper transcription factors |
| 11730 | 184 | 315 | 8390 | for | N-terminal homology in Ets domain |
| 11733 | 127 | 294 | 10770 | for | Bromodomain (conserved sequence found in human, *Drosophila* and yeast proteins.) |
| 11737 | 9 | 146 | 4741 | for | Double-stranded RNA binding motif |
| 11738 | 278 | 355 | 3460 | for | Ank repeat |
| 11739 | 123 | 299 | 12150 | for | Homeobox Domain |
| 11740 | 127 | 303 | 12180 | for | Homeobox Domain |
| 11749 | 184 | 267 | 4270 | for | Ank repeat |
| 11751 | 18 | 173 | 8987 | for | SH3 Domain |
| 11754 | 51 | 206 | 8987 | for | SH3 Domain |
| 11758 | 224 | 307 | 4270 | for | Ank repeat |

TABLE 87-continued

| SEQ ID | Start | Stop | Score | Direction | Description |
|---|---|---|---|---|---|
| 11765 | 12 | 398 | 36700 | for | G-protein alpha subunit |
| 11828 | 160 | 258 | 6370 | for | WD domain, G-beta repeats |
| 11830 | 35 | 151 | 9335 | for | Zinc finger, C3HC4 type (RING finger) |
| 11899 | 60 | 197 | 7917 | for | Zinc finger, C3HC4 type (RING finger) |
| 11984 | 253 | 306 | 5410 | for | Zinc finger, CCHC class |
| 12054 | 2 | 401 | 10596 | for | ATPases Associated with Various Cellular Activities |
| 12135 | 90 | 179 | 5380 | for | WW/rsp5/WWP domain containing proteins |
| 12137 | 127 | 225 | 5500 | for | WD domain, G-beta repeats |
| 12200 | 20 | 387 | 6044 | for | Protein Tyrosine Phosphatase |
| 12201 | 183 | 353 | 5136 | for | C2 domain (prot. kinase C like) |
| 12205 | 12 | 382 | 5228 | for | protein kinase |
| 12229 | 20 | 371 | 5962 | for | Protein Tyrosine Phosphatase |
| 12282 | 48 | 211 | 4132 | for | Basic region plus leucine zipper transcription factors |
| 12343 | 43 | 194 | 3996 | for | Basic region plus leucine zipper transcription factors |
| 12347 | 25 | 350 | 4675 | for | Dual specificity phosphatase, catalytic domain |
| 12481 | 18 | 101 | 4560 | for | Ank repeat |
| 12496 | 0 | 311 | 10295 | for | 4 transmembrane segments integral membrane proteins |
| 12510 | 60 | 165 | 4560 | for | SH2 Domain |
| 12603 | 9 | 461 | 5759 | for | ATPases Associated with Various Cellular Activities |
| 12745 | 116 | 400 | 16107 | for | DEAD and DEAH box helicases |
| 12778 | 100 | 320 | 5550 | rev | ATPases Associated with Various Cellular Activities |
| 12790 | 198 | 392 | 9384 | for | DEAD and DEAH box helicases |
| 12863 | 18 | 281 | 10480 | for | Calpain large subunit, domain III |
| 12888 | 5 | 387 | 5976 | rev | protein kinase |
| 12934 | 131 | 214 | 3600 | for | Ank repeat |
| 12966 | 191 | 292 | 5295 | for | WD domain, G-beta repeats |
| 13000 | 190 | 252 | 4360 | for | Zinc finger, C2H2 type |
| 13027 | 275 | 367 | 5791 | for | WD domain, G-beta repeats |
| 13066 | 190 | 369 | 4022 | for | Basic region plus leucine zipper transcription factors |
| 13071 | 129 | 320 | 3947 | for | Basic region plus leucine zipper transcription factors |
| 13077 | 167 | 334 | 4180 | for | Basic region plus leucine zipper transcription factors |
| 13094 | 14 | 164 | 5951 | for | mkk like kinases |
| 13094 | 8 | 112 | 5968 | for | protein kinase |
| 13097 | 45 | 386 | 19398 | for | ATPases Associated with Various Cellular Activities |
| 13102 | 14 | 215 | 9133 | for | 4 transmembrane segments integral membrane proteins |
| 13109 | 229 | 390 | 6089 | for | mkk like kinases |
| 13109 | 118 | 390 | 8063 | for | protein kinase |
| 13112 | 293 | 355 | 3570 | for | Zinc finger, C2H2 type |
| 13114 | 0 | 215 | 10146 | for | 4 transmembrane segments integral membrane proteins |
| 13116 | 281 | 343 | 4490 | for | Zinc finger, C2H2 type |
| 13127 | 34 | 256 | 4190 | for | Basic region plus leucine zipper transcription factors |
| 13177 | 138 | 394 | 9877 | for | Ras family |
| 13185 | 8 | 139 | 9328 | for | ATPases Associated with Various Cellular Activities |
| 13186 | 97 | 180 | 3820 | for | Ank repeat |
| 13193 | 11 | 187 | 15442 | for | Fork head domain, eukaryotic transcription factors |
| 13200 | 15 | 182 | 9681 | for | mkk like kinases |
| 13204 | 16 | 102 | 4680 | for | EF-hand |
| 13211 | 208 | 300 | 5585 | for | WD domain, G-beta repeats. |
| 13216 | 7 | 153 | 6100 | for | Helicases conserved C-terminal domain |
| 13225 | 161 | 223 | 4900 | for | Zinc finger, C2H2 type |
| 13226 | 43 | 321 | 8740 | for | SH2 Domain |
| 13258 | 94 | 342 | 14970 | for | SH2 Domain |
| 13264 | 65 | 271 | 12512 | for | PDZ domain |
| 13270 | 124 | 270 | 6068 | for | Phorbol esters/diacylglycerol binding |

Example 58

Differential Expression of Polynucleotides of the Invention: Description of Libraries and Detection of Differential Expression The relative expression levels of the polynucleotides of the invention was assessed in several libraries prepared from various sources, including cell lines and patient tissue samples. Table 88 provides a summary of these libraries, including the shortened library name (used hereafter), the mRNA source used to prepare the cDNA library, the abbreviated name of the library that is used in the tables below (in quotes), and the approximate number of clones in the library.

TABLE 88

Description of cDNA Libraries

| Library (lib #) | Description | Number of Clones in this Clustering |
|---|---|---|
| 1 | Km12 L4<br>Human Colon Cell Line, High Metastatic Potential (derived from Km12C)<br>"High Colon" | 307133 |
| 2 | Km12C<br>Human Colon Cell Line, Low Metastatic Potential<br>"Low Colon" | 284755 |
| 3 | MDA-MB-231<br>Human Breast Cancer Cell Line, High Metastatic Potential; micro-metastases in lung<br>"High Breast" | 326937 |
| 4 | MCF7<br>Human Breast Cancer Cell, Non Metastatic<br>"Low Breast" | 318979 |
| 8 | MV-522<br>Human Lung Cancer Cell Line, High Metastatic Potential<br>"High Lung" | 223620 |
| 9 | UCP-3<br>Human Lung Cancer Cell Line, Low Metastatic Potential<br>"Low Lung" | 312503 |
| 12 | Human microvascular endothelial cells (HMEC) - Untreated PCR (OligodT) cDNA library | 41938 |
| 13 | Human microvascular endothelial cells (HMEC) - Basic fibroblast growth factor (bFGF) treated PCR (OligodT) cDNA library | 42100 |
| 14 | Human microvascular endothelial cells (HMEC) - Vascular endothelial growth factor (VEGF) treated PCR (OligodT) cDNA library | 42825 |
| 15 | Normal Colon - UC#2 Patient PCR (OligodT) cDNA library "Normal Colon Tumor Tissue" | 34285 |
| 16 | Colon Tumor - UC#2 Patient PCR (OligodT) cDNA library "Normal Colon Tumor Tissue" | 35625 |
| 17 | Liver Metastasis from Colon Tumor of UC#2 Patient PCR (OligodT) cDNA library "High Colon Metastasis Tissue" | 36984 |
| 18 | Normal Colon - UC#3 Patient PCR (OligodT) cDNA library "Normal Colon Tumor Tissue" | 36216 |
| 19 | Colon Tumor - UC#3 Patient PCR (OligodT) cDNA library "High Colon Tumor Tissue" | 41388 |
| 20 | Liver Metastasis from Colon Tumor of UC#3 Patient PCR (OligodT) cDNA library "High Colon Metastasis Tissue" | 30956 |
| 21 | G RRpz<br>Human Prostate Cell Line | 164801 |
| 22 | WOca<br>Human Prostate Cancer Cell Line | 162088 |

The KM12L4 and KM12C cell lines are described in Example 55 above. The MDA-MB-231 cell line was originally isolated from pleural effusions (Cailleau, *J. Natl. Cancer. Inst.* (1974) 53:661), is of high metastatic potential, and forms poorly differentiated adenocarcinoma grade II in nude mice consistent with breast carcinoma. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., *Cancer Res.* (1979) 39:870 (MDA-MB-231 and MCF-7); Gastpar et al., *J Med Chem* (1998) 41:4965 (MDA-MB-231 and MCF-7); Ranson et al., *Br J Cancer* (1998) 77:1586 (MDA-MB-231 and MCF-7); Kuang et al., *Nucleic Acids Res* (1998) 26:1116 (MDA-MB-231 and MCF-7); Varki et al., *Int J Cancer* (1987) 40:46 (UCP-3); Varki et al., *Tumour Biol.* (1990) 11:327; (MV-522 and UCP-3); Varki et al., *Anticancer Res.* (1990) 10:637; (MV-522); Kelner et al., *Anticancer Res* (1995) 15:867 (MV-522); and Zhang et al., *Anticancer Drugs* (1997) 8:696 (MV522)). The samples of libraries 15-20 are derived from two different patients (UC#2, and UC#3). The bFGF-treated HMEC were prepared by incubation with bFGF at 10 ng/ml for 2 hrs; the VEGF-treated HMEC were prepared by incubation with 20 ng/ml VEGF for 2 hrs. Following incubation with the respective growth factor, the cells were washed and lysis buffer added for RNA preparation. The GRRpz cell line refers to low passage (3 passages or fewer) human prostate cells, and the WOca cell line refers to low passage (3 passages or fewer) human prostate cancer cells.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., *Genomics* (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$).

Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences between Proportions," pp 296-298 (1974)).

Example 59

Polynucleotides Differentially Expressed in High Metastatic Potential Breast Cancer Cells Versus Low Metastatic Breast Cancer Cells A number of polynucleotide sequences have been identified that are differentially expressed between cells derived from high metastatic potential breast cancer tissue and low metastatic breast cancer cells. Expression of these sequences in breast cancer can be valuable in determining diagnostic, prognostic and/or treatment information. For example, sequences that are highly expressed in the high metastatic potential cells can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

The differential expression of these polynucleotides can be used as a diagnostic marker, a prognostic maker, for risk assessment, patient treatment and the like. These polynucleotide sequence can also be used in combination with other known molecular and/or biochemical markers.

The following tables summarize polynucleotides that are differentially expressed between high metastatic potential breast cancer cells and low metastatic potential breast cancer cells.

TABLE 89

Differentially expressed polynucleotides: Higher expression in high metastatic potential breast cancer (lib3) relative to low metastatic breast cancer cells (lib4)

| SEQ ID NOs: | Lib3 clones | Lib4 clones | lib3/lib4 |
|---|---|---|---|
| 472 | 64 | 0 | 62 |
| 11770 | 6 | 0 | 6 |
| 11775 | 8 | 0 | 8 |
| 11786 | 6 | 0 | 6 |
| 11791 | 6 | 0 | 6 |
| 11794 | 12 | 3 | 4 |
| 11842 | 89 | 22 | 4 |
| 12037 | 7 | 0 | 7 |
| 12038 | 7 | 0 | 7 |
| 12054 | 37 | 13 | 3 |
| 12109 | 19 | 0 | 19 |
| 12112 | 16 | 5 | 3 |
| 12151 | 12 | 2 | 6 |
| 12158 | 6 | 0 | 6 |
| 12257 | 21 | 2 | 10 |
| 12297 | 16 | 4 | 4 |
| 12313 | 6 | 0 | 6 |
| 12314 | 6 | 0 | 6 |
| 12409 | 13 | 3 | 4 |
| 12424 | 16 | 2 | 8 |
| 12459 | 8 | 1 | 8 |
| 12461 | 11 | 1 | 11 |
| 12526 | 11 | 2 | 5 |
| 12559 | 22 | 5 | 4 |
| 12593 | 8 | 0 | 8 |
| 12598 | 19 | 0 | 19 |
| 12603 | 14 | 4 | 3 |
| 12626 | 8 | 0 | 8 |
| 12643 | 9 | 0 | 9 |
| 12676 | 6 | 0 | 6 |
| 12695 | 10 | 0 | 10 |
| 12723 | 13 | 2 | 6 |
| 12737 | 6 | 0 | 6 |
| 12825 | 14 | 0 | 14 |
| 12878 | 26 | 8 | 3 |
| 12883 | 17 | 4 | 4 |
| 12887 | 6 | 0 | 6 |
| 12896 | 22 | 3 | 7 |
| 12899 | 13 | 1 | 13 |
| 12929 | 6 | 0 | 6 |
| 12962 | 10 | 1 | 10 |
| 12990 | 33 | 12 | 3 |
| 12991 | 9 | 1 | 9 |
| 13014 | 19 | 3 | 6 |
| 13016 | 11 | 2 | 5 |
| 13092 | 12 | 2 | 6 |
| 13122 | 8 | 1 | 8 |
| 13129 | 27 | 8 | 3 |
| 13131 | 13 | 1 | 13 |
| 13203 | 8 | 0 | 8 |
| 13207 | 6 | 0 | 6 |
| 13250 | 14 | 3 | 5 |
| 13254 | 13 | 1 | 13 |

TABLE 90

Differentially expressed polynucleotides: Higher expression in low metastatic breast cancer cells (lib4) relative to high metastatic potential breast cancer (lib3)

| SEQ ID NOs: | Lib 3 Clones | Lib 4 Clones | lib4/lib3 |
|---|---|---|---|
| 10321 | 0 | 6 | 6 |
| 10533 | 3 | 21 | 7 |
| 10543 | 0 | 6 | 6 |
| 10545 | 0 | 8 | 8 |
| 10631 | 0 | 9 | 9 |
| 10663 | 0 | 7 | 7 |
| 11244 | 2 | 29 | 15 |
| 11371 | 2 | 13 | 7 |

TABLE 90-continued

Differentially expressed polynucleotides: Higher expression in low metastatic breast cancer cells (lib4) relative to high metastatic potential breast cancer (lib3)

| SEQ ID NOs: | Lib 3 Clones | Lib 4 Clones | lib4/lib3 |
|---|---|---|---|
| 11799 | 0 | 9 | 9 |
| 11834 | 0 | 7 | 7 |
| 11870 | 0 | 6 | 6 |
| 11874 | 8 | 32 | 4 |
| 11934 | 0 | 7 | 7 |
| 11965 | 0 | 7 | 7 |
| 11995 | 1 | 22 | 23 |
| 12006 | 0 | 6 | 6 |
| 12043 | 0 | 9 | 9 |
| 12064 | 0 | 8 | 8 |
| 12081 | 0 | 6 | 6 |
| 12082 | 0 | 12 | 12 |
| 12083 | 5 | 19 | 4 |
| 12091 | 2 | 15 | 8 |
| 12111 | 5 | 16 | 3 |
| 12163 | 20 | 43 | 2 |
| 12185 | 3 | 18 | 6 |
| 12232 | 24 | 56 | 2 |
| 12265 | 1 | 13 | 13 |
| 12274 | 0 | 10 | 10 |
| 12290 | 0 | 6 | 6 |
| 12312 | 1 | 17 | 17 |
| 12323 | 1 | 21 | 22 |
| 12362 | 0 | 6 | 6 |
| 12379 | 0 | 11 | 11 |
| 12442 | 0 | 6 | 6 |
| 12494 | 1 | 10 | 10 |
| 12497 | 0 | 6 | 6 |
| 12503 | 1 | 17 | 17 |
| 12509 | 0 | 6 | 6 |
| 12528 | 1 | 9 | 9 |
| 12551 | 5 | 24 | 5 |
| 12633 | 5 | 24 | 5 |
| 12647 | 0 | 6 | 6 |
| 12671 | 1 | 14 | 14 |
| 12713 | 4 | 15 | 4 |
| 12745 | 0 | 7 | 7 |
| 12906 | 5 | 15 | 3 |
| 12924 | 1 | 14 | 14 |
| 12928 | 20 | 58 | 3 |
| 12966 | 4 | 17 | 4 |
| 12976 | 2 | 17 | 9 |
| 12994 | 2 | 11 | 6 |
| 12995 | 0 | 6 | 6 |
| 13021 | 0 | 6 | 6 |
| 13047 | 15 | 52 | 4 |
| 13051 | 15 | 52 | 4 |
| 13061 | 0 | 6 | 6 |
| 13106 | 22 | 49 | 2 |
| 13172 | 23 | 96 | 4 |
| 13201 | 19 | 46 | 2 |
| 13204 | 20 | 40 | 2 |
| 13265 | 0 | 9 | 9 |

Example 60

Polynucleotides Differentially Expressed in High Metastatic Potential Lung Cancer Cells Versus Low Metastatic Lung Cancer Cells A number of polynucleotide sequences have been identified that are differentially expressed between cells derived from high metastatic potential lung cancer cells and low metastatic lung cancer cells. Expression of these sequences in lung cancer tissue can be valuable in determining diagnostic, prognostic and/or treatment information. For example, sequences that are highly expressed in the high metastatic potential cells can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

The differential expression of these polynucleotides can be used as a diagnostic marker, a prognostic marker, for risk assessment, patient treatment and the like. These polynucleotide sequences can also be used in combination with other known molecular and/or biochemical markers.

The following tables summarize polynucleotides that are differentially expressed between high metastatic potential lung cancer cells and low metastatic potential lung cancer cells:

TABLE 91

Differentially expressed polynucleotides: Higher expression in high metastatic potential lung cancer cells (lib8) relative to low metastatic lung cancer cells (lib9)

| SEQ ID NO: | Lib8 clones | Lib9 clones | lib8/lib9 |
|---|---|---|---|
| 9933 | 10 | 0 | 10 |
| 10056 | 5 | 0 | 5 |
| 10070 | 5 | 0 | 7 |
| 10071 | 9 | 0 | 13 |
| 10090 | 6 | 0 | 8 |
| 10119 | 10 | 0 | 14 |
| 10173 | 5 | 0 | 7 |
| 10181 | 5 | 0 | 7 |
| 10190 | 5 | 0 | 7 |
| 10267 | 6 | 1 | 8 |
| 10331 | 5 | 0 | 7 |
| 10426 | 5 | 0 | 7 |
| 10439 | 6 | 0 | 8 |
| 10449 | 5 | 0 | 7 |
| 10507 | 5 | 0 | 7 |
| 10542 | 7 | 0 | 10 |
| 10556 | 7 | 0 | 10 |
| 10579 | 5 | 0 | 7 |
| 10597 | 8 | 0 | 11 |
| 10599 | 5 | 0 | 7 |
| 10619 | 9 | 2 | 6 |
| 10633 | 28 | 13 | 3 |
| 10693 | 11 | 0 | 15 |
| 10731 | 5 | 0 | 7 |
| 10753 | 8 | 2 | 6 |
| 10820 | 11 | 2 | 8 |
| 11087 | 5 | 0 | 7 |
| 11252 | 6 | 0 | 8 |
| 11271 | 5 | 0 | 7 |
| 11443 | 11 | 1 | 15 |
| 11625 | 5 | 0 | 7 |
| 11671 | 17 | 9 | 3 |
| 11687 | 20 | 4 | 7 |
| 11688 | 5 | 0 | 7 |
| 11699 | 6 | 0 | 8 |
| 11700 | 40 | 3 | 19 |
| 11718 | 6 | 1 | 8 |
| 11722 | 6 | 1 | 8 |
| 11730 | 16 | 9 | 2 |
| 11803 | 6 | 0 | 8 |
| 11838 | 8 | 1 | 11 |
| 11858 | 6 | 0 | 8 |
| 11894 | 43 | 9 | 7 |
| 11943 | 12 | 1 | 17 |
| 11964 | 8 | 1 | 11 |
| 11979 | 20 | 13 | 2 |
| 11990 | 16 | 4 | 6 |
| 12047 | 5 | 0 | 7 |
| 12096 | 10 | 2 | 7 |
| 12100 | 44 | 13 | 5 |
| 12103 | 11 | 1 | 15 |

TABLE 91-continued

Differentially expressed polynucleotides: Higher expression in high metastatic potential lung cancer cells (lib8) relative to low metastatic lung cancer cells (lib9)

| SEQ ID NO: | Lib8 clones | Lib9 clones | lib8/lib9 |
|---|---|---|---|
| 12104 | 10 | 4 | 3 |
| 12202 | 7 | 0 | 10 |
| 12230 | 10 | 4 | 3 |
| 12233 | 10 | 0 | 14 |
| 12312 | 14 | 6 | 3 |
| 12317 | 6 | 1 | 8 |
| 12379 | 10 | 4 | 3 |
| 12433 | 6 | 0 | 8 |
| 12516 | 5 | 0 | 7 |
| 12576 | 8 | 2 | 6 |
| 12588 | 6 | 1 | 8 |
| 12589 | 6 | 1 | 8 |
| 12966 | 21 | 3 | 10 |
| 12969 | 16 | 5 | 4 |
| 13011 | 7 | 1 | 10 |
| 13059 | 181 | 119 | 2 |
| 13076 | 5 | 0 | 7 |
| 13106 | 16 | 5 | 4 |
| 13129 | 5 | 0 | 7 |
| 13139 | 28 | 4 | 10 |
| 13155 | 7 | 1 | 10 |
| 13168 | 16 | 0 | 22 |
| 13183 | 8 | 2 | 6 |
| 13224 | 7 | 0 | 10 |
| 13228 | 20 | 0 | 28 |
| 13237 | 24 | 4 | 8 |
| 13249 | 5 | 0 | 7 |
| 13250 | 5 | 0 | 7 |

TABLE 92

Differentially expressed polynucleotides: Higher expression in low metastatic lung cancer cells (lib 9) relative to high metastatic potential lung cancer cells (lib 8)

| SEQ ID NO: | Lib 8 clones | Lib 9 clones | lib 9/lib 8 |
|---|---|---|---|
| 9943 | 3 | 20 | 5 |
| 9972 | 0 | 18 | 13 |
| 9983 | 0 | 8 | 6 |
| 9989 | 0 | 11 | 8 |
| 10024 | 10 | 66 | 5 |
| 10048 | 0 | 16 | 11 |
| 10133 | 1 | 14 | 10 |
| 10152 | 4 | 35 | 6 |
| 10156 | 0 | 13 | 9 |
| 10183 | 0 | 29 | 21 |
| 10248 | 2 | 17 | 6 |
| 10287 | 1 | 37 | 26 |
| 10289 | 0 | 11 | 8 |
| 10337 | 0 | 8 | 6 |
| 10369 | 0 | 9 | 6 |
| 10380 | 0 | 9 | 6 |
| 10403 | 0 | 26 | 19 |
| 10413 | 0 | 41 | 29 |
| 10436 | 1 | 12 | 9 |
| 10441 | 1 | 11 | 8 |
| 10500 | 1 | 17 | 12 |
| 10533 | 3 | 23 | 5 |
| 10625 | 0 | 11 | 8 |
| 10645 | 5 | 23 | 3 |
| 10725 | 0 | 14 | 10 |
| 10743 | 0 | 9 | 6 |
| 10755 | 1 | 14 | 10 |
| 10793 | 0 | 12 | 9 |
| 10819 | 5 | 21 | 3 |
| 10936 | 2 | 14 | 5 |
| 11063 | 0 | 8 | 6 |
| 11073 | 0 | 12 | 9 |
| 11085 | 2 | 45 | 16 |
| 11089 | 1 | 13 | 9 |

TABLE 92-continued

Differentially expressed polynucleotides: Higher expression in low metastatic lung cancer cells (lib 9) relative to high metastatic potential lung cancer cells (lib 8)

| SEQ ID NO: | Lib 8 clones | Lib 9 clones | lib 9/lib 8 |
|---|---|---|---|
| 11221 | 2 | 13 | 5 |
| 11245 | 1 | 13 | 9 |
| 11246 | 1 | 13 | 9 |
| 11286 | 0 | 12 | 9 |
| 11296 | 0 | 12 | 9 |
| 11356 | 2 | 18 | 6 |
| 11361 | 1 | 14 | 10 |
| 11385 | 0 | 13 | 9 |
| 11395 | 0 | 13 | 9 |
| 11414 | 0 | 8 | 6 |
| 11415 | 1 | 13 | 9 |
| 11583 | 38 | 253 | 5 |
| 11601 | 1 | 17 | 12 |
| 11606 | 0 | 9 | 6 |
| 11677 | 0 | 8 | 6 |
| 11736 | 4 | 18 | 3 |
| 11756 | 3 | 16 | 4 |
| 11764 | 3 | 23 | 5 |
| 11775 | 2 | 17 | 6 |
| 11829 | 1 | 18 | 13 |
| 12065 | 2 | 16 | 9 |
| 12075 | 0 | 9 | 6 |
| 12382 | 0 | 12 | 9 |
| 12643 | 10 | 38 | 3 |
| 12668 | 403 | 2000 | 4 |
| 12720 | 6 | 25 | 3 |
| 12912 | 3 | 18 | 4 |
| 12999 | 0 | 10 | 7 |
| 13026 | 3 | 23 | 5 |
| 13211 | 0 | 20 | 14 |
| 13243 | 110 | 548 | 4 |

Example 61

Polynucleotides Differentially Expressed in High Metastatic Potential Colon Cancer Cells Versus Low Metastatic Colon Cancer Cells A number of polynucleotide sequences have been identified that are differentially expressed between cells derived from high metastatic potential colon cancer cells and low metastatic colon cancer cells. Expression of these sequences in colon cancer tissue can provide diagnostic, prognostic and/or treatment information. For example, sequences that are highly expressed in the high metastatic potential cells can be indicative of increased expression of genes or regulatory sequences involved in the metastatic process. A patient sample displaying an increased level of one or more of these polynucleotides may thus warrant more aggressive treatment. In another example, sequences that display higher expression in the low metastatic potential cells can be associated with genes or regulatory sequences that inhibit metastasis, and thus the expression of these polynucleotides in a sample may warrant a more positive prognosis than the gross pathology would suggest.

The differential expression of these polynucleotides can be used as a diagnostic marker, a prognostic marker, for risk assessment, patient treatment and the like. These polynucleotide sequences can also be used in combination with other known molecular and/or biochemical markers.

The following table summarizes identified polynucleotides with differential expression between high metastatic potential colon cancer cells and low metastatic potential colon cancer cells:

TABLE 93

Differentially expressed polynucleotides: Higher expression in low metastatic colon cancer cells (lib 2) relative to high metastatic potential colon cancer cells (lib 1)

| SEQ ID NOs: | Lib 1 clones | Lib 2 clones | lib 2/lib 1 |
|---|---|---|---|
| 10348 | 0 | 9 | 10 |
| 11413 | 0 | 8 | 9 |
| 11842 | 34 | 114 | 4 |
| 11905 | 3 | 12 | 4 |
| 11937 | 0 | 9 | 10 |
| 11955 | 2 | 10 | 5 |
| 11968 | 8 | 25 | 3 |
| 12054 | 24 | 87 | 4 |
| 12065 | 2 | 16 | 9 |
| 12127 | 6 | 27 | 5 |
| 12134 | 2 | 11 | 6 |
| 12158 | 1 | 10 | 11 |
| 12226 | 2 | 12 | 6 |
| 12232 | 28 | 62 | 2 |
| 12276 | 5 | 14 | 3 |
| 12279 | 3 | 21 | 8 |
| 12281 | 0 | 6 | 6 |
| 12297 | 3 | 12 | 4 |
| 12488 | 3 | 20 | 7 |
| 12490 | 0 | 6 | 6 |
| 12507 | 54 | 172 | 3 |
| 12511 | 15 | 41 | 3 |
| 12530 | 0 | 6 | 6 |
| 12555 | 0 | 9 | 10 |
| 12560 | 7 | 20 | 3 |
| 12569 | 0 | 9 | 10 |
| 12581 | 0 | 9 | 10 |
| 12593 | 4 | 13 | 4 |
| 12601 | 0 | 6 | 6 |
| 12621 | 9 | 25 | 3 |
| 12623 | 8 | 23 | 3 |
| 12634 | 2 | 12 | 6 |
| 12723 | 9 | 22 | 3 |
| 12740 | 13 | 29 | 2 |
| 12759 | 1 | 8 | 9 |
| 12765 | 2 | 15 | 8 |
| 12785 | 0 | 6 | 6 |
| 12825 | 0 | 6 | 6 |
| 12834 | 44 | 109 | 3 |
| 12852 | 0 | 6 | 6 |
| 12854 | 5 | 16 | 3 |
| 12876 | 1 | 11 | 12 |
| 12878 | 3 | 27 | 10 |
| 12896 | 16 | 30 | 2 |
| 12899 | 12 | 27 | 2 |
| 12919 | 2 | 13 | 7 |
| 12928 | 12 | 29 | 3 |
| 13034 | 0 | 7 | 8 |
| 13075 | 502 | 2170 | 5 |
| 13129 | 2 | 21 | 11 |
| 13130 | 0 | 9 | 10 |
| 13132 | 0 | 7 | 8 |
| 13154 | 2 | 12 | 6 |
| 13170 | 2 | 12 | 6 |
| 13215 | 3 | 12 | 4 |
| 13254 | 1 | 8 | 9 |

Example 62

Polynucleotides Differentially Expressed in High Metastatic Potential Colon Cancer Patient Tissue Versus Normal Patient Tissue A number of polynucleotide sequences have been identified that are differentially expressed between cells derived from high metastatic potential colon cancer tissue and normal tissue. Expression of these sequences in colon cancer tissue can provide diagnostic, prognostic and/or treatment information. For example, sequences that are highly expressed in the high metastatic potential cells can be indicative of increased expression of genes or regulatory sequences involved in the advanced disease state which involves processes such as angiogenesis, differentiation, cell replication, and metastasis. A patient sample displaying an increased level of one or more of these polynucleotides may thus warrant more aggressive treatment.

The differential expression of these polynucleotides can be used as a diagnostic marker, a prognostic marker, for risk assessment, patient treatment and the like. These polynucleotide sequences can also be used in combination with other known molecular and/or biochemical markers.

The following tables summarize polynucleotides that are differentially expressed between high metastatic potential colon cancer tissue and normal colon tissue:

TABLE 94

Differentially expressed polynucleotides isolated from samples from two patients (patient 2 and patient 3 and): Lower expression in high metastatic potential colon tissue (patient 2: lib 17; patient 3: lib 20) vs. normal colon tissue (patient 2: lib 15; patient 3: lib 18)

| SEQ ID NO: | lib 15 clones | lib 17 clones | lib 15/lib 17 |
|---|---|---|---|
| 9988 | 19 | 7 | 3 |
| 10042 | 6 | 0 | 6 |
| 10059 | 24 | 8 | 3 |
| 10116 | 6 | 0 | 6 |
| 10117 | 113 | 0 | 121 |
| 10173 | 28 | 9 | 3 |
| 10331 | 28 | 9 | 3 |
| 10431 | 11 | 1 | 12 |
| 10560 | 17 | 7 | 3 |
| 10561 | 7 | 0 | 8 |
| 10873 | 12 | 3 | 4 |
| 10930 | 209 | 16 | 14 |
| 10943 | 8 | 0 | 9 |
| 10959 | 12 | 3 | 4 |
| 10974 | 26 | 7 | 4 |
| 11025 | 31 | 15 | 2 |
| 11044 | 17 | 0 | 18 |
| 11048 | 17 | 0 | 18 |
| 11057 | 109 | 0 | 117 |
| 11163 | 14 | 1 | 15 |
| 11172 | 73 | 0 | 78 |
| 11202 | 34 | 7 | 5 |
| 11204 | 34 | 7 | 5 |
| 11258 | 13 | 4 | 3 |
| 11393 | 73 | 0 | 78 |
| 11424 | 18 | 3 | 6 |
| 11472 | 68 | 6 | 12 |
| 11473 | 2542 | 14 | 195 |
| 11524 | 2542 | 14 | 195 |
| 11547 | 6 | 0 | 6 |
| 11562 | 142 | 4 | 38 |
| 11672 | 12 | 0 | 10 |
| 11683 | 13 | 0 | 14 |

| SEQ ID NO: | Lib18 Clones | Lib20 Clones | lib18/lib20 |
|---|---|---|---|
| 10024 | 28 | 11 | 2 |
| 10117 | 21 | 0 | 18 |
| 10173 | 9 | 0 | 8 |
| 10331 | 9 | 0 | 8 |
| 10930 | 11 | 1 | 9 |
| 11057 | 14 | 0 | 12 |
| 11172 | 23 | 0 | 20 |
| 11562 | 18 | 0 | 15 |
| 11683 | 12 | 0 | 10 |
| 13075 | 140 | 43 | 3 |

TABLE 95

Differentially expressed polynucleotides isolated from samples from two patients (patient 2 and patient 3): Lower expression in normal colon tissue (patient 2: lib 15; patient 3: lib 18)vs. high metastatic potential colon tissue (patient 2: lib 17; patient 3: lib 20).

| SEQ ID NO: | Lib 15 Clones | Lib 17 Clones | lib 17/lib 15 |
|---|---|---|---|
| 10240 | 3 | 23 | 7 |
| 10282 | 1 | 9 | 8 |
| 10755 | 21 | 99 | 4 |
| 10778 | 6 | 20 | 3 |
| 10804 | 13 | 28 | 2 |
| 10835 | 13 | 28 | 2 |
| 10900 | 2 | 11 | 5 |
| 11145 | 8 | 70 | 8 |
| 11227 | 0 | 8 | 7 |
| 11236 | 29 | 84 | 3 |
| 11348 | 27 | 127 | 4 |
| 11361 | 0 | 9 | 8 |
| 11453 | 1 | 12 | 11 |
| 11459 | 12 | 43 | 3 |
| 11471 | 0 | 7 | 7 |
| 11475 | 1 | 9 | 8 |
| 11476 | 1 | 9 | 8 |
| 11488 | 2189 | 5122 | 2 |
| 11490 | 6 | 18 | 3 |
| 11495 | 3 | 25 | 8 |
| 11500 | 4 | 22 | 5 |
| 11520 | 25 | 157 | 6 |
| 11532 | 9 | 48 | 5 |
| 11535 | 15 | 61 | 4 |
| 11539 | 2 | 17 | 8 |
| 11541 | 4 | 99 | 23 |
| 11545 | 6 | 35 | 5 |
| 11566 | 4 | 22 | 5 |
| 11583 | 4 | 28 | 7 |
| 11602 | 2 | 18 | 8 |
| 11623 | 3 | 15 | 5 |
| 11719 | 0 | 7 | 7 |
| 12668 | 23 | 60 | 2 |
| 12703 | 4 | 14 | 3 |
| 12724 | 1 | 9 | 8 |
| 12895 | 3 | 14 | 4 |
| 13047 | 18 | 57 | 3 |
| 13048 | 26 | 124 | 4 |
| 13065 | 64 | 210 | 3 |
| 13069 | 940 | 2267 | 2 |
| 13070 | 2 | 15 | 7 |
| SEQ ID NO: | lib 18 clones | lib 20 clones | lib 20/lib 18 |
| 10784 | 0 | 5 | 6 |
| 11488 | 1 | 7 | 8 |
| 11499 | 1 | 7 | 8 |
| 11509 | 1 | 7 | 8 |
| 12709 | 0 | 5 | 6 |

Example 63

Polynucleotides Differentially Expressed in High Colon Tumor Potential Patient Tissue Versus Metastasized Colon Cancer Patient Tissue A number of polynucleotide sequences have been identified that are differentially expressed between cells derived from colon cancer tissue and cells derived from colon cancer tissue metastases to liver. Expression of these sequences in colon cancer tissue can provide diagnostic, prognostic and/or treatment information associated with the transformation of precancerous tissue to malignant tissue. This information can be useful in the prevention of achieving the advanced malignant state in these tissues, and can be important in risk assessment for a patient.

The following table summarizes identified polynucleotides with differential expression between high tumor potential colon cancer tissue and cells derived from high metastatic potential colon cancer cells:

TABLE 96

Differentially expressed polynucleotides: Greater expression in metastatic colon tumor tissue (lib 20) vs. colon tumor tissue (lib 19)

| SEQ ID NO: | lib 19 clones | lib 20 clones | lib 20/lib 19 |
|---|---|---|---|
| 10856 | 0 | 6 | 8 |
| 10895 | 0 | 5 | 7 |
| 11439 | 1 | 8 | 11 |
| 11465 | 1 | 11 | 15 |
| 11469 | 1 | 11 | 15 |
| 11493 | 1 | 8 | 11 |
| 11499 | 0 | 7 | 9 |
| 11509 | 0 | 7 | 9 |
| 11518 | 8 | 21 | 4 |
| 11526 | 158 | 632 | 5 |
| 11541 | 1 | 7 | 9 |

TABLE 97

Greater expression in colon tumor tissue (lib 19) than metastatic colon tissue (lib 20)

| SEQ ID NO: | lib 19 clones | lib 20 clones | lib 19/lib 20 |
|---|---|---|---|
| 10024 | 64 | 11 | 4 |
| 10930 | 53 | 1 | 40 |
| 11145 | 18 | 4 | 3 |
| 11490 | 8 | 0 | 6 |
| 11645 | 15 | 3 | 4 |
| 11730 | 17 | 2 | 6 |
| 12668 | 47 | 6 | 6 |
| 13065 | 19 | 2 | 7 |
| 13243 | 20 | 1 | 15 |

Example 64

Polynucleotides Differentially Expressed in High Tumor Potential Colon Cancer Patient Tissue Versus Normal Patient Tissue A number of polynucleotide sequences have been identified that are differentially expressed between cells derived from high tumor potential colon cancer tissue and normal tissue. Expression of these sequences in colon cancer tissue can provide diagnostic, prognostic and/or treatment information associated with the prevention of the malignant state in these tissues, and can be important in risk assessment for a patient. For example, sequences that are highly expressed in the potential colon cancer cells are associated with or can be indicative of increased expression of genes or regulatory sequences involved in early tumor progression. A patient sample displaying an increased level of one or more of these polynucleotides may thus warrant closer attention or more frequent screening procedures to catch the malignant state as early as possible.

The following tables summarize polynucleotides that are differentially expressed between high metastatic potential colon cancer cells and normal colon cells:

TABLE 98

Differentially expressed polynucleotides detected in samples from patient (patient 2) Higher expression in normal colon tissue (patient 2, lib 15) vs. tumor potential colon tissue (patient 2: lib 16)

| SEQ ID NO: | lib 15 clones | lib 16 clones | lib 16/lib 15 |
|---|---|---|---|
| 9988 | 19 | 7 | 3 |
| 10024 | 116 | 54 | 2 |
| 10059 | 24 | 4 | 6 |
| 10116 | 6 | 0 | 6 |
| 10117 | 113 | 3 | 40 |
| 10173 | 28 | 6 | 5 |
| 10331 | 28 | 6 | 5 |
| 10561 | 7 | 0 | 7 |
| 10749 | 10 | 2 | 5 |
| 10857 | 31 | 13 | 3 |
| 10930 | 209 | 37 | 6 |
| 11014 | 12 | 3 | 4 |
| 11044 | 17 | 0 | 18 |
| 11048 | 17 | 0 | 18 |
| 11057 | 109 | 1 | 115 |
| 11172 | 73 | 1 | 77 |
| 11202 | 34 | 13 | 3 |
| 11204 | 34 | 13 | 3 |
| 11258 | 13 | 3 | 5 |
| 11372 | 11 | 3 | 4 |
| 11393 | 73 | 1 | 77 |
| 11424 | 18 | 6 | 3 |
| 11473 | 2542 | 448 | 6 |
| 11524 | 2542 | 448 | 6 |
| 11533 | 36 | 14 | 3 |
| 11549 | 24 | 9 | 3 |
| 11562 | 142 | 2 | 75 |
| 11565 | 39 | 14 | 3 |
| 11568 | 24 | 8 | 3 |
| 11596 | 19 | 6 | 3 |
| 11672 | 13 | 0 | 14 |
| 11683 | 13 | 0 | 14 |
| 11685 | 177 | 65 | 3 |
| 11691 | 24 | 8 | 3 |

TABLE 99

Differentially expressed polypeptides detected in samples from patient. Lower expression in normal colon tissue (lib 18) than colon tumor tissue (lib 19)

| SEQ ID NO: | lib 18 clones | lib 19 clones | lib 19/lib 18 |
|---|---|---|---|
| 13065 | 3 | 19 | 6 |
| 13069 | 21 | 228 | 10 |
| 13243 | 3 | 20 | 6 |

TABLE 100

Differentially expressed polypeptides detected in samples from patient. Higher expression in normal colon tissue (lib 18) than colon tumor tissue (lib 19)

| SEQ ID NO: | lib 18 clones | lib 19 clones | lib 18/lib 19 |
|---|---|---|---|
| 10117 | 21 | 2 | 12 |
| 10384 | 6 | 0 | 7 |
| 10408 | 6 | 0 | 7 |
| 10664 | 6 | 0 | 7 |
| 10778 | 11 | 2 | 6 |
| 10895 | 7 | 0 | 8 |
| 10930 | 209 | 37 | 6 |
| 10964 | 8 | 1 | 9 |
| 11057 | 14 | 0 | 16 |
| 11172 | 23 | 0 | 26 |
| 11311 | 16 | 4 | 5 |
| 11393 | 23 | 0 | 26 |
| 11508 | 6 | 0 | 7 |
| 11510 | 22 | 11 | 2 |
| 11526 | 386 | 158 | 3 |
| 11562 | 18 | 0 | 21 |
| 11672 | 12 | 0 | 14 |
| 11683 | 12 | 0 | 14 |

| SEQ ID NO: | lib 18 clones | lib 19 clones | lib 19/lib 18 |
|---|---|---|---|
| 10024 | 28 | 64 | 2 |
| 10930 | 11 | 53 | 4 |
| 11145 | 2 | 18 | 8 |
| 11170 | 6 | 19 | 3 |
| 11478 | 1 | 9 | 8 |
| 11490 | 0 | 8 | 7 |
| 11527 | 1 | 9 | 8 |
| 11685 | 2 | 13 | 6 |
| 11701 | 1 | 9 | 8 |
| 11730 | 1 | 17 | 15 |

TABLE 101

Differentially expressed polynucleotides: Higher expression in colon tumor tissue (patient 2, lib 16) vs. normal colon tissue (patient 2, lib 15)

| SEQ ID NO: | lib 15 clones | lib 16 clones | lib 16/lib 15 |
|---|---|---|---|
| 9926 | 1 | 9 | 9 |
| 10083 | 6 | 19 | 3 |
| 10653 | 4 | 15 | 4 |
| 10755 | 21 | 53 | 2 |
| 10847 | 2 | 11 | 5 |
| 10884 | 2 | 11 | 5 |
| 10906 | 2 | 11 | 5 |
| 10945 | 7 | 19 | 3 |
| 10963 | 4 | 16 | 4 |
| 11038 | 4 | 16 | 4 |
| 11145 | 8 | 46 | 5 |
| 11146 | 0 | 9 | 9 |
| 11170 | 7 | 95 | 13 |
| 11235 | 0 | 6 | 6 |
| 11348 | 27 | 81 | 3 |
| 11361 | 0 | 9 | 9 |
| 11459 | 12 | 28 | 2 |
| 11472 | 68 | 590 | 8 |
| 11479 | 4 | 24 | 6 |
| 11496 | 1 | 10 | 9 |
| 11507 | 5 | 20 | 4 |
| 11529 | 3 | 13 | 4 |
| 11539 | 2 | 23 | 11 |
| 11545 | 6 | 23 | 4 |
| 11592 | 2 | 15 | 7 |
| 12335 | 0 | 7 | 7 |
| 12668 | 23 | 54 | 2 |
| 12895 | 3 | 14 | 4 |
| 13048 | 26 | 64 | 2 |
| 13051 | 18 | 54 | 3 |

Example 65

Polynucleotides Differentially Expressed in Growth Factor-Stimulated Human Microvascular Endothelial Cells (HMEC) Relative to Untreated HMEC A number of polynucleotide sequences have been identified that are differentially expressed between human microvascular endothelial cells (HMEC) that have been treated with growth factors relative to untreated HMEC.

Sequences that are differentially expressed between growth factor-treated HMEC and untreated HMEC can represent sequences encoding gene products involved in angiogenesis, metastasis (cell migration), and other developmental and oncogenic processes. For example, sequences that are more highly expressed in HMEC treated with growth factors (such as bFGF or VEGF) relative to untreated HMEC can serve as markers of cancer cells of higher metastatic potential. Detection of expression of these sequences in colon cancer tissue can provide diagnostic, prognostic and/or treatment information associated with the prevention of achieving the malignant state in these tissues, and can be important in risk assessment for a patient. A patient sample displaying an increased level of one or more of these polynucleotides may thus warrant closer attention or more frequent screening procedures to catch the malignant state as early as possible.

The following table summarizes identified polynucleotides with differential expression between growth factor-treated and untreated HMEC.

TABLE 102

Differentially expressed polynucleotides:

| SEQ ID NO: | lib 12 clones | lib 13 clones | lib 12/lib 13 |
|---|---|---|---|
| Higher expression in untreated HMEC (lib 12) vs. bFGF treated HMEC (lib 13) | | | |
| 10768 | 6 | 0 | 6 |
| 10978 | 6 | 0 | 6 |
| 11125 | 12 | 2 | 6 |
| 13127 | 12 | 0 | 12 |
| Lower expression in untreated HMEC (lib 12) vs. bFGF treated HMEC (lib 13) | | | |
| 12667 | 3 | 12 | 4 |
| 13244 | 0 | 6 | 6 |

TABLE 103

Differentially expressed polynucleotides:

| SEQ ID NO: | lib 12 clones | lib 14 clones | lib 12/lib 14 |
|---|---|---|---|
| Higher expression in untreated HMEC (lib 12) VEGF treated HMEC (lib14) | | | |
| 11069 | 9 | 0 | 9 |
| Lower expression in untreated HMEC (lib 12) vs. VEGF treated HMEC (lib14) | | | |
| 13243 | 22 | 50 | 2 |

Example 66

Polynucleotides Differentially Expressed in Normal Prostate Cells Relative to Prostate Cancer Cells A number of polynucleotide sequences have been identified that are differentially expressed between cells derived from normal prostate cells and prostate cancer cells. Expression of these sequences prostate tissue suspected of being cancerous can provide diagnostic, prognostic and/or treatment information. These polynucleotide sequences can also be used in combination with other known molecular and/or biochemical markers. The following table summarizes identified polynucleotides with differential expression between high metastatic potential colon cancer cells and low metastatic potential colon cancer cells:

TABLE 104

Differentially expressed polynucleotides: normal prostate cell line (lib 21) vs. prostate cancer cell line (lib 22)

| SEQ ID NO: | lib 21 clones | lib 22 clones | lib 21/lib 22 |
|---|---|---|---|
| Higher in lib 21 | | | |
| 9972 | 17 | 2 | 8 |
| 11673 | 22 | 8 | 3 |
| 11720 | 7 | 0 | 7 |
| 11764 | 22 | 6 | 4 |
| 10365 | 8 | 0 | 8 |
| 11329 | 6 | 0 | 6 |
| 11979 | 18 | 6 | 3 |
| 12062 | 12 | 3 | 4 |
| 12551 | 13 | 1 | 13 |
| 12818 | 16 | 2 | 8 |
| 13257 | 12 | 2 | 6 |
| Higher in lib 22 | | | |
| 10005 | 2 | 13 | 7 |
| 10012 | 0 | 9 | 9 |
| 10606 | 0 | 9 | 9 |
| 11188 | 1 | 15 | 15 |
| 11500 | 25 | 74 | 3 |
| 11566 | 25 | 74 | 3 |
| 11568 | 12 | 27 | 2 |
| 11629 | 5 | 16 | 3 |
| 11636 | 5 | 16 | 3 |
| 11691 | 12 | 27 | 2 |
| 11879 | 0 | 6 | 6 |
| 12906 | 0 | 6 | 6 |
| 13047 | 13 | 42 | 3 |
| 13051 | 13 | 42 | 3 |
| 13069 | 263 | 962 | 4 |
| 13141 | 0 | 6 | 6 |
| 13187 | 0 | 6 | 6 |

Example 67

Polynucleotides Differentially Expressed Across Multiple Libraries

A number of polynucleotide sequences have been identified that are differentially expressed between cancerous cells and normal cells across two or more tissue types tested (i.e., breast, colon, lung, and prostate). Expression of these sequences in a tissue of any origin can provide diagnostic, prognostic and/or treatment information associated with the prevention of achieving the malignant state in these tissues, and can be important in risk assessment for a patient. These polynucleotides can also serve as non-tissue specific markers of, for example, risk of metastasis of a tumor. The following polynucleotides were differentially expressed but without tissue type-specificity in at least two of the breast, colon, lung, and prostate libraries tested: 9972, 10024, 10274, 10331, 10533, 10755, 11361, 11500, 11566, 11568, 11583, 11691, 11701, 11730, 11764, 11775, 11794, 11842, 11979, 11990, 12054, 12065, 12158, 12232, 12297, 12312, 12335, 12379, 12409, 12551, 12593, 12623, 12643, 12668, 12703, 12723, 12878, 12895, 12896, 12899, 12906, 12928, 12966, 13047, 13048, 13051, 13065, 13069, 13075, 13129, 13243, 13250 and 13254.

Those skilled in the art will recognize, or be able to ascertain, using not more than routine experimentation, many equivalents to the specific embodiments of the invention described herein. Such specific embodiments and equivalents are intended to be encompassed by the following claims.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

Deposit Information:

The following materials were deposited with the American Type Culture Collection (ATCC); CMCC=Chiron Master Culture Collection:

cDNA Libraries Deposited with ATCC

| Tube Number | Deposit Date | ATCC Accession No. | CMCC Accession No. |
|---|---|---|---|
| ES137 | May 30, 2000 | | |
| ES138 | May 30, 2000 | | |
| ES139 | May 30, 2000 | | |
| ES140 | May 30, 2000 | | |
| ES141 | May 30, 2000 | | |
| ES142 | May 30, 2000 | | |
| ES143 | May 30, 2000 | | |
| ES137 | May 30, 2000 | | |
| ES144 | May 30, 2000 | | |
| ES145 | May 30, 2000 | | |
| ES146 | May 30, 2000 | | |
| ES147 | May 30, 2000 | | |
| ES148 | May 30, 2000 | | |
| ES149 | May 30, 2000 | | |
| ES150 | May 30, 2000 | | |
| ES151 | May 30, 2000 | | |
| ES152 | May 30, 2000 | | |
| ES153 | May 30, 2000 | | |
| ES154 | May 30, 2000 | | |
| ES155 | May 30, 2000 | | |
| ES156 | May 30, 2000 | | |
| ES157 | May 30, 2000 | | |
| ES158 | May 30, 2000 | | |
| ES159 | May 30, 2000 | | |
| ES160 | May 30, 2000 | | |
| ES161 | May 30, 2000 | | |
| ES162 | May 30, 2000 | | |
| ES163 | May 30, 2000 | | |
| ES164 | May 30, 2000 | | |
| ES165 | May 30, 2000 | | |
| ES166 | May 30, 2000 | | |
| ES167 | May 30, 2000 | | |

Table 105 lists the clones for each deposit, designated as "tube" number. This deposit is provided merely as convenience to those of skill in the art, and is not an admission that a deposit is required under 35 U.S.C. §112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby.

Retrieval of Individual Clones from Deposit of Pooled Clones

Where the ATCC deposit is composed of a pool of cDNA clones, the deposit was prepared by first transfecting each of the clones into separate bacterial cells. The clones were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

TABLE 105

| Clone Name | Tube |
|---|---|
| M00001351A:B02 | ES 137 |
| M00001356A:H11 | ES 137 |
| M00001363D:D09 | ES 137 |
| M00001395D:H02 | ES 137 |
| M00001439C:H06 | ES 137 |
| M00001476B:G10 | ES 137 |
| M00001582A:E02 | ES 137 |
| M00003750D:E06 | ES 137 |
| M00003761C:F02 | ES 137 |
| M00003770A:E05 | ES 137 |
| M00003786A:A11 | ES 137 |
| M00003800A:F09 | ES 137 |
| M00003816D:E11 | ES 137 |
| M00003902A:C03 | ES 137 |
| M00003991C:F06 | ES 137 |
| M00003995B:E03 | ES 137 |
| M00004046C:A08 | ES 137 |
| M00004105D:D05 | ES 137 |
| M00004139B:B10 | ES 137 |
| M00004140D:C03 | ES 137 |
| M00004144A:H05 | ES 137 |
| M00004152A:C12 | ES 137 |
| M00004155D:A10 | ES 137 |
| M00004168A:G11 | ES 137 |
| M00004197B:H10 | ES 137 |
| M00004222C:E03 | ES 137 |
| M00004234A:E07 | ES 137 |
| M00004239B:F11 | ES 137 |
| M00004241B:H07 | ES 137 |
| M00004264B:A05 | ES 137 |
| M00004278A:F09 | ES 137 |
| M00004282D:C11 | ES 137 |
| M00004308C:C06 | ES 137 |
| M00004340C:C07 | ES 137 |
| M00004354D:E05 | ES 137 |
| M00004361A:H02 | ES 137 |
| M00004372B:F07 | ES 137 |
| M00004378A:B10 | ES 137 |
| M00004393B:E07 | ES 137 |
| M00023282A:C02 | ES 137 |
| M00023300D:C11 | ES 137 |
| M00023316C:G08 | ES 137 |
| M00023333D:C12 | ES 137 |
| M00023352B:F03 | ES 137 |
| M00023352D:H03 | ES 137 |
| M00023376B:G04 | ES 137 |
| M00023377B:F01 | ES 137 |
| M00023398B:D12 | ES 137 |
| M00023399C:E10 | ES 137 |
| M00026803A:F08 | ES 137 |
| M00026843B:D10 | ES 137 |
| M00026850D:F09 | ES 137 |
| M00026851B:F01 | ES 137 |
| M00026856D:F02 | ES 137 |

TABLE 105-continued

| Clone Name | Tube |
|---|---|
| M00026857D:G12 | ES 137 |
| M00026859D:D01 | ES 137 |
| M00026860B:C05 | ES 137 |
| M00026865B:A06 | ES 137 |
| M00026868C:E11 | ES 137 |
| M00026878A:F05 | ES 137 |
| M00026882D:G09 | ES 137 |
| M00026885A:H09 | ES 137 |
| M00026901A:G07 | ES 137 |
| M00026914A:H10 | ES 137 |
| M00026915B:C06 | ES 137 |
| M00026918B:D01 | ES 137 |
| M00026922C:B02 | ES 137 |
| M00026922C:G03 | ES 137 |
| M00026926A:E10 | ES 137 |
| M00026927D:F02 | ES 137 |
| M00026928D:A03 | ES 137 |
| M00026935C:B04 | ES 137 |
| M00026941D:A04 | ES 137 |
| M00026944B:E03 | ES 137 |
| M00026946A:F12 | ES 137 |
| M00026980A:D09 | ES 137 |
| M00027016A:B06 | ES 137 |
| M00027018A:C09 | ES 137 |
| M00027021A:G02 | ES 137 |
| M00027022D:G11 | ES 137 |
| M00027030C:H06 | ES 137 |
| M00027035D:C06 | ES 137 |
| M00027049B:F05 | ES 137 |
| M00027078A:B02 | ES 137 |
| M00027080A:B01 | ES 137 |
| M00027085C:E11 | ES 137 |
| M00027094A:B03 | ES 137 |
| M00027103B:A09 | ES 137 |
| M00027108C:B03 | ES 137 |
| M00027121D:C05 | ES 137 |
| M00027135A:B11 | ES 137 |
| M00027136C:C09 | ES 137 |
| M00027141C:H03 | ES 137 |
| M00027159D:F03 | ES 137 |
| M00027162B:F05 | ES 137 |
| M00027178B:G09 | ES 137 |
| M00027179D:E06 | ES 138 |
| M00027181D:A05 | ES 138 |
| M00027195C:E04 | ES 138 |
| M00027198B:B08 | ES 138 |
| M00027200A:F02 | ES 138 |
| M00027207B:F07 | ES 138 |
| M00027212D:E03 | ES 138 |
| M00027228D:A01 | ES 138 |
| M00027232D:B08 | ES 138 |
| M00027233B:C01 | ES 138 |
| M00027236A:E04 | ES 138 |
| M00027237C:B08 | ES 138 |
| M00027248A:C02 | ES 138 |
| M00027256B:H09 | ES 138 |
| M00027258A:A07 | ES 138 |
| M00027263A:F10 | ES 138 |
| M00027292D:F10 | ES 138 |
| M00027297A:C04 | ES 138 |
| M00027299B:B12 | ES 138 |
| M00027301A:G05 | ES 138 |
| M00027301B:B08 | ES 138 |
| M00027314C:D09 | ES 138 |
| M00027319D:B11 | ES 138 |
| M00027324D:C05 | ES 138 |
| M00027347C:G07 | ES 138 |
| M00027355A:B07 | ES 138 |
| M00027359B:G05 | ES 138 |
| M00027366A:F11 | ES 138 |
| M00027379C:B07 | ES 138 |
| M00027392B:H02 | ES 138 |
| M00027396D:G08 | ES 138 |
| M00027398C:F07 | ES 138 |
| M00027438C:G07 | ES 138 |
| M00027462A:D07 | ES 138 |
| M00027462B:H07 | ES 138 |
| M00027468A:C09 | ES 138 |
| M00027475B:E10 | ES 138 |
| M00027476A:C09 | ES 138 |
| M00027486A:F06 | ES 138 |
| M00027520A:C05 | ES 138 |
| M00027525B:D06 | ES 138 |
| M00027526D:F03 | ES 138 |
| M00027528C:B10 | ES 138 |
| M00027537C:B01 | ES 138 |
| M00027546C:B10 | ES 138 |
| M00027591B:C04 | ES 138 |
| M00027596A:A10 | ES 138 |
| M00027596C:E06 | ES 138 |
| M00027602B:C01 | ES 138 |
| M00027615A:F10 | ES 138 |
| M00027617B:C12 | ES 138 |
| M00027620D:F11 | ES 138 |
| M00027625A:H01 | ES 138 |
| M00027634A:D11 | ES 138 |
| M00027641C:A03 | ES 138 |
| M00027647C:D03 | ES 138 |
| M00027652B:F11 | ES 138 |
| M00027668C:H12 | ES 138 |
| M00027729D:H06 | ES 138 |
| M00027733A:A02 | ES 138 |
| M00027741B:F09 | ES 138 |
| M00027743A:C03 | ES 138 |
| M00027801C:C11 | ES 138 |
| M00027813C:F01 | ES 138 |
| M00027818C:C07 | ES 138 |
| M00027836D:F12 | ES 138 |
| M00027837C:D09 | ES 138 |
| M00028120D:F12 | ES 138 |
| M00028066C:D07 | ES 138 |
| M00028184D:G10 | ES 138 |
| M00028185B:A06 | ES 138 |
| M00028196D:A03 | ES 138 |
| M00028201B:H12 | ES 138 |
| M00028207D:E09 | ES 138 |
| M00028210B:D02 | ES 138 |
| M00028212C:B08 | ES 138 |
| M00028215D:F03 | ES 138 |
| M00028220A:B04 | ES 138 |
| M00028314D:F05 | ES 138 |
| M00028316B:H12 | ES 138 |
| M00028354A:B12 | ES 138 |
| M00028354D:A03 | ES 138 |
| M00028357A:G10 | ES 138 |
| M00028362A:G11 | ES 138 |
| M00028364C:G08 | ES 138 |
| M00028369D:E08 | ES 138 |
| M00028617C:A12 | ES 138 |
| M00028768C:D05 | ES 138 |
| M00028770A:D04 | ES 138 |
| M00028772C:B09 | ES 138 |
| M00028775D:F03 | ES 138 |
| M00028777B:G12 | ES 138 |
| M00031368A:E10 | ES 138 |
| M00031417C:G09 | ES 138 |
| M00031419D:C04 | ES 138 |
| M00031485D:G02 | ES 138 |
| M00032480B:E10 | ES 139 |
| M00032492A:C01 | ES 139 |
| M00032495B:D02 | ES 139 |
| M00032499C:A01 | ES 139 |
| M00032508B:H03 | ES 139 |
| M00032510D:F12 | ES 139 |
| M00032510D:G06 | ES 139 |
| M00032513D:F01 | ES 139 |
| M00032530D:C02 | ES 139 |
| M00032535D:H01 | ES 139 |
| M00032539B:C11 | ES 139 |
| M00032540A:A09 | ES 139 |
| M00032541D:H08 | ES 139 |
| M00032545B:H09 | ES 139 |
| M00032545D:G05 | ES 139 |
| M00032550D:C02 | ES 139 |
| M00032551B:G05 | ES 139 |
| M00032577A:C04 | ES 139 |

TABLE 105-continued

| Clone Name | Tube |
|---|---|
| M00032578A:G06 | ES 139 |
| M00032584A:H08 | ES 139 |
| M00032592A:H11 | ES 139 |
| M00032597C:B01 | ES 139 |
| M00032638C:G08 | ES 139 |
| M00032638D:A06 | ES 139 |
| M00032668D:G12 | ES 139 |
| M00032678C:D06 | ES 139 |
| M00032688D:D11 | ES 139 |
| M00032712B:G02 | ES 139 |
| M00032724A:C05 | ES 139 |
| M00032725C:F06 | ES 139 |
| M00032726C:C01 | ES 139 |
| M00032731B:C10 | ES 139 |
| M00032731C:C07 | ES 139 |
| M00032737B:E09 | ES 139 |
| M00032739A:A06 | ES 139 |
| M00032744B:F10 | ES 139 |
| M00032766B:D12 | ES 139 |
| M00032766C:A04 | ES 139 |
| M00032790B:A07 | ES 139 |
| M00032793A:F06 | ES 139 |
| M00032797B:G02 | ES 139 |
| M00032808B:G10 | ES 139 |
| M00032811B:D02 | ES 139 |
| M00032829B:E06 | ES 139 |
| M00032830D:G03 | ES 139 |
| M00032831C:G07 | ES 139 |
| M00032853D:G12 | ES 139 |
| M00032864B:B09 | ES 139 |
| M00032871D:E11 | ES 139 |
| M00032876C:D06 | ES 139 |
| M00032907A:G04 | ES 139 |
| M00032909A:B06 | ES 139 |
| M00032917D:G09 | ES 139 |
| M00032918B:D08 | ES 139 |
| M00032918B:E06 | ES 139 |
| M00032918C:B10 | ES 139 |
| M00032921B:H08 | ES 139 |
| M00032933A:C10 | ES 139 |
| M00032939B:E07 | ES 139 |
| M00032940A:C02 | ES 139 |
| M00032942D:C12 | ES 139 |
| M00032944B:B02 | ES 139 |
| M00032984C:G05 | ES 139 |
| M00032990B:A11 | ES 139 |
| M00032994A:A08 | ES 139 |
| M00032995C:C05 | ES 139 |
| M00033007C:E01 | ES 139 |
| M00033019B:E10 | ES 139 |
| M00033033C:H01 | ES 139 |
| M00033034C:A06 | ES 139 |
| M00033034C:F02 | ES 139 |
| M00033037D:C11 | ES 139 |
| M00033074A:C08 | ES 139 |
| M00033130B:F06 | ES 139 |
| M00033140D:F06 | ES 139 |
| M00033173D:C01 | ES 139 |
| M00033176B:E12 | ES 139 |
| M00033186C:D11 | ES 139 |
| M00033189D:F08 | ES 139 |
| M00033202D:G06 | ES 139 |
| M00033204B:A07 | ES 139 |
| M00033205A:F03 | ES 139 |
| M00033217B:H07 | ES 139 |
| M00033218A:C04 | ES 139 |
| M00033223B:H07 | ES 139 |
| M00033226A:A11 | ES 139 |
| M00033231D:B09 | ES 139 |
| M00033231D:G10 | ES 139 |
| M00033243B:A05 | ES 139 |
| M00033246C:E08 | ES 139 |
| M00033248A:B02 | ES 139 |
| M00033261C:D12 | ES 139 |
| M00033262D:A11 | ES 139 |
| M00033263B:G04 | ES 139 |
| M00033276B:G08 | ES 139 |
| M00033185C:D01 | ES 139 |
| M00033288B:D12 | ES 140 |
| M00033300D:H12 | ES 140 |
| M00033306D:G08 | ES 140 |
| M00033306D:H09 | ES 140 |
| M00033308B:G05 | ES 140 |
| M00033343C:H08 | ES 140 |
| M00033345D:A09 | ES 140 |
| M00033346C:A05 | ES 140 |
| M00033347C:F02 | ES 140 |
| M00033349D:F05 | ES 140 |
| M00033358A:H12 | ES 140 |
| M00033362C:C05 | ES 140 |
| M00033375A:G04 | ES 140 |
| M00033376A:C12 | ES 140 |
| M00033377D:A05 | ES 140 |
| M00033410B:C09 | ES 140 |
| M00033424B:A04 | ES 140 |
| M00033424D:H12 | ES 140 |
| M00033425A:C10 | ES 140 |
| M00033427D:F01 | ES 140 |
| M00033432B:H10 | ES 140 |
| M00033437C:A07 | ES 140 |
| M00033437C:C03 | ES 140 |
| M00033442A:D06 | ES 140 |
| M00033446C:G08 | ES 140 |
| M00033446D:B02 | ES 140 |
| M00033450C:A02 | ES 140 |
| M00033451A:H01 | ES 140 |
| M00033454A:D09 | ES 140 |
| M00033457D:A05 | ES 140 |
| M00033560D:G07 | ES 140 |
| M00033561C:A02 | ES 140 |
| M00033566C:E08 | ES 140 |
| M00033570B:C08 | ES 140 |
| M00033570B:E06 | ES 140 |
| M00033570C:C10 | ES 140 |
| M00033578D:G02 | ES 140 |
| M00033581C:H10 | ES 140 |
| M00033581D:D08 | ES 140 |
| M00033583B:E06 | ES 140 |
| M00033583D:B05 | ES 140 |
| M00033584D:G11 | ES 140 |
| M00033585D:A02 | ES 140 |
| M00033588C:G04 | ES 140 |
| M00033594C:B03 | ES 140 |
| M00033595A:C11 | ES 140 |
| M00038259A:G08 | ES 140 |
| M00038259B:A02 | ES 140 |
| M00038259B:G08 | ES 140 |
| M00038259C:H09 | ES 140 |
| M00038272A:G01 | ES 140 |
| M00038272D:F11 | ES 140 |
| M00038279C:A11 | ES 140 |
| M00038284B:H04 | ES 140 |
| M00038303A:C03 | ES 140 |
| M00038303C:D02 | ES 140 |
| M00038303D:E07 | ES 140 |
| M00038315C:G11 | ES 140 |
| M00038325D:F12 | ES 140 |
| M00038326B:D04 | ES 140 |
| M00038327A:C11 | ES 140 |
| M00038327D:A05 | ES 140 |
| M00038328D:A03 | ES 140 |
| M00038329A:E08 | ES 140 |
| M00038387B:A07 | ES 140 |
| M00038614C:H11 | ES 140 |
| M00038615A:H12 | ES 140 |
| M00038616D:B12 | ES 140 |
| M00038618C:C08 | ES 140 |
| M00038619B:A03 | ES 140 |
| M00038620B:E09 | ES 140 |
| M00038631C:B10 | ES 140 |
| M00038631D:B02 | ES 140 |
| M00038632C:B09 | ES 140 |
| M00038633A:D07 | ES 140 |
| M00038633B:G02 | ES 140 |
| M00038635A:G09 | ES 140 |
| M00038635B:C08 | ES 140 |

TABLE 105-continued

| Clone Name | Tube |
|---|---|
| M00038638D:H03 | ES 140 |
| M00038639B:C03 | ES 140 |
| M00038639D:F07 | ES 140 |
| M00038661A:A07 | ES 140 |
| M00038662B:A12 | ES 140 |
| M00038663B:H06 | ES 140 |
| M00038663D:H10 | ES 140 |
| M00038664C:E04 | ES 140 |
| M00038991A:D01 | ES 140 |
| M00038994A:A10 | ES 140 |
| M00038995C:G08 | ES 140 |
| M00038995D:E05 | ES 140 |
| M00038999B:G11 | ES 140 |
| M00038999D:C11 | ES 140 |
| M00039002D:G11 | ES 140 |
| M00039004B:A06 | ES 140 |
| M00039004B:C11 | ES 140 |
| M00039005C:H01 | ES 141 |
| M00039006D:B01 | ES 141 |
| M00039011D:C10 | ES 141 |
| M00039013A:C09 | ES 141 |
| M00039013D:F02 | ES 141 |
| M00039014A:H10 | ES 141 |
| M00039014B:C04 | ES 141 |
| M00039015A:D07 | ES 141 |
| M00039015B:G10 | ES 141 |
| M00039015B:H09 | ES 141 |
| M00039015D:H04 | ES 141 |
| M00039016A:A02 | ES 141 |
| M00039016D:G06 | ES 141 |
| M00039024B:B10 | ES 141 |
| M00039025A:H09 | ES 141 |
| M00039026D:F05 | ES 141 |
| M00039028C:B11 | ES 141 |
| M00039030B:E02 | ES 141 |
| M00039036C:B05 | ES 141 |
| M00039039B:E03 | ES 141 |
| M00039039B:F09 | ES 141 |
| M00039042B:B02 | ES 141 |
| M00039043B:E01 | ES 141 |
| M00039049D:G07 | ES 141 |
| M00039050A:H10 | ES 141 |
| M00039052C:F07 | ES 141 |
| M00039058A:A04 | ES 141 |
| M00039058C:H02 | ES 141 |
| M00039059C:G08 | ES 141 |
| M00039061B:F08 | ES 141 |
| M00039063B:D08 | ES 141 |
| M00039064D:H09 | ES 141 |
| M00039066D:G08 | ES 141 |
| M00039068B:B04 | ES 141 |
| M00039068C:E06 | ES 141 |
| M00039070D:C02 | ES 141 |
| M00039072C:C03 | ES 141 |
| M00039072C:E02 | ES 141 |
| M00039079A:A05 | ES 141 |
| M00039080C:H06 | ES 141 |
| M00039081B:G06 | ES 141 |
| M00039082B:A05 | ES 141 |
| M00039084C:G07 | ES 141 |
| M00039084C:H03 | ES 141 |
| M00039084C:H04 | ES 141 |
| M00039084D:D07 | ES 141 |
| M00039096A:A05 | ES 141 |
| M00039096A:E07 | ES 141 |
| M00039097D:D06 | ES 141 |
| M00039099A:H08 | ES 141 |
| M00039104D:C09 | ES 141 |
| M00039105C:B08 | ES 141 |
| M00039107C:E04 | ES 141 |
| M00039108D:B06 | ES 141 |
| M00039112B:C05 | ES 141 |
| M00039118B:C05 | ES 141 |
| M00039118D:A06 | ES 141 |
| M00039120C:C09 | ES 141 |
| M00039120C:H03 | ES 141 |
| M00039123A:B10 | ES 141 |
| M00039124C:F03 | ES 141 |
| M00039124C:H02 | ES 141 |
| M00039124C:H08 | ES 141 |
| M00039126D:A08 | ES 141 |
| M00039127A:G11 | ES 141 |
| M00039127D:E10 | ES 141 |
| M00039129C:D04 | ES 141 |
| M00039133B:F08 | ES 141 |
| M00039135D:F05 | ES 141 |
| M00039135D:G02 | ES 141 |
| M00039135D:H02 | ES 141 |
| M00039139A:C09 | ES 141 |
| M00039139C:G12 | ES 141 |
| M00039140A:B08 | ES 141 |
| M00039140D:A04 | ES 141 |
| M00039140D:D09 | ES 141 |
| M00039141C:E01 | ES 141 |
| M00039142D:B11 | ES 141 |
| M00039144C:E06 | ES 141 |
| M00039147A:F10 | ES 141 |
| M00039156A:B11 | ES 141 |
| M00039158B:G12 | ES 141 |
| M00039166B:G06 | ES 141 |
| M00039167B:H09 | ES 141 |
| M00039168C:A04 | ES 141 |
| M00039169A:E12 | ES 141 |
| M00039170A:B10 | ES 141 |
| M00039170C:F05 | ES 141 |
| M00039171B:D11 | ES 141 |
| M00039177B:D03 | ES 141 |
| M00039179A:G09 | ES 141 |
| M00039180A:A07 | ES 141 |
| M00039196B:H06 | ES 141 |
| M00039196D:A07 | ES 141 |
| M00039200A:C10 | ES 141 |
| M00039211A:C12 | ES 141 |
| M00039212C:C12 | ES 142 |
| M00039213A:D01 | ES 142 |
| M00039213B:F05 | ES 142 |
| M00039218A:F03 | ES 142 |
| M00039221A:H03 | ES 142 |
| M00039224A:E12 | ES 142 |
| M00039228A:B05 | ES 142 |
| M00039230A:A10 | ES 142 |
| M00039230D:D09 | ES 142 |
| M00039230D:G12 | ES 142 |
| M00039233A:A03 | ES 142 |
| M00039238A:B12 | ES 142 |
| M00039238D:A08 | ES 142 |
| M00039241A:E11 | ES 142 |
| M00039249A:C12 | ES 142 |
| M00039249C:G11 | ES 142 |
| M00039255C:E12 | ES 142 |
| M00039257D:C03 | ES 142 |
| M00039258B:E06 | ES 142 |
| M00039258D:B08 | ES 142 |
| M00039260C:G03 | ES 142 |
| M00039263D:A12 | ES 142 |
| M00039266A:B02 | ES 142 |
| M00039266D:F12 | ES 142 |
| M00039266D:H04 | ES 142 |
| M00039273B:F02 | ES 142 |
| M00039273D:B02 | ES 142 |
| M00039274B:G07 | ES 142 |
| M00039276B:H09 | ES 142 |
| M00039277D:G10 | ES 142 |
| M00039279B:C11 | ES 142 |
| M00039279B:H02 | ES 142 |
| M00039279C:B08 | ES 142 |
| M00039281D:B04 | ES 142 |
| M00039284D:B12 | ES 142 |
| M00039286A:C06 | ES 142 |
| M00039287C:A06 | ES 142 |
| M00039288C:B11 | ES 142 |
| M00039293A:H04 | ES 142 |
| M00039293B:C11 | ES 142 |
| M00039295B:D03 | ES 142 |
| M00039297C:H08 | ES 142 |
| M00039298B:B06 | ES 142 |

TABLE 105-continued

| Clone Name | Tube |
|---|---|
| M00039298B:D03 | ES 142 |
| M00039298D:B04 | ES 142 |
| M00039299B:G12 | ES 142 |
| M00039300C:C09 | ES 142 |
| M00039300C:G04 | ES 142 |
| M00039301B:F06 | ES 142 |
| M00039303C:F11 | ES 142 |
| M00039304D:B09 | ES 142 |
| M00039308B:G08 | ES 142 |
| M00039310A:C07 | ES 142 |
| M00039313D:G04 | ES 142 |
| M00039316A:C01 | ES 142 |
| M00039318B:B09 | ES 142 |
| M00039319B:H12 | ES 142 |
| M00039319C:A04 | ES 142 |
| M00039322A:F04 | ES 142 |
| M00039328D:D07 | ES 142 |
| M00039329A:C01 | ES 142 |
| M00039329C:B10 | ES 142 |
| M00039333D:D09 | ES 142 |
| M00039334B:E03 | ES 142 |
| M00039335A:E08 | ES 142 |
| M00039339A:H07 | ES 142 |
| M00039339C:F03 | ES 142 |
| M00039340A:D05 | ES 142 |
| M00039340B:E07 | ES 142 |
| M00039340B:G08 | ES 142 |
| M00039341C:H11 | ES 142 |
| M00039341D:D07 | ES 142 |
| M00039343B:F12 | ES 142 |
| M00039344B:G07 | ES 142 |
| M00039345A:D09 | ES 142 |
| M00039345C:C12 | ES 142 |
| M00039381C:H08 | ES 142 |
| M00039381D:C02 | ES 142 |
| M00039384C:E02 | ES 142 |
| M00039384C:F08 | ES 142 |
| M00039385B:E09 | ES 142 |
| M00039391D:F08 | ES 142 |
| M00039396D:B04 | ES 142 |
| M00039397B:H09 | ES 142 |
| M00039398A:B10 | ES 142 |
| M00039401B:D02 | ES 142 |
| M00039402B:E03 | ES 142 |
| M00039403A:G12 | ES 142 |
| M00039404B:A05 | ES 142 |
| M00039407B:G02 | ES 142 |
| M00039411C:E07 | ES 142 |
| M00039412D:G06 | ES 142 |
| M00039414D:G03 | ES 142 |
| M00039415D:E01 | ES 142 |
| M00039417A:D03 | ES 142 |
| M00039417A:E12 | ES 142 |
| M00039417B:F01 | ES 143 |
| M00039417C:A01 | ES 143 |
| M00039417C:G01 | ES 143 |
| M00039418B:D08 | ES 143 |
| M00039420D:D03 | ES 143 |
| M00039422D:F04 | ES 143 |
| M00039425C:G01 | ES 143 |
| M00039425D:E12 | ES 143 |
| M00039428C:E01 | ES 143 |
| M00039430B:F12 | ES 143 |
| M00039431B:F04 | ES 143 |
| M00039432C:A01 | ES 143 |
| M00039444C:H02 | ES 143 |
| M00039452C:G09 | ES 143 |
| M00039454B:A11 | ES 143 |
| M00039455D:H04 | ES 143 |
| M00039456A:C08 | ES 143 |
| M00039458B:H11 | ES 143 |
| M00039461A:F04 | ES 143 |
| M00039465A:A08 | ES 143 |
| M00039472C:B08 | ES 143 |
| M00039475D:E10 | ES 143 |
| M00039476B:A02 | ES 143 |
| M00039477A:B03 | ES 143 |
| M00039477D:A10 | ES 143 |
| M00039611D:D11 | ES 143 |
| M00039612B:B10 | ES 143 |
| M00039612B:G05 | ES 143 |
| M00039616A:B10 | ES 143 |
| M00039616B:C01 | ES 143 |
| M00039619B:D02 | ES 143 |
| M00039631A:C10 | ES 143 |
| M00039633D:D05 | ES 143 |
| M00039636C:D11 | ES 143 |
| M00039637C:A10 | ES 143 |
| M00039652B:D05 | ES 143 |
| M00039655B:H09 | ES 143 |
| M00039655C:C07 | ES 143 |
| M00039655C:E08 | ES 143 |
| M00039660C:C10 | ES 143 |
| M00039663C:G09 | ES 143 |
| M00039664D:G07 | ES 143 |
| M00039672D:D10 | ES 143 |
| M00039673A:F09 | ES 143 |
| M00039675D:B03 | ES 143 |
| M00039675D:H05 | ES 143 |
| M00039677A:B08 | ES 143 |
| M00039681B:H09 | ES 143 |
| M00039682A:C08 | ES 143 |
| M00039682C:H11 | ES 143 |
| M00039684D:B08 | ES 143 |
| M00039685A:A08 | ES 143 |
| M00039686C:C05 | ES 143 |
| M00039686C:E06 | ES 143 |
| M00039688C:G06 | ES 143 |
| M00039689C:E08 | ES 143 |
| M00039696A:E05 | ES 143 |
| M00039697B:F11 | ES 143 |
| M00039700B:D02 | ES 143 |
| M00039702A:B12 | ES 143 |
| M00039702A:B02 | ES 143 |
| M00039705D:F02 | ES 143 |
| M00039707A:D02 | ES 143 |
| M00039710C:G03 | ES 143 |
| M00039720D:D02 | ES 143 |
| M00039727C:B09 | ES 143 |
| M00039729A:A10 | ES 143 |
| M00039771C:E11 | ES 143 |
| M00039773D:A09 | ES 143 |
| M00039773D:F11 | ES 143 |
| M00039774C:A03 | ES 143 |
| M00039774C:C09 | ES 143 |
| M00039775A:A09 | ES 143 |
| M00039777C:E05 | ES 143 |
| M00039778B:G03 | ES 143 |
| M00039778C:A04 | ES 143 |
| M00039781D:D10 | ES 143 |
| M00039782A:H10 | ES 143 |
| M00039785D:G05 | ES 143 |
| M00039788A:E03 | ES 143 |
| M00039788B:A06 | ES 143 |
| M00039788C:A01 | ES 143 |
| M00039790B:D03 | ES 143 |
| M00039792A:B04 | ES 143 |
| M00039793D:C05 | ES 143 |
| M00039794A:E04 | ES 143 |
| M00039795B:H10 | ES 143 |
| M00039795D:E10 | ES 143 |
| M00039795D:G06 | ES 143 |
| M00039797C:G05 | ES 143 |
| M00039798B:B02 | ES 143 |
| M00039799A:D10 | ES 143 |
| M00039801A:H11 | ES 143 |
| M00039807A:D01 | ES 143 |
| M00039808D:H02 | ES 143 |
| M00039810A:H10 | ES 143 |
| M00039813B:B01 | ES 144 |
| M00039813B:D11 | ES 144 |
| M00039815C:F09 | ES 144 |
| M00039816B:D04 | ES 144 |
| M00039816C:D05 | ES 144 |
| M00039820A:F11 | ES 144 |
| M00039820A:H11 | ES 144 |

TABLE 105-continued

| Clone Name | Tube |
|---|---|
| M00039820B:B06 | ES 144 |
| M00039827B:F07 | ES 144 |
| M00039828B:C05 | ES 144 |
| M00039832A:B12 | ES 144 |
| M00039835A:F07 | ES 144 |
| M00039838A:F05 | ES 144 |
| M00039839B:B01 | ES 144 |
| M00039839C:E05 | ES 144 |
| M00039847A:F06 | ES 144 |
| M00039851B:G11 | ES 144 |
| M00039851C:D12 | ES 144 |
| M00039854B:F09 | ES 144 |
| M00039855C:F01 | ES 144 |
| M00039857B:G10 | ES 144 |
| M00039859A:F06 | ES 144 |
| M00039859C:G10 | ES 144 |
| M00039864A:A07 | ES 144 |
| M00039866B:A08 | ES 144 |
| M00039869B:F06 | ES 144 |
| M00039875D:A10 | ES 144 |
| M00039876D:H09 | ES 144 |
| M00039877C:C03 | ES 144 |
| M00039879C:F05 | ES 144 |
| M00039879D:B11 | ES 144 |
| M00039880A:H11 | ES 144 |
| M00039884A:H11 | ES 144 |
| M00039885C:D01 | ES 144 |
| M00039887C:E07 | ES 144 |
| M00039887D:C04 | ES 144 |
| M00039888B:D03 | ES 144 |
| M00039890A:H05 | ES 144 |
| M00039894C:H07 | ES 144 |
| M00039896C:H01 | ES 144 |
| M00039897D:C10 | ES 144 |
| M00039898A:A08 | ES 144 |
| M00039898D:C06 | ES 144 |
| M00039903A:H07 | ES 144 |
| M00039903C:D01 | ES 144 |
| M00039903C:F03 | ES 144 |
| M00039909C:G05 | ES 144 |
| M00039909D:C02 | ES 144 |
| M00039910C:G10 | ES 144 |
| M00039914D:G12 | ES 144 |
| M00039915D:C11 | ES 144 |
| M00039927A:F04 | ES 144 |
| M00039928B:G05 | ES 144 |
| M00039936C:C05 | ES 144 |
| M00039938C:A08 | ES 144 |
| M00039938C:E11 | ES 144 |
| M00039940A:D07 | ES 144 |
| M00039940D:G08 | ES 144 |
| M00039973D:C08 | ES 144 |
| M00039973D:D12 | ES 144 |
| M00039975C:C11 | ES 144 |
| M00039976D:A12 | ES 144 |
| M00039978A:G03 | ES 144 |
| M00039981A:E08 | ES 144 |
| M00039982C:H04 | ES 144 |
| M00039983D:A06 | ES 144 |
| M00039984A:C02 | ES 144 |
| M00039984B:G12 | ES 144 |
| M00039984D:G12 | ES 144 |
| M00039987A:F09 | ES 144 |
| M00039987C:E12 | ES 144 |
| M00039987C:G08 | ES 144 |
| M00039988A:E06 | ES 144 |
| M00039990C:D10 | ES 144 |
| M00040004D:B03 | ES 144 |
| M00040005B:C11 | ES 144 |
| M00040005D:B07 | ES 144 |
| M00040007D:A06 | ES 144 |
| M00040009D:B07 | ES 144 |
| M00040010A:F10 | ES 144 |
| M00040014B:D01 | ES 144 |
| M00040014D:D10 | ES 144 |
| M00040014D:F03 | ES 144 |
| M00040015C:F08 | ES 144 |
| M00040016C:H12 | ES 144 |
| M00040017A:C06 | ES 144 |
| M00040017D:G03 | ES 144 |
| M00040019A:E01 | ES 144 |
| M00040021A:F09 | ES 144 |
| M00040022C:D06 | ES 144 |
| M00040026B:F06 | ES 144 |
| M00040029A:B03 | ES 144 |
| M00040029A:G04 | ES 144 |
| M00040031A:E06 | ES 144 |
| M00040032A:B03 | ES 144 |
| M00040032A:D09 | ES 144 |
| M00040037A:E11 | ES 145 |
| M00040038D:G04 | ES 145 |
| M00040039D:D06 | ES 145 |
| M00040040A:A06 | ES 145 |
| M00040041C:C09 | ES 145 |
| M00040042B:A10 | ES 145 |
| M00040047C:F05 | ES 145 |
| M00040052D:F12 | ES 145 |
| M00040055D:A06 | ES 145 |
| M00040055D:B01 | ES 145 |
| M00040060C:H10 | ES 145 |
| M00040062B:B05 | ES 145 |
| M00040070B:B07 | ES 145 |
| M00040071B:A10 | ES 145 |
| M00040072C:G09 | ES 145 |
| M00040076C:D06 | ES 145 |
| M00040077D:C11 | ES 145 |
| M00040080C:C06 | ES 145 |
| M00040081C:E01 | ES 145 |
| M00040085D:A10 | ES 145 |
| M00040085D:E04 | ES 145 |
| M00040087D:F08 | ES 145 |
| M00040088C:E10 | ES 145 |
| M00040089A:G08 | ES 145 |
| M00040089B:E04 | ES 145 |
| M00040089C:E06 | ES 145 |
| M00040090B:G09 | ES 145 |
| M00040092B:F05 | ES 145 |
| M00040093B:C02 | ES 145 |
| M00040093D:D03 | ES 145 |
| M00040097A:C12 | ES 145 |
| M00040098C:B01 | ES 145 |
| M00040098D:E04 | ES 145 |
| M00040098D:G12 | ES 145 |
| M00040100C:E05 | ES 145 |
| M00040100D:B06 | ES 145 |
| M00040103B:H10 | ES 145 |
| M00040105C:F11 | ES 145 |
| M00040106B:B09 | ES 145 |
| M00040107B:H07 | ES 145 |
| M00040111C:D05 | ES 145 |
| M00040115B:A04 | ES 145 |
| M00040115B:H12 | ES 145 |
| M00040118D:G10 | ES 145 |
| M00040121B:C05 | ES 145 |
| M00040122D:A02 | ES 145 |
| M00040123A:A09 | ES 145 |
| M00040124D:H01 | ES 145 |
| M00040129D:E10 | ES 145 |
| M00040302C:A04 | ES 145 |
| M00040304B:F06 | ES 145 |
| M00040305A:D11 | ES 145 |
| M00040305C:H06 | ES 145 |
| M00040307B:F01 | ES 145 |
| M00040307C:F10 | ES 145 |
| M00040309A:E11 | ES 145 |
| M00004825D:D05 | ES 145 |
| M00004832D:H02 | ES 145 |
| M00004839C:H02 | ES 145 |
| M00005018A:B05 | ES 145 |
| M00005297D:H08 | ES 145 |
| M00005308A:D06 | ES 145 |
| M00005351C:G05 | ES 145 |
| M00005352C:A02 | ES 145 |
| M00005358B:B06 | ES 145 |
| M00005359A:D04 | ES 145 |
| M00005379A:E04 | ES 145 |

TABLE 105-continued

| Clone Name | Tube |
|---|---|
| M00005382B:F08 | ES 145 |
| M00005384A:C11 | ES 145 |
| M00005402B:F08 | ES 145 |
| M00005445D:B01 | ES 145 |
| M00005449B:B10 | ES 145 |
| M00005449B:D01 | ES 145 |
| M00005457C:A03 | ES 145 |
| M00005458A:F11 | ES 145 |
| M00005498A:H06 | ES 145 |
| M00005531D:F06 | ES 145 |
| M00005539D:G01 | ES 145 |
| M00005555A:A10 | ES 145 |
| M00005556B:D02 | ES 145 |
| M00005601D:D08 | ES 145 |
| M00005614B:B01 | ES 145 |
| M00005623A:G02 | ES 145 |
| M00005623D:G12 | ES 145 |
| M00005625A:C02 | ES 145 |
| M00005673B:B12 | ES 145 |
| M00005778B:F09 | ES 145 |
| M00005805D:D12 | ES 145 |
| M00005820C:E04 | ES 145 |
| M00006581D:F08 | ES 145 |
| M00006599D:B02 | ES 145 |
| M00006657C:G05 | ES 145 |
| M00006680B:D02 | ES 145 |
| M00006712C:H09 | ES 145 |
| M00006809B:B09 | ES 145 |
| M00006861B:F09 | ES 145 |
| M00006866A:D07 | ES 146 |
| M00006886D:H02 | ES 146 |
| M00006893C:E07 | ES 146 |
| M00006897A:H02 | ES 146 |
| M00006928D:D07 | ES 146 |
| M00006935C:F06 | ES 146 |
| M00006968A:G08 | ES 146 |
| M00006977C:G04 | ES 146 |
| M00006977D:A03 | ES 146 |
| M00007012D:H08 | ES 146 |
| M00007013A:D09 | ES 146 |
| M00007026B:H09 | ES 146 |
| M00007108B:A02 | ES 146 |
| M00007112C:B10 | ES 146 |
| M00007116C:G02 | ES 146 |
| M00007124D:H10 | ES 146 |
| M00007136A:A03 | ES 146 |
| M00007149A:G02 | ES 146 |
| M00007157C:F11 | ES 146 |
| M00007165B:G11 | ES 146 |
| M00007194A:B09 | ES 146 |
| M00007929C:B08 | ES 146 |
| M00007941D:C09 | ES 146 |
| M00007943D:C09 | ES 146 |
| M00007972B:H12 | ES 146 |
| M00007976A:C10 | ES 146 |
| M00007992C:F06 | ES 146 |
| M00007994A:G02 | ES 146 |
| M00008006B:B03 | ES 146 |
| M00008026B:C11 | ES 146 |
| M00008045A:H02 | ES 146 |
| M00008053A:F10 | ES 146 |
| M00008063B:A06 | ES 146 |
| M00021665B:F12 | ES 146 |
| M00021671D:F12 | ES 146 |
| M00021852D:A05 | ES 146 |
| M00021866D:A03 | ES 146 |
| M00021908D:G12 | ES 146 |
| M00021919C:A10 | ES 146 |
| M00021923C:D11 | ES 146 |
| M00021955A:H02 | ES 146 |
| M00021964C:E10 | ES 146 |
| M00021972D:C11 | ES 146 |
| M00022005C:C06 | ES 146 |
| M00022015B:B07 | ES 146 |
| M00022054A:H03 | ES 146 |
| M00022084D:B01 | ES 146 |
| M00022099B:D06 | ES 146 |
| M00022105C:C12 | ES 146 |
| M00022127C:H03 | ES 146 |
| M00022135C:B05 | ES 146 |
| M00022138A:E05 | ES 146 |
| M00022175D:D12 | ES 146 |
| M00022178B:D06 | ES 146 |
| M00022181C:D01 | ES 146 |
| M00022183B:C02 | ES 146 |
| M00022184C:C11 | ES 146 |
| M00022233C:A12 | ES 146 |
| M00022234C:D06 | ES 146 |
| M00022247A:E02 | ES 146 |
| M00022257A:B09 | ES 146 |
| M00022262D:G03 | ES 146 |
| M00022264B:G10 | ES 146 |
| M00022363C:G12 | ES 146 |
| M00022365D:A03 | ES 146 |
| M00022373A:B05 | ES 146 |
| M00022373C:B07 | ES 146 |
| M00022391B:E01 | ES 146 |
| M00022391D:F10 | ES 146 |
| M00022416A:A07 | ES 146 |
| M00022421B:C11 | ES 146 |
| M00022433A:E02 | ES 146 |
| M00022434D:D06 | ES 146 |
| M00022440B:E01 | ES 146 |
| M00022444D:G01 | ES 146 |
| M00022467C:B12 | ES 146 |
| M00022489C:G04 | ES 146 |
| M00022492C:A02 | ES 146 |
| M00022495D:H08 | ES 146 |
| M00022496B:E12 | ES 146 |
| M00022499A:B02 | ES 146 |
| M00022533A:A08 | ES 146 |
| M00022579C:C11 | ES 146 |
| M00022597D:A06 | ES 146 |
| M00022602A:E09 | ES 146 |
| M00022615D:G05 | ES 146 |
| M00022634D:C08 | ES 146 |
| M00022640C:C12 | ES 146 |
| M00022641C:H05 | ES 146 |
| M00022646A:H10 | ES 146 |
| M00022662D:G11 | ES 146 |
| M00022667D:B02 | ES 146 |
| M00022668B:B12 | ES 146 |
| M00022670D:H11 | ES 146 |
| M00022671B:A08 | ES 146 |
| M00022684A:C02 | ES 146 |
| M00022731A:D02 | ES 147 |
| M00022739A:B03 | ES 147 |
| M00022747D:E03 | ES 147 |
| M00022767B:G11 | ES 147 |
| M00022785C:G06 | ES 147 |
| M00022793D:B01 | ES 147 |
| M00022795B:G06 | ES 147 |
| M00022797B:G08 | ES 147 |
| M00022817A:H02 | ES 147 |
| M00022821C:C09 | ES 147 |
| M00022823C:C01 | ES 147 |
| M00022830D:D01 | ES 147 |
| M00022834B:G11 | ES 147 |
| M00022854A:B03 | ES 147 |
| M00022856C:A07 | ES 147 |
| M00022860C:G04 | ES 147 |
| M00022885C:H05 | ES 147 |
| M00022895A:H08 | ES 147 |
| M00022910A:A06 | ES 147 |
| M00022925C:A08 | ES 147 |
| M00022928B:C01 | ES 147 |
| M00022930C:E02 | ES 147 |
| M00022938B:F07 | ES 147 |
| M00022968B:E02 | ES 147 |
| M00022976C:F04 | ES 147 |
| M00022979A:D05 | ES 147 |
| M00022986D:H09 | ES 147 |
| M00022997A:F06 | ES 147 |
| M00023001C:C08 | ES 147 |
| M00023003C:D07 | ES 147 |
| M00023007A:H04 | ES 147 |

TABLE 105-continued

| Clone Name | Tube |
|---|---|
| M00023007C:E10 | ES 147 |
| M00023020C:G08 | ES 147 |
| M00023024D:F12 | ES 147 |
| M00023032A:B05 | ES 147 |
| M00023039D:B05 | ES 147 |
| M00023042D:D02 | ES 147 |
| M00023044B:D02 | ES 147 |
| M00023094A:B11 | ES 147 |
| M00023100A:E12 | ES 147 |
| M00039181D:E05 | ES 147 |
| M00039184A:D03 | ES 147 |
| M00039184B:B09 | ES 147 |
| M00039361B:E01 | ES 147 |
| M00039363A:C09 | ES 147 |
| M00039366C:B07 | ES 147 |
| M00039367B:H02 | ES 147 |
| M00039371B:H06 | ES 147 |
| M00039372C:D12 | ES 147 |
| M00039374B:B07 | ES 147 |
| M00039374C:H12 | ES 147 |
| M00039374D:H02 | ES 147 |
| M00039376D:H07 | ES 147 |
| M00039377D:E12 | ES 147 |
| M00039378D:H07 | ES 147 |
| M00039379A:B03 | ES 147 |
| M00039380C:C09 | ES 147 |
| M00039482B:G02 | ES 147 |
| M00039493A:C04 | ES 147 |
| M00039496B:D08 | ES 147 |
| M00039496B:H09 | ES 147 |
| M00039497C:C06 | ES 147 |
| M00039499C:A04 | ES 147 |
| M00039500C:C04 | ES 147 |
| M00039505C:E03 | ES 147 |
| M00039508A:C12 | ES 147 |
| M00039508C:G01 | ES 147 |
| M00039510C:G02 | ES 147 |
| M00039512C:D06 | ES 147 |
| M00039515A:A06 | ES 147 |
| M00039515D:C11 | ES 147 |
| M00039517B:G12 | ES 147 |
| M00039521A:A02 | ES 147 |
| M00039521D:H03 | ES 147 |
| M00039528B:B12 | ES 147 |
| M00039529C:D07 | ES 147 |
| M00039530B:E02 | ES 147 |
| M00039533A:C12 | ES 147 |
| M00039533B:G08 | ES 147 |
| M00039533D:F04 | ES 147 |
| M00039535D:D10 | ES 147 |
| M00039536C:C10 | ES 147 |
| M00039536C:H11 | ES 147 |
| M00039561A:B07 | ES 147 |
| M00039561B:A09 | ES 147 |
| M00039562B:G02 | ES 147 |
| M00039564B:C01 | ES 147 |
| M00039570A:D10 | ES 147 |
| M00039570B:D10 | ES 147 |
| M00039584C:C01 | ES 147 |
| M00039584C:C11 | ES 147 |
| M00039587C:F12 | ES 147 |
| M00039590D:D02 | ES 147 |
| M00039591C:D06 | ES 147 |
| M00039595C:E05 | ES 147 |
| M00039597D:F04 | ES 147 |
| M00039600A:A11 | ES 148 |
| M00039604B:E05 | ES 148 |
| M00039604D:G03 | ES 148 |
| M00039606B:D08 | ES 148 |
| M00039607D:E08 | ES 148 |
| M00039608D:H01 | ES 148 |
| M00039609D:F07 | ES 148 |
| M00039624A:H09 | ES 148 |
| M00039624B:F12 | ES 148 |
| M00039625B:G08 | ES 148 |
| M00039626D:F04 | ES 148 |
| M00039629B:F01 | ES 148 |
| M00039629D:B04 | ES 148 |
| M00039630A:C08 | ES 148 |
| M00039630C:H04 | ES 148 |
| M00039641A:A05 | ES 148 |
| M00039641C:D07 | ES 148 |
| M00039642D:B12 | ES 148 |
| M00039642D:H09 | ES 148 |
| M00039643C:B04 | ES 148 |
| M00039645C:E01 | ES 148 |
| M00039647A:H11 | ES 148 |
| M00039736D:G08 | ES 148 |
| M00039740B:F10 | ES 148 |
| M00039752B:G08 | ES 148 |
| M00039755A:B08 | ES 148 |
| M00039756B:H06 | ES 148 |
| M00039760B:B08 | ES 148 |
| M00040131B:D11 | ES 148 |
| M00040131C:F03 | ES 148 |
| M00040131D:G08 | ES 148 |
| M00040133B:B03 | ES 148 |
| M00040136C:F08 | ES 148 |
| M00040138B:H03 | ES 148 |
| M00040141D:F05 | ES 148 |
| M00040143A:H05 | ES 148 |
| M00040145D:D03 | ES 148 |
| M00040147D:H11 | ES 148 |
| M00040160B:A10 | ES 148 |
| M00040162A:E01 | ES 148 |
| M00040169B:F08 | ES 148 |
| M00040173D:B05 | ES 148 |
| M00040174C:E10 | ES 148 |
| M00040174D:G03 | ES 148 |
| M00040181B:H09 | ES 148 |
| M00040181D:H10 | ES 148 |
| M00040182D:D06 | ES 148 |
| M00040183A:F07 | ES 148 |
| M00040184C:A11 | ES 148 |
| M00040191A:B09 | ES 148 |
| M00040221A:G11 | ES 148 |
| M00040222D:G02 | ES 148 |
| M00040223A:C05 | ES 148 |
| M00040226A:H10 | ES 148 |
| M00040230A:H02 | ES 148 |
| M00040231B:C08 | ES 148 |
| M00040232D:B07 | ES 148 |
| M00040233A:H02 | ES 148 |
| M00040233C:G05 | ES 148 |
| M00040252C:C06 | ES 148 |
| M00040253C:A05 | ES 148 |
| M00040254B:C10 | ES 148 |
| M00040256A:A06 | ES 148 |
| M00040257D:H10 | ES 148 |
| M00040260B:D02 | ES 148 |
| M00040260C:D04 | ES 148 |
| M00040261C:F01 | ES 148 |
| M00040262B:B06 | ES 148 |
| M00040264D:G05 | ES 148 |
| M00040265D:B07 | ES 148 |
| M00040265D:C08 | ES 148 |
| M00040267A:E06 | ES 148 |
| M00040267C:C04 | ES 148 |
| M00040271B:E12 | ES 148 |
| M00040271C:D08 | ES 148 |
| M00040273B:H12 | ES 148 |
| M00040274A:D07 | ES 148 |
| M00040274A:H11 | ES 148 |
| M00040280C:H05 | ES 148 |
| M00040281D:B01 | ES 148 |
| M00040282A:A03 | ES 148 |
| M00040286C:C02 | ES 148 |
| M00040287C:B09 | ES 148 |
| M00040287D:D07 | ES 148 |
| M00039746C:A08 | ES 148 |
| M00039746C:G09 | ES 148 |
| M00039746C:H05 | ES 148 |
| M00039746C:H06 | ES 148 |
| M00039746D:D11 | ES 148 |
| M00039748A:F11 | ES 148 |
| M00039748C:F11 | ES 148 |

TABLE 105-continued

| Clone Name | Tube |
|---|---|
| M00039749D:D05 | ES 148 |
| M00039761D:E10 | ES 148 |
| M00039762B:F07 | ES 148 |
| M00039764C:D07 | ES 148 |
| M00039766A:G07 | ES 148 |
| M00039766D:H01 | ES 149 |
| M00039767B:A04 | ES 149 |
| M00039767C:E12 | ES 149 |
| M00039770A:G11 | ES 149 |
| M00039770C:E04 | ES 149 |
| M00039942D:C01 | ES 149 |
| M00039943B:F10 | ES 149 |
| M00039945C:F09 | ES 149 |
| M00039946B:F08 | ES 149 |
| M00039947A:D06 | ES 149 |
| M00039947C:G03 | ES 149 |
| M00039948A:E03 | ES 149 |
| M00039948D:D11 | ES 149 |
| M00039951A:B07 | ES 149 |
| M00039951B:B12 | ES 149 |
| M00039951B:C03 | ES 149 |
| M00039955C:C04 | ES 149 |
| M00039957C:C09 | ES 149 |
| M00039957D:A12 | ES 149 |
| M00039958A:A08 | ES 149 |
| M00039958C:B09 | ES 149 |
| M00040201C:G11 | ES 149 |
| M00040202A:F05 | ES 149 |
| M00040203A:H06 | ES 149 |
| M00040203B:A05 | ES 149 |
| M00040203D:H11 | ES 149 |
| M00040206A:A07 | ES 149 |
| M00040207B:D08 | ES 149 |
| M00040208A:C03 | ES 149 |
| M00040208B:A07 | ES 149 |
| M00040208D:G09 | ES 149 |
| M00040217D:B07 | ES 149 |
| M00040218C:C02 | ES 149 |
| M00040219B:D02 | ES 149 |
| M00040219D:E08 | ES 149 |
| M00040291D:C05 | ES 149 |
| M00040293D:G04 | ES 149 |
| M00040294D:D12 | ES 149 |
| M00040296D:E09 | ES 149 |
| M00040298B:G02 | ES 149 |
| M00040299B:F10 | ES 149 |
| M00040313C:D05 | ES 149 |
| M00040313D:E04 | ES 149 |
| M00040314D:H05 | ES 149 |
| M00040317A:H03 | ES 149 |
| M00040317D:F02 | ES 149 |
| M00040318A:B02 | ES 149 |
| M00040318C:H11 | ES 149 |
| M00040320D:F02 | ES 149 |
| M00040323B:C12 | ES 149 |
| M00040323C:G11 | ES 149 |
| M00040326A:F04 | ES 149 |
| M00040327B:G06 | ES 149 |
| M00040332D:B05 | ES 149 |
| M00040333D:G05 | ES 149 |
| M00040334B:B02 | ES 149 |
| M00040334D:C07 | ES 149 |
| M00040342B:D12 | ES 149 |
| M00040345D:A09 | ES 149 |
| M00040346A:C11 | ES 149 |
| M00040347D:F09 | ES 149 |
| M00040349B:B09 | ES 149 |
| M00040351B:F02 | ES 149 |
| M00040351D:A11 | ES 149 |
| M00040364A:E05 | ES 149 |
| M00040366A:B01 | ES 149 |
| M00040368A:A12 | ES 149 |
| M00040368A:F01 | ES 149 |
| M00040368D:E09 | ES 149 |
| M00040371C:H05 | ES 149 |
| M00040375C:B06 | ES 149 |
| M00040376C:G02 | ES 149 |
| M00040377C:G07 | ES 149 |
| M00040383A:H02 | ES 149 |
| M00040383D:C04 | ES 149 |
| M00040385C:D02 | ES 149 |
| M00040386A:A02 | ES 149 |
| M00040387C:E07 | ES 149 |
| M00040387D:H05 | ES 149 |
| M00040390A:H02 | ES 149 |
| M00040390B:F02 | ES 149 |
| M00040391A:D10 | ES 149 |
| M00040392B:H01 | ES 149 |
| M00040392C:B12 | ES 149 |
| M00040394A:D04 | ES 149 |
| M00040395B:D11 | ES 149 |
| M00042534A:A05 | ES 149 |
| M00042538B:E06 | ES 149 |
| M00042543C:G04 | ES 149 |
| M00042558A:F03 | ES 149 |
| M00042560A:F12 | ES 149 |
| M00042565C:A08 | ES 149 |
| M00042566C:C05 | ES 149 |
| M00042567B:H10 | ES 149 |
| M00042693D:E04 | ES 149 |
| M00042696B:E05 | ES 149 |
| M00042697D:C07 | ES 150 |
| M00042698D:D10 | ES 150 |
| M00042698D:E01 | ES 150 |
| M00042702B:G02 | ES 150 |
| M00042704A:F09 | ES 150 |
| M00042711B:A11 | ES 150 |
| M00042717A:C07 | ES 150 |
| M00042737C:H04 | ES 150 |
| M00042740A:E09 | ES 150 |
| M00042742D:D05 | ES 150 |
| M00042887C:D07 | ES 150 |
| M00042895A:D10 | ES 150 |
| M00042895C:G01 | ES 150 |
| M00042902D:B08 | ES 150 |
| M00042904B:E07 | ES 150 |
| M00042905A:F11 | ES 150 |
| M00042905B:C03 | ES 150 |
| M00042905D:D02 | ES 150 |
| M00042347D:H11 | ES 150 |
| M00042348B:E05 | ES 150 |
| M00042349D:D07 | ES 150 |
| M00042431B:G08 | ES 150 |
| M00042431C:F01 | ES 150 |
| M00042431D:C10 | ES 150 |
| M00042432D:E02 | ES 150 |
| M00042435A:A11 | ES 150 |
| M00042436B:H09 | ES 150 |
| M00042437A:D04 | ES 150 |
| M00042439B:B03 | ES 150 |
| M00042439B:D03 | ES 150 |
| M00042440B:E09 | ES 150 |
| M00042463A:F09 | ES 150 |
| M00042470C:E05 | ES 150 |
| M00042511A:H04 | ES 150 |
| M00042515C:F08 | ES 150 |
| M00042751C:C12 | ES 150 |
| M00042752A:E11 | ES 150 |
| M00042756B:F11 | ES 150 |
| M00042756D:A10 | ES 150 |
| M00042759B:G11 | ES 150 |
| M00042760A:C12 | ES 150 |
| M00042765C:D04 | ES 150 |
| M00042767B:G10 | ES 150 |
| M00042769C:E09 | ES 150 |
| M00042770B:B12 | ES 150 |
| M00042770C:C04 | ES 150 |
| M00042771C:F06 | ES 150 |
| M00042774C:C05 | ES 150 |
| M00042781A:A07 | ES 150 |
| M00042784A:H06 | ES 150 |
| M00042788C:F11 | ES 150 |
| M00042790C:C07 | ES 150 |
| M00042792A:H01 | ES 150 |
| M00042797D:D10 | ES 150 |
| M00042799D:F08 | ES 150 |

TABLE 105-continued

| Clone Name | Tube |
|---|---|
| M00042800A:A03 | ES 150 |
| M00042802C:C04 | ES 150 |
| M00042806C:F07 | ES 150 |
| M00042807D:D05 | ES 150 |
| M00042823C:C02 | ES 150 |
| M00042830B:E02 | ES 150 |
| M00042839B:B11 | ES 150 |
| M00042841D:H07 | ES 150 |
| M00042849D:F11 | ES 150 |
| M00042852B:A03 | ES 150 |
| M00042852C:A01 | ES 150 |
| M00042856B:H02 | ES 150 |
| M00042352C:H03 | ES 150 |
| M00042352D:C01 | ES 150 |
| M00042352D:G09 | ES 150 |
| M00042448A:C09 | ES 150 |
| M00042448C:H12 | ES 150 |
| M00042453B:G09 | ES 150 |
| M00042518D:A06 | ES 150 |
| M00042518D:D04 | ES 150 |
| M00043296B:G09 | ES 150 |
| M00043304B:D05 | ES 150 |
| M00043304C:D02 | ES 150 |
| M00043305B:G02 | ES 150 |
| M00043306C:B03 | ES 150 |
| M00043306D:B07 | ES 150 |
| M00043310C:G06 | ES 150 |
| M00043311C:E03 | ES 150 |
| M00043312C:E08 | ES 150 |
| M00043320B:A07 | ES 150 |
| M00043324D:H11 | ES 150 |
| M00043328D:H02 | ES 150 |
| M00043332C:G04 | ES 150 |
| M00043334B:A10 | ES 150 |
| M00043338B:A03 | ES 150 |
| M00043338B:C11 | ES 150 |
| M00043339A:F11 | ES 150 |
| M00043340B:H08 | ES 150 |
| M00043344D:E04 | ES 150 |
| M00043345C:A06 | ES 150 |
| M00043346A:G01 | ES 150 |
| M00043350D:B11 | ES 151 |
| M00043351D:A11 | ES 151 |
| M00043352D:B05 | ES 151 |
| M00043352D:C03 | ES 151 |
| M00043359B:D10 | ES 151 |
| M00043359C:G01 | ES 151 |
| M00043361B:A01 | ES 151 |
| M00043366A:A02 | ES 151 |
| M00043366C:H05 | ES 151 |
| M00043367B:A08 | ES 151 |
| M00043368C:F09 | ES 151 |
| M00043370B:C08 | ES 151 |
| M00043372C:G05 | ES 151 |
| M00043377A:C03 | ES 151 |
| M00043378A:H10 | ES 151 |
| M00043379D:H02 | ES 151 |
| M00043383C:F12 | ES 151 |
| M00043383D:A02 | ES 151 |
| M00043384B:B02 | ES 151 |
| M00043386A:B08 | ES 151 |
| M00043389C:E03 | ES 151 |
| M00043389D:D07 | ES 151 |
| M00043391A:C10 | ES 151 |
| M00043391A:G08 | ES 151 |
| M00043392D:C11 | ES 151 |
| M00043393A:B08 | ES 151 |
| M00043401D:G08 | ES 151 |
| M00043402C:D08 | ES 151 |
| M00043405A:D11 | ES 151 |
| M00043405C:G12 | ES 151 |
| M00043405C:G02 | ES 151 |
| M00043406B:G12 | ES 151 |
| M00043407C:E05 | ES 151 |
| M00043408B:D11 | ES 151 |
| M00043409B:B03 | ES 151 |
| M00043410C:A09 | ES 151 |
| M00043411B:D08 | ES 151 |
| M00043411D:H06 | ES 151 |
| M00042584B:C10 | ES 151 |
| M00042623D:D07 | ES 151 |
| M00042625C:B04 | ES 151 |
| M00042626B:D08 | ES 151 |
| M00042627C:D01 | ES 151 |
| M00042630A:C05 | ES 151 |
| M00042955C:D05 | ES 151 |
| M00042956C:B06 | ES 151 |
| M00042960D:H08 | ES 151 |
| M00042962D:C05 | ES 151 |
| M00042964D:A03 | ES 151 |
| M00042966B:F07 | ES 151 |
| M00042966C:E06 | ES 151 |
| M00042970C:A04 | ES 151 |
| M00042970C:H10 | ES 151 |
| M00042976A:H04 | ES 151 |
| M00042979B:E02 | ES 151 |
| M00042981B:D11 | ES 151 |
| M00042983C:A11 | ES 151 |
| M00042983C:G06 | ES 151 |
| M00042986C:G12 | ES 151 |
| M00042988A:F06 | ES 151 |
| M00042997B:D06 | ES 151 |
| M00042998A:E03 | ES 151 |
| M00042998A:G04 | ES 151 |
| M00043001B:H10 | ES 151 |
| M00043001D:D03 | ES 151 |
| M00043002A:E05 | ES 151 |
| M00043003C:D08 | ES 151 |
| M00043011A:H12 | ES 151 |
| M00043015A:H10 | ES 151 |
| M00043022A:E12 | ES 151 |
| M00043026C:D07 | ES 151 |
| M00043028A:G05 | ES 151 |
| M00043029C:A06 | ES 151 |
| M00043032C:A10 | ES 151 |
| M00043034D:C01 | ES 151 |
| M00043036C:E05 | ES 151 |
| M00043036D:C09 | ES 151 |
| M00043040B:B07 | ES 151 |
| M00043044B:A12 | ES 151 |
| M00043044D:A09 | ES 151 |
| M00043045D:G12 | ES 151 |
| M00043046D:B11 | ES 151 |
| M00043060D:G12 | ES 151 |
| M00043066B:H11 | ES 151 |
| M00043067D:D10 | ES 151 |
| M00043125A:B11 | ES 151 |
| M00043125C:A11 | ES 151 |
| M00042611A:A06 | ES 151 |
| M00042611D:B12 | ES 151 |
| M00042612D:F06 | ES 151 |
| M00042614B:B05 | ES 151 |
| M00043073A:C12 | ES 151 |
| M00043078D:D04 | ES 151 |
| M00043081D:F05 | ES 151 |
| M00043087B:G07 | ES 151 |
| M00043093C:G11 | ES 151 |
| M00043095A:F09 | ES 152 |
| M00043096A:G04 | ES 152 |
| M00043108A:F06 | ES 152 |
| M00043109C:G01 | ES 152 |
| M00043131B:A09 | ES 152 |
| M00043133B:C11 | ES 152 |
| M00043138D:B11 | ES 152 |
| M00043143B:A10 | ES 152 |
| M00043148C:A09 | ES 152 |
| M00043154A:B07 | ES 152 |
| M00043162A:B08 | ES 152 |
| M00043162D:C12 | ES 152 |
| M00043164C:E12 | ES 152 |
| M00043165B:G01 | ES 152 |
| M00043173D:G03 | ES 152 |
| M00043184A:H08 | ES 152 |
| M00043187A:C04 | ES 152 |
| M00043191A:A07 | ES 152 |
| M00043192C:B12 | ES 152 |

TABLE 105-continued

| Clone Name | Tube |
|---|---|
| M00043200A:H09 | ES 152 |
| M00043200B:C08 | ES 152 |
| M00043202B:F01 | ES 152 |
| M00043203A:B09 | ES 152 |
| M00043210C:E05 | ES 152 |
| M00043211A:F01 | ES 152 |
| M00043213B:B12 | ES 152 |
| M00043215A:D02 | ES 152 |
| M00043220B:C04 | ES 152 |
| M00042591D:H03 | ES 152 |
| M00042592A:H10 | ES 152 |
| M00042593A:C02 | ES 152 |
| M00042593C:G06 | ES 152 |
| M00042595A:A11 | ES 152 |
| M00042595A:B01 | ES 152 |
| M00042596B:F06 | ES 152 |
| M00042596C:D07 | ES 152 |
| M00042597B:E12 | ES 152 |
| M00043416C:A02 | ES 152 |
| M00043417C:D05 | ES 152 |
| M00043418A:H10 | ES 152 |
| M00043419D:A10 | ES 152 |
| M00043428D:G08 | ES 152 |
| M00043430B:C02 | ES 152 |
| M00043431D:B08 | ES 152 |
| M00043433B:G09 | ES 152 |
| M00043433C:G07 | ES 152 |
| M00043437D:D04 | ES 152 |
| M00043440C:B07 | ES 152 |
| M00043446C:E12 | ES 152 |
| M00043447A:C07 | ES 152 |
| M00043449A:E12 | ES 152 |
| M00043450C:C06 | ES 152 |
| M00043453B:B09 | ES 152 |
| M00043458A:B12 | ES 152 |
| M00043461D:C02 | ES 152 |
| M00043461D:E06 | ES 152 |
| M00043465B:H02 | ES 152 |
| M00043465C:A03 | ES 152 |
| M00043465C:C09 | ES 152 |
| M00043476A:F07 | ES 152 |
| M00043483B:G10 | ES 152 |
| M00043491C:F04 | ES 152 |
| M00043492A:E01 | ES 152 |
| M00043513D:G08 | ES 152 |
| M00043516B:H09 | ES 152 |
| M00043518B:D06 | ES 152 |
| M00043526B:D10 | ES 152 |
| M00043527C:E09 | ES 152 |
| M00043528C:A02 | ES 152 |
| M00043616B:F02 | ES 152 |
| M00043616C:A05 | ES 152 |
| M00043632D:F09 | ES 152 |
| M00043634A:C10 | ES 152 |
| M00043635C:C11 | ES 152 |
| M00043636B:C06 | ES 152 |
| M00043637C:H01 | ES 152 |
| M00043638A:D06 | ES 152 |
| M00043640C:E03 | ES 152 |
| M00043648A:G07 | ES 152 |
| M00043649B:E07 | ES 152 |
| M00001338C:B02 | ES 153 |
| M00001338C:F05 | ES 153 |
| M00001338D:D01 | ES 153 |
| M00001340D:F07 | ES 153 |
| M00001344D:E08 | ES 153 |
| M00001346B:G11 | ES 153 |
| M00001348B:B03 | ES 153 |
| M00001349C:B04 | ES 153 |
| M00001351B:E11 | ES 153 |
| M00001352B:B02 | ES 153 |
| M00001353A:H07 | ES 153 |
| M00001353C:A05 | ES 153 |
| M00001353D:E05 | ES 153 |
| M00001356D:E06 | ES 153 |
| M00001358A:E08 | ES 153 |
| M00001359A:H10 | ES 153 |
| M00001361A:C12 | ES 153 |
| M00001361B:A12 | ES 153 |
| M00001362A:F09 | ES 153 |
| M00001364A:C09 | ES 153 |
| M00001364C:H10 | ES 153 |
| M00001368A:A08 | ES 153 |
| M00001368A:B07 | ES 153 |
| M00001368A:C02 | ES 153 |
| M00001369A:G06 | ES 153 |
| M00001374A:B02 | ES 153 |
| M00001374C:B10 | ES 153 |
| M00001375B:D04 | ES 153 |
| M00001378C:E10 | ES 153 |
| M00001379A:F09 | ES 153 |
| M00001382D:A07 | ES 153 |
| M00001382D:H08 | ES 153 |
| M00001384A:A07 | ES 153 |
| M00001385A:E07 | ES 153 |
| M00001386B:F11 | ES 153 |
| M00001387A:C12 | ES 153 |
| M00001387B:A11 | ES 153 |
| M00001389B:E10 | ES 153 |
| M00001389D:D06 | ES 153 |
| M00001390D:E02 | ES 153 |
| M00001391D:D03 | ES 153 |
| M00001393B:C03 | ES 153 |
| M00001393C:E08 | ES 153 |
| M00001393C:F04 | ES 153 |
| M00001393D:E02 | ES 153 |
| M00001396B:B01 | ES 153 |
| M00001396B:B12 | ES 153 |
| M00001396D:H02 | ES 153 |
| M00001397C:H08 | ES 153 |
| M00001399B:B01 | ES 153 |
| M00001399C:A01 | ES 153 |
| M00001403C:B03 | ES 153 |
| M00001403D:C12 | ES 153 |
| M00001406B:H09 | ES 153 |
| M00001406D:F06 | ES 153 |
| M00001410A:G10 | ES 153 |
| M00001416B:A05 | ES 153 |
| M00001421B:E07 | ES 153 |
| M00001422B:D06 | ES 153 |
| M00001424B:H06 | ES 153 |
| M00001424D:D02 | ES 153 |
| M00001426C:F06 | ES 153 |
| M00001428B:C10 | ES 153 |
| M00001429B:G05 | ES 153 |
| M00001430B:C01 | ES 153 |
| M00001433B:E02 | ES 153 |
| M00001442A:F08 | ES 153 |
| M00001442C:G12 | ES 153 |
| M00001444B:E04 | ES 153 |
| M00001444C:D11 | ES 153 |
| M00001445B:F06 | ES 153 |
| M00001449B:H10 | ES 153 |
| M00001451C:E10 | ES 153 |
| M00001460C:E10 | ES 153 |
| M00001461D:B10 | ES 153 |
| M00001461D:C10 | ES 153 |
| M00001465C:A02 | ES 153 |
| M00001466B:F03 | ES 153 |
| M00001467C:D04 | ES 153 |
| M00001477D:G09 | ES 153 |
| M00001485C:F06 | ES 153 |
| M00001488C:A03 | ES 153 |
| M00001497C:F10 | ES 153 |
| M00001503B:H10 | ES 153 |
| M00001506B:D11 | ES 153 |
| M00001512D:F08 | ES 153 |
| M00001518B:D10 | ES 153 |
| M00001528C:C03 | ES 153 |
| M00001532A:G08 | ES 153 |
| M00001533C:G11 | ES 153 |
| M00001533D:A01 | ES 153 |
| M00001534C:E07 | ES 153 |
| M00001535B:B10 | ES 153 |
| M00001535B:E02 | ES 153 |
| M00001537B:H10 | ES 153 |

TABLE 105-continued

| Clone Name | Tube |
|---|---|
| M00001538B:A07 | ES 153 |
| M00001539C:F12 | ES 154 |
| M00001542B:F09 | ES 154 |
| M00001543C:A08 | ES 154 |
| M00001544B:B05 | ES 154 |
| M00001544B:E06 | ES 154 |
| M00001546B:C11 | ES 154 |
| M00001548B:D06 | ES 154 |
| M00001550A:H06 | ES 154 |
| M00001550D:B11 | ES 154 |
| M00001551D:D01 | ES 154 |
| M00001551D:H09 | ES 154 |
| M00001554C:G10 | ES 154 |
| M00001558A:E06 | ES 154 |
| M00001559A:H09 | ES 154 |
| M00001561D:H04 | ES 154 |
| M00001562B:B02 | ES 154 |
| M00001562D:B07 | ES 154 |
| M00001565A:H05 | ES 154 |
| M00001568C:A03 | ES 154 |
| M00001570A:B07 | ES 154 |
| M00001591B:H05 | ES 154 |
| M00001596A:D02 | ES 154 |
| M00001600B:G01 | ES 154 |
| M00001605B:B05 | ES 154 |
| M00001606B:A10 | ES 154 |
| M00001606D:D06 | ES 154 |
| M00001607A:E04 | ES 154 |
| M00001607D:H09 | ES 154 |
| M00001609D:C11 | ES 154 |
| M00001616D:F03 | ES 154 |
| M00001617C:F10 | ES 154 |
| M00001618C:D01 | ES 154 |
| M00001619C:H09 | ES 154 |
| M00001620B:A03 | ES 154 |
| M00001623D:A10 | ES 154 |
| M00001623D:E12 | ES 154 |
| M00001624A:C01 | ES 154 |
| M00001625D:B04 | ES 154 |
| M00001626A:D07 | ES 154 |
| M00001632C:A10 | ES 154 |
| M00001633D:C11 | ES 154 |
| M00001637D:C12 | ES 154 |
| M00001648A:D10 | ES 154 |
| M00001661D:F06 | ES 154 |
| M00001663A:A12 | ES 154 |
| M00001671A:H10 | ES 154 |
| M00001671C:F03 | ES 154 |
| M00001675B:D06 | ES 154 |
| M00001677B:H08 | ES 154 |
| M00001680A:A01 | ES 154 |
| M00001683B:F11 | ES 154 |
| M00001684D:E04 | ES 154 |
| M00001686B:H01 | ES 154 |
| M00001686D:F06 | ES 154 |
| M00001688B:B11 | ES 154 |
| M00001692C:C04 | ES 154 |
| M00001771B:E06 | ES 154 |
| M00003746C:E11 | ES 154 |
| M00003749C:C08 | ES 154 |
| M00003753A:C11 | ES 154 |
| M00003758B:D07 | ES 154 |
| M00003758B:F06 | ES 154 |
| M00003760C:G10 | ES 154 |
| M00003761B:B02 | ES 154 |
| M00003763A:B02 | ES 154 |
| M00003763B:B10 | ES 154 |
| M00003764A:H09 | ES 154 |
| M00003764B:F11 | ES 154 |
| M00003764B:H11 | ES 154 |
| M00003764C:F07 | ES 154 |
| M00003768D:D08 | ES 154 |
| M00003770C:A10 | ES 154 |
| M00003771D:A03 | ES 154 |
| M00003773A:F10 | ES 154 |
| M00003780A:G01 | ES 154 |
| M00003782A:B02 | ES 154 |
| M00003785D:F07 | ES 154 |
| M00003787D:A10 | ES 154 |
| M00003808A:F11 | ES 154 |
| M00003808B:E07 | ES 154 |
| M00003812C:A03 | ES 154 |
| M00003814A:G05 | ES 154 |
| M00003819B:B01 | ES 154 |
| M00003820B:F11 | ES 154 |
| M00003821C:E12 | ES 154 |
| M00003822C:A09 | ES 154 |
| M00003822D:A02 | ES 154 |
| M00003823B:A06 | ES 154 |
| M00003825A:H10 | ES 154 |
| M00003828A:D11 | ES 154 |
| M00003830B:C06 | ES 154 |
| M00003830C:D02 | ES 154 |
| M00003837C:D10 | ES 154 |
| M00003839C:H10 | ES 154 |
| M00003842D:D11 | ES 154 |
| M00003842D:H09 | ES 154 |
| M00003845A:C07 | ES 155 |
| M00003845D:G03 | ES 155 |
| M00003847A:H04 | ES 155 |
| M00003848C:G09 | ES 155 |
| M00003851B:A01 | ES 155 |
| M00003854B:F07 | ES 155 |
| M00003855C:F02 | ES 155 |
| M00003884A:E12 | ES 155 |
| M00003887C:E09 | ES 155 |
| M00003888B:F09 | ES 155 |
| M00003891B:H02 | ES 155 |
| M00003898C:A01 | ES 155 |
| M00003900C:D12 | ES 155 |
| M00003906A:C02 | ES 155 |
| M00003911C:A09 | ES 155 |
| M00003914A:A08 | ES 155 |
| M00003915C:D10 | ES 155 |
| M00003915C:G08 | ES 155 |
| M00003916A:E04 | ES 155 |
| M00003926A:F11 | ES 155 |
| M00003935B:B01 | ES 155 |
| M00003938C:A05 | ES 155 |
| M00003942A:D01 | ES 155 |
| M00003958C:H08 | ES 155 |
| M00003959D:A05 | ES 155 |
| M00003960D:C12 | ES 155 |
| M00003963D:F01 | ES 155 |
| M00003965D:D11 | ES 155 |
| M00003968C:G03 | ES 155 |
| M00003970D:H07 | ES 155 |
| M00003972C:F07 | ES 155 |
| M00003974C:E11 | ES 155 |
| M00003974D:E02 | ES 155 |
| M00003979B:A04 | ES 155 |
| M00003980D:C06 | ES 155 |
| M00003985D:B02 | ES 155 |
| M00003988D:B01 | ES 155 |
| M00003991A:C11 | ES 155 |
| M00003993C:D07 | ES 155 |
| M00003993D:B03 | ES 155 |
| M00003994A:B10 | ES 155 |
| M00003996B:H07 | ES 155 |
| M00003998B:G10 | ES 155 |
| M00004028B:F10 | ES 155 |
| M00004029D:A01 | ES 155 |
| M00004031C:G06 | ES 155 |
| M00004036B:A11 | ES 155 |
| M00004036D:C12 | ES 155 |
| M00004038A:A04 | ES 155 |
| M00004042B:A11 | ES 155 |
| M00004047C:B09 | ES 155 |
| M00004047D:F12 | ES 155 |
| M00004053D:F09 | ES 155 |
| M00004054A:D03 | ES 155 |
| M00004055C:B10 | ES 155 |
| M00004055D:D05 | ES 155 |
| M00004057D:G01 | ES 155 |
| M00004061B:E05 | ES 155 |
| M00004062D:A02 | ES 155 |

TABLE 105-continued

| Clone Name | Tube |
|---|---|
| M00004066D:G10 | ES 155 |
| M00004067B:D03 | ES 155 |
| M00004080C:C04 | ES 155 |
| M00004085A:H01 | ES 155 |
| M00004085B:H02 | ES 155 |
| M00004087C:E02 | ES 155 |
| M00004093A:C03 | ES 155 |
| M00004096D:F02 | ES 155 |
| M00004102A:E03 | ES 155 |
| M00004103C:E10 | ES 155 |
| M00004104A:A12 | ES 155 |
| M00004110D:F09 | ES 155 |
| M00004114C:D11 | ES 155 |
| M00004115A:G12 | ES 155 |
| M00004118C:D12 | ES 155 |
| M00004122C:D01 | ES 155 |
| M00004134A:A08 | ES 155 |
| M00004136C:B12 | ES 155 |
| M00004139B:F01 | ES 155 |
| M00004141A:D01 | ES 155 |
| M00004141B:B01 | ES 155 |
| M00004141B:F08 | ES 155 |
| M00004143B:B04 | ES 155 |
| M00004144D:B02 | ES 155 |
| M00004146A:C11 | ES 155 |
| M00004146B:E08 | ES 155 |
| M00004146C:B04 | ES 155 |
| M00004147C:E01 | ES 155 |
| M00004151B:A07 | ES 155 |
| M00004155A:H03 | ES 155 |
| M00004155C:A10 | ES 155 |
| M00004158B:E03 | ES 155 |
| M00004158D:E08 | ES 155 |
| M00004159C:D10 | ES 155 |
| M00004159D:F12 | ES 155 |
| M00004160D:F06 | ES 155 |
| M00004160D:G05 | ES 155 |
| M00004162D:F02 | ES 156 |
| M00004163B:C03 | ES 156 |
| M00004163C:A03 | ES 156 |
| M00004164B:E12 | ES 156 |
| M00004165C:A11 | ES 156 |
| M00004166C:B10 | ES 156 |
| M00004169A:E04 | ES 156 |
| M00004170A:F03 | ES 156 |
| M00004171B:B03 | ES 156 |
| M00004172C:A08 | ES 156 |
| M00004172D:B12 | ES 156 |
| M00004172D:F04 | ES 156 |
| M00004175D:E06 | ES 156 |
| M00004176C:A09 | ES 156 |
| M00004179C:B06 | ES 156 |
| M00004179D:A12 | ES 156 |
| M00004187B:C02 | ES 156 |
| M00004189A:C12 | ES 156 |
| M00004192C:B06 | ES 156 |
| M00004195A:F07 | ES 156 |
| M00004200C:A04 | ES 156 |
| M00004201D:C01 | ES 156 |
| M00004201D:C03 | ES 156 |
| M00004204C:H08 | ES 156 |
| M00004207C:A04 | ES 156 |
| M00004208A:D08 | ES 156 |
| M00004210A:A03 | ES 156 |
| M00004212D:C03 | ES 156 |
| M00004214A:E05 | ES 156 |
| M00004214A:A05 | ES 156 |
| M00004215B:C05 | ES 156 |
| M00004220D:C11 | ES 156 |
| M00004225D:E03 | ES 156 |
| M00004229B:B06 | ES 156 |
| M00004230D:B05 | ES 156 |
| M00004237C:D10 | ES 156 |
| M00004242D:H01 | ES 156 |
| M00004245C:G10 | ES 156 |
| M00004246B:H07 | ES 156 |
| M00004251D:D03 | ES 156 |
| M00004263C:D03 | ES 156 |
| M00004266B:F07 | ES 156 |
| M00004269A:F11 | ES 156 |
| M00004269A:G11 | ES 156 |
| M00004269B:B04 | ES 156 |
| M00004270A:E09 | ES 156 |
| M00004276C:A08 | ES 156 |
| M00004277D:B02 | ES 156 |
| M00004278A:G06 | ES 156 |
| M00004278C:B10 | ES 156 |
| M00004281A:C04 | ES 156 |
| M00004282A:D01 | ES 156 |
| M00004282B:D07 | ES 156 |
| M00004282C:A12 | ES 156 |
| M00004284A:F08 | ES 156 |
| M00004295D:C07 | ES 156 |
| M00004296B:D03 | ES 156 |
| M00004303C:C05 | ES 156 |
| M00004310B:E02 | ES 156 |
| M00004316A:B03 | ES 156 |
| M00004320C:E07 | ES 156 |
| M00004321C:C11 | ES 156 |
| M00004322B:D03 | ES 156 |
| M00004324A:B03 | ES 156 |
| M00004324A:D10 | ES 156 |
| M00004324A:D05 | ES 156 |
| M00004328A:D01 | ES 156 |
| M00004330A:A01 | ES 156 |
| M00004336A:A01 | ES 156 |
| M00004341C:A09 | ES 156 |
| M00004341C:E05 | ES 156 |
| M00004344A:G11 | ES 156 |
| M00004344D:C12 | ES 156 |
| M00004347B:E04 | ES 156 |
| M00004347C:A05 | ES 156 |
| M00004350A:A04 | ES 156 |
| M00004351B:G07 | ES 156 |
| M00004352A:D08 | ES 156 |
| M00004357B:B06 | ES 156 |
| M00004358B:G02 | ES 156 |
| M00004359A:E01 | ES 156 |
| M00004360C:D09 | ES 156 |
| M00004365C:C09 | ES 156 |
| M00004365C:G11 | ES 156 |
| M00004366D:C11 | ES 156 |
| M00004368A:B11 | ES 156 |
| M00004372A:E12 | ES 156 |
| M00004376D:A12 | ES 156 |
| M00004385C:H12 | ES 156 |
| M00004393C:D06 | ES 156 |
| M00004406A:G09 | ES 156 |
| M00004416B:G10 | ES 156 |
| M00004418B:A11 | ES 156 |
| M00004419A:G02 | ES 156 |
| M00004420D:E05 | ES 156 |
| M00004430A:A05 | ES 156 |
| M00004430B:B10 | ES 156 |
| M00004443C:F07 | ES 157 |
| M00004462D:D12 | ES 157 |
| M00004502A:D12 | ES 157 |
| M00004507D:E03 | ES 157 |
| M00004509B:B10 | ES 157 |
| M00004509D:C06 | ES 157 |
| M00004603B:E02 | ES 157 |
| M00004603C:C10 | ES 157 |
| M00004606D:H09 | ES 157 |
| M00004608A:C10 | ES 157 |
| M00004608A:H04 | ES 157 |
| M00004609A:E09 | ES 157 |
| M00023389A:G04 | ES 157 |
| M00023394D:D10 | ES 157 |
| M00026809A:H08 | ES 157 |
| M00026818C:E01 | ES 157 |
| M00026836B:H03 | ES 157 |
| M00026842B:A01 | ES 157 |
| M00026842D:C02 | ES 157 |
| M00026850B:C09 | ES 157 |
| M00026856B:G03 | ES 157 |
| M00026900A:H07 | ES 157 |

TABLE 105-continued

| Clone Name | Tube |
|---|---|
| M00026907D:E07 | ES 157 |
| M00026910B:G06 | ES 157 |
| M00026914C:H09 | ES 157 |
| M00026936D:C07 | ES 157 |
| M00026961A:B06 | ES 157 |
| M00026994D:D07 | ES 157 |
| M00027004C:C11 | ES 157 |
| M00027017A:B09 | ES 157 |
| M00027036A:B06 | ES 157 |
| M00027050A:B02 | ES 157 |
| M00027052A:E10 | ES 157 |
| M00027057C:D10 | ES 157 |
| M00027064B:D06 | ES 157 |
| M00027081A:A08 | ES 157 |
| M00027093A:H02 | ES 157 |
| M00027131A:B03 | ES 157 |
| M00027159C:F07 | ES 157 |
| M00027167C:B10 | ES 157 |
| M00027168B:H08 | ES 157 |
| M00027170D:C07 | ES 157 |
| M00027173C:E11 | ES 157 |
| M00027177B:D04 | ES 157 |
| M00027178B:A11 | ES 157 |
| M00027182B:G06 | ES 157 |
| M00027189C:B10 | ES 157 |
| M00027193C:A07 | ES 157 |
| M00027215A:F06 | ES 157 |
| M00027215B:B12 | ES 157 |
| M00027244C:B06 | ES 157 |
| M00027247C:D02 | ES 157 |
| M00027262A:A07 | ES 157 |
| M00027270A:D04 | ES 157 |
| M00027274A:A09 | ES 157 |
| M00027290C:F06 | ES 157 |
| M00027291A:G08 | ES 157 |
| M00027311A:H09 | ES 157 |
| M00027313C:E01 | ES 157 |
| M00027314D:E02 | ES 157 |
| M00027316C:C03 | ES 157 |
| M00027319C:C03 | ES 157 |
| M00027319D:F07 | ES 157 |
| M00027332B:H09 | ES 157 |
| M00027359B:A06 | ES 157 |
| M00027363D:G04 | ES 157 |
| M00027364B:E12 | ES 157 |
| M00027376C:A02 | ES 157 |
| M00027381B:B04 | ES 157 |
| M00027400D:H02 | ES 157 |
| M00027433B:D12 | ES 157 |
| M00027457B:E11 | ES 157 |
| M00027459C:B10 | ES 157 |
| M00027467A:C07 | ES 157 |
| M00027475D:A01 | ES 157 |
| M00027480C:E09 | ES 157 |
| M00027485C:F07 | ES 157 |
| M00027506B:G01 | ES 157 |
| M00027513D:F06 | ES 157 |
| M00027523A:H05 | ES 157 |
| M00027527B:C05 | ES 157 |
| M00027549C:G03 | ES 157 |
| M00027569A:E05 | ES 157 |
| M00027586A:C09 | ES 157 |
| M00027589B:G07 | ES 157 |
| M00027591A:E04 | ES 157 |
| M00027600B:C07 | ES 157 |
| M00027605B:D09 | ES 157 |
| M00027688C:C01 | ES 157 |
| M00027717C:C06 | ES 157 |
| M00027724D:D04 | ES 157 |
| M00027734D:C03 | ES 157 |
| M00027746A:D06 | ES 157 |
| M00027801B:D07 | ES 157 |
| M00027806C:H05 | ES 157 |
| M00028055B:G07 | ES 158 |
| M00028063C:H01 | ES 158 |
| M00028067A:C11 | ES 158 |
| M00028069D:H02 | ES 158 |
| M00028070A:H09 | ES 158 |
| M00028070D:C03 | ES 158 |
| M00028188C:H11 | ES 158 |
| M00028193B:E07 | ES 158 |
| M00028196A:G03 | ES 158 |
| M00028210B:H03 | ES 158 |
| M00028211A:F10 | ES 158 |
| M00028212D:C05 | ES 158 |
| M00028219B:H05 | ES 158 |
| M00028361B:H08 | ES 158 |
| M00028366B:B08 | ES 158 |
| M00028616C:D09 | ES 158 |
| M00028620C:C07 | ES 158 |
| M00028763A:G11 | ES 158 |
| M00028764B:D03 | ES 158 |
| M00028771A:E02 | ES 158 |
| M00028773C:C05 | ES 158 |
| M00028774D:E10 | ES 158 |
| M00028777B:G04 | ES 158 |
| M00028782A:F01 | ES 158 |
| M00028784A:D12 | ES 158 |
| M00028786B:A04 | ES 158 |
| M00031370B:C01 | ES 158 |
| M00031416D:H05 | ES 158 |
| M00031484A:D03 | ES 158 |
| M00031485B:G05 | ES 158 |
| M00032471D:A05 | ES 158 |
| M00032473B:A03 | ES 158 |
| M00032474A:G03 | ES 158 |
| M00032475A:A06 | ES 158 |
| M00032489B:G12 | ES 158 |
| M00032490D:E08 | ES 158 |
| M00032494C:H08 | ES 158 |
| M00032497D:B10 | ES 158 |
| M00032504B:B10 | ES 158 |
| M00032507D:G08 | ES 158 |
| M00032508A:E03 | ES 158 |
| M00032515A:B12 | ES 158 |
| M00032517C:E10 | ES 158 |
| M00032519D:F08 | ES 158 |
| M00032534B:E12 | ES 158 |
| M00032541C:G03 | ES 158 |
| M00032553A:A07 | ES 158 |
| M00032556D:A03 | ES 158 |
| M00032562C:F01 | ES 158 |
| M00032567B:G05 | ES 158 |
| M00032568B:F08 | ES 158 |
| M00032577D:F01 | ES 158 |
| M00032580D:A09 | ES 158 |
| M00032581B:A09 | ES 158 |
| M00032584A:D06 | ES 158 |
| M00032586C:B04 | ES 158 |
| M00032590B:H01 | ES 158 |
| M00032594C:F05 | ES 158 |
| M00032597A:H02 | ES 158 |
| M00032605B:D09 | ES 158 |
| M00032613A:E11 | ES 158 |
| M00032614C:B10 | ES 158 |
| M00032614D:D08 | ES 158 |
| M00032620B:F06 | ES 158 |
| M00032621A:F11 | ES 158 |
| M00032628C:B06 | ES 158 |
| M00032634B:D09 | ES 158 |
| M00032637A:F09 | ES 158 |
| M00032638B:F02 | ES 158 |
| M00032644C:B05 | ES 158 |
| M00032645D:C01 | ES 158 |
| M00032647B:F06 | ES 158 |
| M00032652C:C07 | ES 158 |
| M00032666A:C02 | ES 158 |
| M00032671B:D06 | ES 158 |
| M00032671B:D08 | ES 158 |
| M00032676C:C10 | ES 158 |
| M00032688C:A03 | ES 158 |
| M00032700A:E09 | ES 158 |
| M00032707D:F08 | ES 158 |
| M00032711B:F01 | ES 158 |
| M00032723D:H02 | ES 158 |
| M00032727A:E04 | ES 158 |

TABLE 105-continued

| Clone Name | Tube |
|---|---|
| M00032728D:F01 | ES 158 |
| M00032729A:F10 | ES 158 |
| M00032733B:F12 | ES 158 |
| M00032734B:E12 | ES 158 |
| M00032734C:C05 | ES 158 |
| M00032749D:G03 | ES 158 |
| M00032753A:C07 | ES 158 |
| M00032759A:A03 | ES 158 |
| M00032765A:C05 | ES 158 |
| M00032770C:G11 | ES 158 |
| M00032772D:D03 | ES 158 |
| M00032773D:F08 | ES 158 |
| M00032774C:C04 | ES 158 |
| M00032787D:C05 | ES 159 |
| M00032791B:H11 | ES 159 |
| M00032791D:F01 | ES 159 |
| M00032792C:B01 | ES 159 |
| M00032793A:G06 | ES 159 |
| M00032795C:A03 | ES 159 |
| M00032797D:D08 | ES 159 |
| M00032825B:F08 | ES 159 |
| M00032826C:D10 | ES 159 |
| M00032828A:A06 | ES 159 |
| M00032829D:A05 | ES 159 |
| M00032830D:D02 | ES 159 |
| M00032831A:C07 | ES 159 |
| M00032831A:E09 | ES 159 |
| M00032835D:G04 | ES 159 |
| M00032836B:A07 | ES 159 |
| M00032848D:B10 | ES 159 |
| M00032892C:C12 | ES 159 |
| M00032908A:D08 | ES 159 |
| M00032918D:B04 | ES 159 |
| M00032928C:D02 | ES 159 |
| M00032944A:B07 | ES 159 |
| M00032945D:B07 | ES 159 |
| M00032979D:C11 | ES 159 |
| M00032979D:H07 | ES 159 |
| M00032985D:G09 | ES 159 |
| M00032987B:F01 | ES 159 |
| M00032988B:G01 | ES 159 |
| M00033006A:F10 | ES 159 |
| M00033028C:A02 | ES 159 |
| M00033028D:C10 | ES 159 |
| M00033037B:F04 | ES 159 |
| M00033041A:B11 | ES 159 |
| M00033055D:D02 | ES 159 |
| M00033071C:G05 | ES 159 |
| M00033071D:E08 | ES 159 |
| M00033072A:A09 | ES 159 |
| M00033080C:A07 | ES 159 |
| M00033081D:D11 | ES 159 |
| M00033144A:D02 | ES 159 |
| M00033146D:A03 | ES 159 |
| M00033147C:B08 | ES 159 |
| M00033149B:E10 | ES 159 |
| M00033150B:E02 | ES 159 |
| M00033150C:A11 | ES 159 |
| M00033183B:F10 | ES 159 |
| M00033218C:F07 | ES 159 |
| M00033223C:G04 | ES 159 |
| M00033230C:G10 | ES 159 |
| M00033232B:C08 | ES 159 |
| M00033246A:H12 | ES 159 |
| M00033248D:H11 | ES 159 |
| M00033264B:E06 | ES 159 |
| M00033274D:F03 | ES 159 |
| M00033311B:G10 | ES 159 |
| M00033324B:F04 | ES 159 |
| M00033326B:B05 | ES 159 |
| M00033329C:C02 | ES 159 |
| M00033296C:C11 | ES 159 |
| M00033302A:E11 | ES 159 |
| M00033302B:F10 | ES 159 |
| M00033303C:F09 | ES 159 |
| M00033342B:F03 | ES 159 |
| M00033344A:B06 | ES 159 |
| M00033359C:H05 | ES 159 |
| M00033360C:A03 | ES 159 |
| M00033374D:C07 | ES 159 |
| M00033413A:A08 | ES 159 |
| M00033420B:E08 | ES 159 |
| M00033434D:F05 | ES 159 |
| M00033441A:B12 | ES 159 |
| M00033445D:G03 | ES 159 |
| M00038290A:D12 | ES 159 |
| M00038304B:E02 | ES 159 |
| M00038389D:D10 | ES 159 |
| M00038390B:F02 | ES 159 |
| M00038616C:C09 | ES 159 |
| M00038616D:B07 | ES 159 |
| M00038618D:D08 | ES 159 |
| M00038619B:F09 | ES 159 |
| M00038619D:C12 | ES 159 |
| M00039001A:B10 | ES 159 |
| M00039024D:E12 | ES 159 |
| M00039055C:A01 | ES 159 |
| M00039056B:G01 | ES 159 |
| M00039063C:H09 | ES 159 |
| M00039067A:C05 | ES 159 |
| M00039067B:F07 | ES 159 |
| M00039076D:G04 | ES 159 |
| M00039078B:B03 | ES 159 |
| M00039078D:C10 | ES 159 |
| M00039081B:C04 | ES 159 |
| M00039081B:G07 | ES 159 |
| M00039100A:G04 | ES 159 |
| M00039105D:A08 | ES 159 |
| M00039107A:E12 | ES 159 |
| M00039111A:C12 | ES 160 |
| M00039121D:E07 | ES 160 |
| M00039124D:H01 | ES 160 |
| M00039125D:H12 | ES 160 |
| M00039131C:B09 | ES 160 |
| M00039133B:D06 | ES 160 |
| M00039133C:F12 | ES 160 |
| M00039134D:F08 | ES 160 |
| M00039138B:G05 | ES 160 |
| M00039140A:F05 | ES 160 |
| M00039143A:F04 | ES 160 |
| M00039143D:C10 | ES 160 |
| M00039146B:G04 | ES 160 |
| M00039162D:C04 | ES 160 |
| M00039165D:C04 | ES 160 |
| M00039175A:F01 | ES 160 |
| M00039204A:E09 | ES 160 |
| M00039207A:F07 | ES 160 |
| M00039219B:C08 | ES 160 |
| M00039222B:A04 | ES 160 |
| M00039225A:D11 | ES 160 |
| M00039246B:A08 | ES 160 |
| M00039248C:A08 | ES 160 |
| M00039251C:H12 | ES 160 |
| M00039251D:B08 | ES 160 |
| M00039255D:B01 | ES 160 |
| M00039258C:C01 | ES 160 |
| M00039270D:D02 | ES 160 |
| M00039275B:E02 | ES 160 |
| M00039278C:D03 | ES 160 |
| M00039284D:H07 | ES 160 |
| M00039285B:G04 | ES 160 |
| M00039291D:F02 | ES 160 |
| M00039294C:B09 | ES 160 |
| M00039302B:E10 | ES 160 |
| M00039326A:G07 | ES 160 |
| M00039326C:B08 | ES 160 |
| M00039331B:F09 | ES 160 |
| M00039338B:F07 | ES 160 |
| M00039344C:A11 | ES 160 |
| M00039349D:B11 | ES 160 |
| M00039381C:C07 | ES 160 |
| M00039383A:H07 | ES 160 |
| M00039411D:D09 | ES 160 |
| M00039413C:E06 | ES 160 |
| M00039430A:E04 | ES 160 |
| M00039433B:D06 | ES 160 |

TABLE 105-continued

| Clone Name | Tube |
|---|---|
| M00039433C:E03 | ES 160 |
| M00039438B:D08 | ES 160 |
| M00039440C:G06 | ES 160 |
| M00039457D:C02 | ES 160 |
| M00039471D:G10 | ES 160 |
| M00039472B:E05 | ES 160 |
| M00039478C:B02 | ES 160 |
| M00039554D:B09 | ES 160 |
| M00039556C:G05 | ES 160 |
| M00039559B:C07 | ES 160 |
| M00039560B:G09 | ES 160 |
| M00039560C:G06 | ES 160 |
| M00039617C:A10 | ES 160 |
| M00039654C:C11 | ES 160 |
| M00039668C:F01 | ES 160 |
| M00039672C:D05 | ES 160 |
| M00039686C:C01 | ES 160 |
| M00039694C:H01 | ES 160 |
| M00039698C:B03 | ES 160 |
| M00039710B:A01 | ES 160 |
| M00039710B:E01 | ES 160 |
| M00039785C:H12 | ES 160 |
| M00039786D:A10 | ES 160 |
| M00039805B:B06 | ES 160 |
| M00039806B:D05 | ES 160 |
| M00039820B:F06 | ES 160 |
| M00039822A:H02 | ES 160 |
| M00039826B:F09 | ES 160 |
| M00039826D:E04 | ES 160 |
| M00039828B:H06 | ES 160 |
| M00039829B:E01 | ES 160 |
| M00039860B:E01 | ES 160 |
| M00039860D:B02 | ES 160 |
| M00039861C:B12 | ES 160 |
| M00039865A:C09 | ES 160 |
| M00039869A:H01 | ES 160 |
| M00039871C:G05 | ES 160 |
| M00039873B:H04 | ES 160 |
| M00039874A:B06 | ES 160 |
| M00039885C:D11 | ES 160 |
| M00039894C:D09 | ES 160 |
| M00039895D:C04 | ES 160 |
| M00039900B:G04 | ES 160 |
| M00039915B:E08 | ES 160 |
| M00039921A:B10 | ES 160 |
| M00004824A:D12 | ES 160 |
| M00004824D:H05 | ES 160 |
| M00004831C:G11 | ES 160 |
| M00004832D:G04 | ES 160 |
| M00004836B:C02 | ES 161 |
| M00004839B:C12 | ES 161 |
| M00004843A:G12 | ES 161 |
| M00004846A:A10 | ES 161 |
| M00004850A:B02 | ES 161 |
| M00004852D:C06 | ES 161 |
| M00004856D:F09 | ES 161 |
| M00004873B:G04 | ES 161 |
| M00004876B:A06 | ES 161 |
| M00005002A:C03 | ES 161 |
| M00005003D:C02 | ES 161 |
| M00005013D:H05 | ES 161 |
| M00005014B:F02 | ES 161 |
| M00005016C:E04 | ES 161 |
| M00005309B:A11 | ES 161 |
| M00005314A:G10 | ES 161 |
| M00005332A:C06 | ES 161 |
| M00005333D:D08 | ES 161 |
| M00005346D:A03 | ES 161 |
| M00005349C:C02 | ES 161 |
| M00005359B:B08 | ES 161 |
| M00005359B:D09 | ES 161 |
| M00005364B:E10 | ES 161 |
| M00005365A:F05 | ES 161 |
| M00005366D:F08 | ES 161 |
| M00005367D:A11 | ES 161 |
| M00005375D:A10 | ES 161 |
| M00005379A:D10 | ES 161 |
| M00005380B:H10 | ES 161 |
| M00005383A:C11 | ES 161 |
| M00005385A:B12 | ES 161 |
| M00005385D:F07 | ES 161 |
| M00005387A:B03 | ES 161 |
| M00005392A:G06 | ES 161 |
| M00005401D:F09 | ES 161 |
| M00005403C:A01 | ES 161 |
| M00005405C:D01 | ES 161 |
| M00005409D:B02 | ES 161 |
| M00005413D:A05 | ES 161 |
| M00005422B:B08 | ES 161 |
| M00005422D:H02 | ES 161 |
| M00005422D:H10 | ES 161 |
| M00005423A:C11 | ES 161 |
| M00005423C:A10 | ES 161 |
| M00005423C:D07 | ES 161 |
| M00005434A:C03 | ES 161 |
| M00005442A:B10 | ES 161 |
| M00005445A:E07 | ES 161 |
| M00005445D:D04 | ES 161 |
| M00005445D:F11 | ES 161 |
| M00005452B:G03 | ES 161 |
| M00005452D:E05 | ES 161 |
| M00005460D:C11 | ES 161 |
| M00005461A:D12 | ES 161 |
| M00005463A:G02 | ES 161 |
| M00005466C:B01 | ES 161 |
| M00005468A:C04 | ES 161 |
| M00005468D:C01 | ES 161 |
| M00005474C:H09 | ES 161 |
| M00005485C:H04 | ES 161 |
| M00005489B:C08 | ES 161 |
| M00005500A:D04 | ES 161 |
| M00005504C:F12 | ES 161 |
| M00005504D:F06 | ES 161 |
| M00005505A:F01 | ES 161 |
| M00005505B:E01 | ES 161 |
| M00005506C:E09 | ES 161 |
| M00005506D:E11 | ES 161 |
| M00005507B:A03 | ES 161 |
| M00005511A:F05 | ES 161 |
| M00005512B:H01 | ES 161 |
| M00005515D:F02 | ES 161 |
| M00005520B:E01 | ES 161 |
| M00005520B:H05 | ES 161 |
| M00005524C:H04 | ES 161 |
| M00005535B:B01 | ES 161 |
| M00005540A:F09 | ES 161 |
| M00005557D:H10 | ES 161 |
| M00005569D:G09 | ES 161 |
| M00005570A:B08 | ES 161 |
| M00005570A:D05 | ES 161 |
| M00005603B:H03 | ES 161 |
| M00005606D:B12 | ES 161 |
| M00005607B:C04 | ES 161 |
| M00005616B:F07 | ES 161 |
| M00005622A:H02 | ES 161 |
| M00005623B:G01 | ES 161 |
| M00005626D:G11 | ES 161 |
| M00005634A:F07 | ES 161 |
| M00005641B:E09 | ES 161 |
| M00005643D:A05 | ES 161 |
| M00005674C:F04 | ES 161 |
| M00005675D:D09 | ES 161 |
| M00005689C:B02 | ES 161 |
| M00005703B:E03 | ES 161 |
| M00005703D:G10 | ES 161 |
| M00005710B:H03 | ES 162 |
| M00005743D:A12 | ES 162 |
| M00005763D:A01 | ES 162 |
| M00005766D:D12 | ES 162 |
| M00005771D:C02 | ES 162 |
| M00005819D:F09 | ES 162 |
| M00005822C:A04 | ES 162 |
| M00006576D:C02 | ES 162 |
| M00006577A:H10 | ES 162 |
| M00006582D:A09 | ES 162 |
| M00006585A:D07 | ES 162 |

TABLE 105-continued

| Clone Name | Tube |
|---|---|
| M00006585A:F09 | ES 162 |
| M00006586D:D04 | ES 162 |
| M00006592A:A12 | ES 162 |
| M00006595B:C10 | ES 162 |
| M00006601D:G05 | ES 162 |
| M00006631C:A04 | ES 162 |
| M00006631D:D02 | ES 162 |
| M00006636B:E04 | ES 162 |
| M00006641B:F05 | ES 162 |
| M00006646A:A07 | ES 162 |
| M00006678A:A03 | ES 162 |
| M00006678C:C02 | ES 162 |
| M00006712C:H01 | ES 162 |
| M00006714C:D06 | ES 162 |
| M00006738A:F12 | ES 162 |
| M00006739B:A04 | ES 162 |
| M00006740B:A09 | ES 162 |
| M00006743A:D04 | ES 162 |
| M00006743A:H11 | ES 162 |
| M00006756B:G06 | ES 162 |
| M00006756C:A02 | ES 162 |
| M00006861D:H10 | ES 162 |
| M00006872D:B07 | ES 162 |
| M00006877B:C09 | ES 162 |
| M00006877C:F11 | ES 162 |
| M00006884D:A08 | ES 162 |
| M00006885A:F07 | ES 162 |
| M00006890C:F10 | ES 162 |
| M00006904D:A02 | ES 162 |
| M00006907A:C09 | ES 162 |
| M00006907B:C06 | ES 162 |
| M00006989B:G05 | ES 162 |
| M00006994C:F06 | ES 162 |
| M00007002C:A10 | ES 162 |
| M00007006C:C12 | ES 162 |
| M00007007A:E04 | ES 162 |
| M00007031A:E02 | ES 162 |
| M00007032A:B05 | ES 162 |
| M00007032C:A12 | ES 162 |
| M00007046D:C09 | ES 162 |
| M00007048B:E11 | ES 162 |
| M00007048C:A12 | ES 162 |
| M00007059B:D07 | ES 162 |
| M00007060D:G07 | ES 162 |
| M00007064D:D12 | ES 162 |
| M00007070C:C01 | ES 162 |
| M00007081B:C08 | ES 162 |
| M00007081B:E09 | ES 162 |
| M00007082D:E05 | ES 162 |
| M00007098A:E10 | ES 162 |
| M00007103C:C12 | ES 162 |
| M00007103D:C02 | ES 162 |
| M00007112D:D03 | ES 162 |
| M00007117A:C11 | ES 162 |
| M00007126A:A02 | ES 162 |
| M00007141C:B05 | ES 162 |
| M00007154A:E06 | ES 162 |
| M00007155C:D07 | ES 162 |
| M00007155D:C09 | ES 162 |
| M00007158D:D03 | ES 162 |
| M00007178A:C02 | ES 162 |
| M00007195C:E11 | ES 162 |
| M00007197B:B05 | ES 162 |
| M00007202B:F01 | ES 162 |
| M00007947A:B06 | ES 162 |
| M00007953D:F07 | ES 162 |
| M00007969D:C01 | ES 162 |
| M00007973B:D11 | ES 162 |
| M00007975C:A10 | ES 162 |
| M00007975D:F12 | ES 162 |
| M00007980A:B01 | ES 162 |
| M00007980B:A07 | ES 162 |
| M00007981C:F07 | ES 162 |
| M00007985C:D08 | ES 162 |
| M00008001B:F05 | ES 162 |
| M00008007B:E03 | ES 162 |
| M00008016B:E09 | ES 162 |
| M00008019B:A01 | ES 162 |
| M00008020D:D05 | ES 162 |
| M00008020D:F02 | ES 162 |
| M00008021C:G12 | ES 162 |
| M00008045C:A05 | ES 162 |
| M00008055D:G03 | ES 162 |
| M00008059B:F08 | ES 162 |
| M00008059D:B08 | ES 162 |
| M00008065D:A07 | ES 163 |
| M00008071D:H03 | ES 163 |
| M00008073A:D01 | ES 163 |
| M00008073D:D01 | ES 163 |
| M00021649B:A02 | ES 163 |
| M00021650D:A11 | ES 163 |
| M00021653A:B02 | ES 163 |
| M00021668D:A03 | ES 163 |
| M00021676C:G03 | ES 163 |
| M00021677A:D09 | ES 163 |
| M00021678A:H03 | ES 163 |
| M00021678D:H04 | ES 163 |
| M00021681C:C09 | ES 163 |
| M00021690A:C03 | ES 163 |
| M00021697C:B07 | ES 163 |
| M00021700D:H03 | ES 163 |
| M00021852C:H02 | ES 163 |
| M00021855D:F10 | ES 163 |
| M00021866C:H08 | ES 163 |
| M00021896D:A05 | ES 163 |
| M00021923A:B12 | ES 163 |
| M00021923D:H02 | ES 163 |
| M00021933B:F02 | ES 163 |
| M00021941A:D09 | ES 163 |
| M00021952B:G06 | ES 163 |
| M00021958B:E08 | ES 163 |
| M00021967D:H06 | ES 163 |
| M00021971C:B11 | ES 163 |
| M00021974D:F01 | ES 163 |
| M00021981A:C02 | ES 163 |
| M00021991D:F09 | ES 163 |
| M00021998B:D09 | ES 163 |
| M00022009C:A08 | ES 163 |
| M00022016B:F01 | ES 163 |
| M00022032A:G05 | ES 163 |
| M00022051B:D07 | ES 163 |
| M00022069D:C12 | ES 163 |
| M00022070B:B04 | ES 163 |
| M00022073C:C07 | ES 163 |
| M00022081A:B07 | ES 163 |
| M00022088B:F10 | ES 163 |
| M00022088B:H02 | ES 163 |
| M00022088D:E10 | ES 163 |
| M00022090B:A10 | ES 163 |
| M00022092D:A11 | ES 163 |
| M00022094B:G02 | ES 163 |
| M00022096D:A03 | ES 163 |
| M00022103C:D05 | ES 163 |
| M00022104A:G08 | ES 163 |
| M00022117C:A02 | ES 163 |
| M00022118A:E06 | ES 163 |
| M00022140D:A07 | ES 163 |
| M00022144C:E12 | ES 163 |
| M00022158B:B09 | ES 163 |
| M00022170C:C01 | ES 163 |
| M00022171A:F03 | ES 163 |
| M00022185A:B03 | ES 163 |
| M00022193B:A09 | ES 163 |
| M00022193C:C09 | ES 163 |
| M00022200B:B05 | ES 163 |
| M00022202C:C04 | ES 163 |
| M00022208B:D03 | ES 163 |
| M00022208C:E04 | ES 163 |
| M00022208C:F08 | ES 163 |
| M00022212D:G02 | ES 163 |
| M00022216D:D10 | ES 163 |
| M00022218B:B12 | ES 163 |
| M00022220A:A07 | ES 163 |
| M00022224A:C07 | ES 163 |
| M00022224A:G07 | ES 163 |
| M00022228B:B11 | ES 163 |

TABLE 105-continued

| Clone Name | Tube |
|---|---|
| M00022229D:E01 | ES 163 |
| M00022237C:E04 | ES 163 |
| M00022237D:D06 | ES 163 |
| M00022238C:G04 | ES 163 |
| M00022240B:C12 | ES 163 |
| M00022240D:B11 | ES 163 |
| M00022249D:C01 | ES 163 |
| M00022250A:B04 | ES 163 |
| M00022262A:F06 | ES 163 |
| M00022262B:B06 | ES 163 |
| M00022264A:B02 | ES 163 |
| M00022265A:F11 | ES 163 |
| M00022269C:A04 | ES 163 |
| M00022273A:E03 | ES 163 |
| M00022282B:C09 | ES 163 |
| M00022305A:B04 | ES 163 |
| M00022363C:D05 | ES 163 |
| M00022367D:G11 | ES 163 |
| M00022368A:B11 | ES 163 |
| M00022372D:H12 | ES 163 |
| M00022374C:E11 | ES 163 |
| M00022376D:D05 | ES 163 |
| M00022383C:A12 | ES 163 |
| M00022386D:F10 | ES 163 |
| M00022392B:F01 | ES 163 |
| M00022403C:E12 | ES 164 |
| M00022415C:D12 | ES 164 |
| M00022416D:D01 | ES 164 |
| M00022421A:F12 | ES 164 |
| M00022425A:C09 | ES 164 |
| M00022430C:C06 | ES 164 |
| M00022435B:G12 | ES 164 |
| M00022436C:F11 | ES 164 |
| M00022438C:H09 | ES 164 |
| M00022442B:G03 | ES 164 |
| M00022446C:H06 | ES 164 |
| M00022449D:F08 | ES 164 |
| M00022452B:E06 | ES 164 |
| M00022454C:B08 | ES 164 |
| M00022457A:G05 | ES 164 |
| M00022467D:B03 | ES 164 |
| M00022470D:B02 | ES 164 |
| M00022472D:B01 | ES 164 |
| M00022474B:C08 | ES 164 |
| M00022475D:C07 | ES 164 |
| M00022481B:A04 | ES 164 |
| M00022485B:E07 | ES 164 |
| M00022487B:A08 | ES 164 |
| M00022487C:C02 | ES 164 |
| M00022491A:A08 | ES 164 |
| M00022491D:A10 | ES 164 |
| M00022494B:D06 | ES 164 |
| M00022494D:A05 | ES 164 |
| M00022499D:D08 | ES 164 |
| M00022507C:C08 | ES 164 |
| M00022509A:H02 | ES 164 |
| M00022509B:D11 | ES 164 |
| M00022512B:A09 | ES 164 |
| M00022516B:C05 | ES 164 |
| M00022525B:D09 | ES 164 |
| M00022530B:C04 | ES 164 |
| M00022537B:C06 | ES 164 |
| M00022546B:E05 | ES 164 |
| M00022559D:G10 | ES 164 |
| M00022563B:C08 | ES 164 |
| M00022590B:E05 | ES 164 |
| M00022600D:B05 | ES 164 |
| M00022601B:G06 | ES 164 |
| M00022618B:D09 | ES 164 |
| M00022618C:E04 | ES 164 |
| M00022627B:H03 | ES 164 |
| M00022634A:C07 | ES 164 |
| M00022634B:H09 | ES 164 |
| M00022638A:D03 | ES 164 |
| M00022642A:G08 | ES 164 |
| M00022648A:D08 | ES 164 |
| M00022656D:D07 | ES 164 |
| M00022662C:H04 | ES 164 |
| M00022662D:H03 | ES 164 |
| M00022672C:H04 | ES 164 |
| M00022674C:H08 | ES 164 |
| M00022677C:C01 | ES 164 |
| M00022678B:C08 | ES 164 |
| M00022681D:E10 | ES 164 |
| M00022682D:A10 | ES 164 |
| M00022684A:E06 | ES 164 |
| M00022690A:A07 | ES 164 |
| M00022694A:F05 | ES 164 |
| M00022696B:C11 | ES 164 |
| M00039921C:H11 | ES 164 |
| M00039929B:E06 | ES 164 |
| M00039929D:H10 | ES 164 |
| M00039932B:A07 | ES 164 |
| M00039976C:F11 | ES 164 |
| M00039977B:D12 | ES 164 |
| M00039981D:B01 | ES 164 |
| M00040003A:G10 | ES 164 |
| M00040016C:E07 | ES 164 |
| M00040023B:B10 | ES 164 |
| M00040025A:B04 | ES 164 |
| M00040034A:E06 | ES 164 |
| M00040034B:G02 | ES 164 |
| M00040041A:G08 | ES 164 |
| M00040041D:F01 | ES 164 |
| M00040045B:H07 | ES 164 |
| M00040061C:C08 | ES 164 |
| M00040075B:A05 | ES 164 |
| M00040078A:C07 | ES 164 |
| M00040079B:F06 | ES 164 |
| M00040079D:D09 | ES 164 |
| M00040081C:E02 | ES 164 |
| M00040094B:C08 | ES 164 |
| M00040118D:C05 | ES 164 |
| M00040123C:A10 | ES 164 |
| M00040127C:D02 | ES 164 |
| M00022698C:D10 | ES 164 |
| M00022702D:E02 | ES 164 |
| M00022703B:D11 | ES 164 |
| M00022706D:G08 | ES 164 |
| M00022727A:G01 | ES 164 |
| M00022738D:G08 | ES 164 |
| M00022740C:H11 | ES 165 |
| M00022797D:A06 | ES 165 |
| M00022801D:D09 | ES 165 |
| M00022805B:A10 | ES 165 |
| M00022812A:G01 | ES 165 |
| M00022820A:F07 | ES 165 |
| M00022835C:A09 | ES 165 |
| M00022854C:G07 | ES 165 |
| M00022856D:A07 | ES 165 |
| M00022857B:A09 | ES 165 |
| M00022897B:F06 | ES 165 |
| M00022901A:C05 | ES 165 |
| M00022904C:D04 | ES 165 |
| M00022924B:A05 | ES 165 |
| M00022924C:F04 | ES 165 |
| M00022945A:H09 | ES 165 |
| M00022945B:F11 | ES 165 |
| M00022947B:D02 | ES 165 |
| M00022952A:B02 | ES 165 |
| M00022953B:D06 | ES 165 |
| M00022964A:B03 | ES 165 |
| M00022972C:E05 | ES 165 |
| M00022992A:H06 | ES 165 |
| M00022992B:G12 | ES 165 |
| M00022995C:G07 | ES 165 |
| M00023004C:A01 | ES 165 |
| M00023007D:D03 | ES 165 |
| M00023020C:H03 | ES 165 |
| M00023097D:B08 | ES 165 |
| M00039184D:H09 | ES 165 |
| M00039364D:E05 | ES 165 |
| M00039377B:E05 | ES 165 |
| M00039377B:H09 | ES 165 |
| M00039483A:D10 | ES 165 |
| M00039526A:A08 | ES 165 |

TABLE 105-continued

| Clone Name | Tube |
|---|---|
| M00039537A:F08 | ES 165 |
| M00039564D:D04 | ES 165 |
| M00039594C:B06 | ES 165 |
| M00039598A:E04 | ES 165 |
| M00039630D:B07 | ES 165 |
| M00039642A:A08 | ES 165 |
| M00039642C:F08 | ES 165 |
| M00039646A:E06 | ES 165 |
| M00039647A:A02 | ES 165 |
| M00039647B:A02 | ES 165 |
| M00039739B:H12 | ES 165 |
| M00040132A:H09 | ES 165 |
| M00040162A:E02 | ES 165 |
| M00040169A:G06 | ES 165 |
| M00040173D:A04 | ES 165 |
| M00040174D:G06 | ES 165 |
| M00040198A:F12 | ES 165 |
| M00040224C:F06 | ES 165 |
| M00040247D:D02 | ES 165 |
| M00040252C:G05 | ES 165 |
| M00040267D:A12 | ES 165 |
| M00040287A:C11 | ES 165 |
| M00040287C:F10 | ES 165 |
| M00040289D:C06 | ES 165 |
| M00039747B:B06 | ES 165 |
| M00039748C:G09 | ES 165 |
| M00040201A:H01 | ES 165 |
| M00040219B:B07 | ES 165 |
| M00040291A:G10 | ES 165 |
| M00040298B:B09 | ES 165 |
| M00040314B:D07 | ES 165 |
| M00040326B:G09 | ES 165 |
| M00040329A:H05 | ES 165 |
| M00040338A:B10 | ES 165 |
| M00040344C:D05 | ES 165 |
| M00040349D:D07 | ES 165 |
| M00040351A:C08 | ES 165 |
| M00040351D:G07 | ES 165 |
| M00040366B:H10 | ES 165 |
| M00040367A:C08 | ES 165 |
| M00040381B:B06 | ES 165 |
| M00040384B:E04 | ES 165 |
| M00040391A:G05 | ES 165 |
| M00042525B:H01 | ES 165 |
| M00042528C:H01 | ES 165 |
| M00042554A:D01 | ES 165 |
| M00042557D:B06 | ES 165 |
| M00042560C:G06 | ES 165 |
| M00042579A:D09 | ES 165 |
| M00042719A:G08 | ES 165 |
| M00042722C:C09 | ES 165 |
| M00042724A:G06 | ES 165 |
| M00042732B:H06 | ES 165 |
| M00042734A:F05 | ES 165 |
| M00042742B:E04 | ES 165 |
| M00042743D:G10 | ES 165 |
| M00042891C:G08 | ES 165 |
| M00042894C:A11 | ES 165 |
| M00042908A:F09 | ES 165 |
| M00042915B:G11 | ES 165 |
| M00054793B:A06 | ES 165 |
| M00054911D:E06 | ES 166 |
| M00055430A:A01 | ES 166 |
| M00055433D:G03 | ES 166 |
| M00055448B:E05 | ES 166 |
| M00055454A:D02 | ES 166 |
| M00055456C:H06 | ES 166 |
| M00055466A:F06 | ES 166 |
| M00055468A:A08 | ES 166 |
| M00055527B:E01 | ES 166 |
| M00055639A:E06 | ES 166 |
| M00055653C:B07 | ES 166 |
| M00055676A:G02 | ES 166 |
| M00055724B:E04 | ES 166 |
| M00055724A:C07 | ES 166 |
| M00055725D:D09 | ES 166 |
| M00055735A:H08 | ES 166 |
| M00055745B:A08 | ES 166 |
| M00055757A:B01 | ES 166 |
| M00055794A:E10 | ES 166 |
| M00055805A:H02 | ES 166 |
| M00055809A:B09 | ES 166 |
| M00055810C:D03 | ES 166 |
| M00055818B:D01 | ES 166 |
| M00055873D:C02 | ES 166 |
| M00055880B:H10 | ES 166 |
| M00055919B:C10 | ES 166 |
| M00055925D:B07 | ES 166 |
| M00055961C:B10 | ES 166 |
| M00055975B:F09 | ES 166 |
| M00055980C:B04 | ES 166 |
| M00056004B:C05 | ES 166 |
| M00056024B:F09 | ES 166 |
| M00056035D:A08 | ES 166 |
| M00056057C:F06 | ES 166 |
| M00056105A:D06 | ES 166 |
| M00056133A:E11 | ES 166 |
| M00056215D:F02 | ES 166 |
| M00056217D:E10 | ES 166 |
| M00056220D:G02 | ES 166 |
| M00056230D:E07 | ES 166 |
| M00056244A:B06 | ES 166 |
| M00056244C:H05 | ES 166 |
| M00056304A:H05 | ES 166 |
| M00056320B:A03 | ES 166 |
| M00056342A:C03 | ES 166 |
| M00056345D:A04 | ES 166 |
| M00056436C:F01 | ES 166 |
| M00056458C:E01 | ES 166 |
| M00042350A:A05 | ES 166 |
| M00042433A:E11 | ES 166 |
| M00042462B:C02 | ES 166 |
| M00042512D:D10 | ES 166 |
| M00042766C:D05 | ES 166 |
| M00042788A:F04 | ES 166 |
| M00042794A:F01 | ES 166 |
| M00042796A:A10 | ES 166 |
| M00042801C:D01 | ES 166 |
| M00042822A:H04 | ES 166 |
| M00042857C:E01 | ES 166 |
| M00042858C:G11 | ES 166 |
| M00042860B:C07 | ES 166 |
| M00042863D:F09 | ES 166 |
| M00042878D:F05 | ES 166 |
| M00042878D:G06 | ES 166 |
| M00042352B:A04 | ES 166 |
| M00042352D:B03 | ES 166 |
| M00042449B:F05 | ES 166 |
| M00042457C:B06 | ES 166 |
| M00042516B:D01 | ES 166 |
| M00042520B:H04 | ES 166 |
| M00043299A:B10 | ES 166 |
| M00043306D:C01 | ES 166 |
| M00043313D:E09 | ES 166 |
| M00043328C:E04 | ES 166 |
| M00043336D:B03 | ES 166 |
| M00043339C:F11 | ES 166 |
| M00043355A:D07 | ES 166 |
| M00043358C:A02 | ES 166 |
| M00043402B:G07 | ES 166 |
| M00054499A:C08 | ES 166 |
| M00054528B:E05 | ES 166 |
| M00054536B:B01 | ES 166 |
| M00054538D:C12 | ES 166 |
| M00054542B:A10 | ES 166 |
| M00054548C:H06 | ES 166 |
| M00054569A:B07 | ES 166 |
| M00054579A:C02 | ES 166 |
| M00054599D:B03 | ES 166 |
| M00054623C:F05 | ES 166 |
| M00054643D:F07 | ES 166 |
| M00054675D:G03 | ES 166 |
| M00054682B:H02 | ES 166 |
| M00054683D:G11 | ES 166 |
| M00054686A:A09 | ES 166 |
| M00054686A:F10 | ES 166 |

TABLE 105-continued

| Clone Name | Tube |
|---|---|
| M00054693A:E11 | ES 166 |
| M00054708C:B06 | ES 167 |
| M00054714B:G10 | ES 167 |
| M00054725C:D09 | ES 167 |
| M00054744C:F12 | ES 167 |
| M00054781B:H04 | ES 167 |
| M00054781D:A11 | ES 167 |
| M00054786C:D08 | ES 167 |
| M00054807D:C11 | ES 167 |
| M00054817D:A11 | ES 167 |
| M00054818B:F10 | ES 167 |
| M00054843A:C01 | ES 167 |
| M00054856C:D03 | ES 167 |
| M00054866B:C08 | ES 167 |
| M00054890C:D05 | ES 167 |
| M00054908C:A01 | ES 167 |
| M00054931D:E10 | ES 167 |
| M00054973B:E12 | ES 167 |
| M00054978C:F01 | ES 167 |
| M00055001C:G10 | ES 167 |
| M00055002B:E08 | ES 167 |
| M00055004C:H05 | ES 167 |
| M00055023A:E11 | ES 167 |
| M00055043B:H08 | ES 167 |
| M00055055C:F01 | ES 167 |
| M00055081A:A05 | ES 167 |
| M00055093B:A03 | ES 167 |
| M00055108B:A02 | ES 167 |
| M00055117A:E02 | ES 167 |
| M00055166C:D10 | ES 167 |
| M00055221C:H11 | ES 167 |
| M00055232A:E08 | ES 167 |
| M00055239D:F11 | ES 167 |
| M00055240A:A08 | ES 167 |
| M00055244B:F07 | ES 167 |
| M00055254A:H03 | ES 167 |
| M00055337B:C04 | ES 167 |
| M00055375C:F12 | ES 167 |
| M00055387C:C12 | ES 167 |
| M00055391B:C07 | ES 167 |
| M00055395D:D11 | ES 167 |
| M00055402A:H01 | ES 167 |
| M00055420A:E06 | ES 167 |
| M00055423A:B08 | ES 167 |
| M00055423C:G12 | ES 167 |
| M00055423C:H10 | ES 167 |
| M00055424B:H06 | ES 167 |
| M00055424D:G05 | ES 167 |
| M00055425C:A04 | ES 167 |
| M00055473C:F02 | ES 167 |
| M00055477D:B01 | ES 167 |
| M00042585A:H11 | ES 167 |
| M00042585D:D03 | ES 167 |
| M00042585D:E10 | ES 167 |
| M00042586A:B01 | ES 167 |
| M00042588C:E02 | ES 167 |
| M00042621C:C04 | ES 167 |
| M00042951D:G12 | ES 167 |
| M00042960B:C06 | ES 167 |
| M00042967D:C01 | ES 167 |
| M00042970C:B01 | ES 167 |
| M00042972C:F04 | ES 167 |
| M00042976D:C01 | ES 167 |
| M00042982D:A10 | ES 167 |
| M00042986D:E03 | ES 167 |
| M00042996B:H08 | ES 167 |
| M00043013B:E03 | ES 167 |
| M00043015D:D05 | ES 167 |
| M00043016B:F09 | ES 167 |
| M00043017C:D08 | ES 167 |
| M00043063C:H05 | ES 167 |
| M00043070A:C03 | ES 167 |
| M00043113C:G09 | ES 167 |
| M00042617B:E01 | ES 167 |
| M00043074C:D07 | ES 167 |
| M00043076D:A02 | ES 167 |
| M00043077B:F11 | ES 167 |
| M00043077C:D12 | ES 167 |
| M00043077C:G10 | ES 167 |
| M00043099A:H04 | ES 167 |
| M00043101D:G11 | ES 167 |
| M00043134A:F05 | ES 167 |
| M00043152C:B10 | ES 167 |
| M00043213A:D05 | ES 167 |
| M00043219C:C02 | ES 167 |
| M00043221D:C12 | ES 167 |
| M00043222C:B06 | ES 167 |
| M00043455B:C08 | ES 167 |
| M00043465C:H11 | ES 167 |
| M00043470A:C10 | ES 167 |
| M00043485C:C03 | ES 167 |
| M00043490C:F02 | ES 167 |
| M00043495C:H05 | ES 167 |
| M00043528A:E11 | ES 167 |
| M00043529A:B08 | ES 167 |
| M00043640A:B01 | ES 167 |

Example 68

Source of Biological Materials and Overview of Novel Polynucleotides Expressed by the Biological Materials cDNA libraries were constructed from mRNA isolated from the cell lines indicated in Table 109. The specific library from which any polynucleotide was isolated is indicated in Table 106, with the number of the entry under the "LIBRARY" column correlating to the library number in Table 109. Polynucleotides expressed by the selected cell lines were isolated and analyzed; the sequences of these polynucleotides were about 275-300 nucleotides in length.

The sequences of the isolated polynucleotides were fist masked to eliminate low complexity sequences using the XBLAST masking program (Claverie "Effective Large-Scale Sequence Similarity Searches," In: *Computer Methods for Macromolecular Sequence Analysis*, Doolittle, ed., *Meth. Enzymol.* 266:212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem.* (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. The remaining sequences were then used in a BLASTN vs. GenBank search; sequences that exhibited greater than 70% overlap, 99% identity, and a p value of less than $1 \times 10^{-40}$ were discarded. Sequences from this search also were discarded if the inclusive parameters were met, but the sequence was ribosomal or vector-derived.

The resulting sequences from the previous search were classified into three groups (1, 2 and 3 below) and searched in a BLASTX vs. NRP (non-redundant proteins) database search: (1) unknown (no hits in the GenBank search), (2) weak similarity (greater than 45% identity and p value of less than $1 \times 10^{-5}$), and (3) high similarity (greater than 60% overlap, greater than 80% identity, and p value less than $1 \times 10^{-5}$). Sequences having greater than 70% overlap, greater than 99% identity, and p value of less than $1 \times 10^{-40}$ were discarded.

The remaining sequences were classified as unknown (no hits), weak similarity, and high similarity (parameters as above). Two searches were performed on these sequences.

First, a BLAST vs. EST database search was performed and sequences with greater than 99% overlap, greater than 99% similarity and a p value of less than $1\times10^{-40}$ were discarded. Sequences with a p value of less than $1\times10^{-65}$ when compared to a database sequence of human origin were also excluded. Second, a BLASTN vs. Patent GeneSeq database was performed and sequences having greater than 99% identity, p value less than $1\times10^{-40}$, and greater than 99% overlap were discarded.

The remaining sequences were subjected to screening using other rules and redundancies in the dataset. Sequences with a p value of less than $1\times10^{-111}$ in relation to a database sequence of human origin were specifically excluded. The final result provided the 2396 sequences listed as SEQ ID NOS:13271-15666 in the accompanying Sequence Listing and summarized in Table 106. Each identified polynucleotide represents sequence from at least a partial mRNA transcript.

Table 106 provides: 1) the SEQ ID NO assigned to each sequence for use in the present specification; 2) the cluster to which the sequence is assigned; 3) the sequence name used as an internal identifier of the sequence; 4) the orientation of the insert in the clone (F=forward; R=reverse); 5) the name assigned to the clone from which the sequence was isolated; and 6) the library from which the sequence was originally isolated. Because the provided polynucleotides represent partial mRNA transcripts, two or more polynucleotides of the invention may represent different regions of the same mRNA transcript and the same gene. Thus, if two or more SEQ ID NOS: are identified as belonging to the same clone, then either sequence can be used to obtain the full-length mRNA or gene.

Example 69

Results of Public Database Search to Identify Function of Gene Products

SEQ ID NOS:13271-15666 were translated in all three reading frames, and the nucleotide sequences and translated amino acid sequences used as query sequences to search for homologous sequences in either the GenBank (nucleotide sequences) or Non-Redundant Protein (amino acid sequences) databases. Query and individual sequences were aligned using the BLAST 2.0 programs (National Center for Biotechnology Information, Bethesda, Md.; see also Altschul, et al. *Nucleic Acids Res.* (1997) 25:3389-3402). The sequences were masked to various extents to prevent searching of repetitive sequences or poly-A sequences, using the XBLAST program for masking low complexity as described above in Example 68.

Tables 107A and 107B (inserted before the claims) provide the alignment summaries having a p value of $1\times10^{-2}$ or less indicating substantial homology between the sequences of the present invention and those of the indicated public databases. Table 107A provides the SEQ ID NO of the query sequence, the accession number of the GenBank database entry of the homologous sequence, and the p value of the alignment. Table 107B provides the SEQ ID NO of the query sequence, the accession number of the Non-Redundant Protein database entry of the homologous sequence, and the p value of the alignment. The alignments provided in Tables 107A and 107B are the best available alignment to a DNA or amino acid sequence at a time just prior to filing of the present specification. The activity of the polypeptide encoded by the SEQ ID NOS listed in Tables 107A and 107B can be extrapolated to be substantially the same or substantially similar to the activity of the reported nearest neighbor or closely related sequence. The accession number of the nearest neighbor is reported, providing a publicly available reference to the activities and functions exhibited by the nearest neighbor. The public information regarding the activities and functions of each of the nearest neighbor sequences is incorporated by reference in this application. Also incorporated by reference is all publicly available information regarding the sequence, as well as the putative and actual activities and functions of the nearest neighbor sequences listed in Table 107B and their related sequences. The search program and database used for the alignment, as well as the calculation of the p value are also indicated.

Full length sequences or fragments of the polynucleotide sequences of the nearest neighbors can be used as probes and primers to identify and isolate the full length sequence of the corresponding polynucleotide. The nearest neighbors can indicate a tissue or cell type to be used to construct a library for the full-length sequences of the corresponding polynucleotides.

Example 70

Members of Protein Families

SEQ ID NOS: 13271-15666 were used to conduct a profile search as described in the specification above. Several of the polynucleotides of the invention were found to encode polypeptides having characteristics of a polypeptide belonging to a known protein family (and thus represent members of these protein families) and/or comprising a known functional domain. Table provides the SEQ ID NO: of the query sequence, the profile name, and a brief description of the profile hit.

TABLE 108

| SEQ ID | Profilename | Description |
|---|---|---|
| 13680 | ATPases | ATPases Associated with Various Cellular Activities |
| 13807 | ATPases | ATPases Associated with Various Cellular Activities |
| 13809 | ATPases | ATPases Associated with Various Cellular Activities |
| 13810 | ATPases | ATPases Associated with Various Cellular Activities |
| 13932 | rrm | RNA recognition motif. (aka RRM, RBD or RNP domain) |
| 13953 | rrm | RNA recognition motif. (aka RRM, RBD, or RNP domain) |
| 13977 | dualspecphosphatase | Dual specificity phosphatase, catalytic domain |
| 13978 | rrm | RNA recognition motif. (aka RRM, RBD, or RNP domain) |
| 13989 | EFhand | EF-hand |
| 14008 | ATPases | ATPases Associated with Various Cellular Activities |
| 14049 | Zincfing_C2H2 | Zinc finger, C2H2 type |

TABLE 108-continued

| SEQ ID | Profilename | Description |
| --- | --- | --- |
| 14051 | rrm | RNA recognition motif. (aka RRM, RBD, or RNP domain) |
| 14053 | rrm | RNA recognition motif. (aka RRM, RBD, or RNP domain) |
| 14380 | WD_domain | WD domain, G-beta repeats |
| 14685 | Dead_box_helic | DEAD and DEAH box helicases |
| 14803 | C2 | C2 domain (prot. kinase C like) |
| 14903 | dualspecphosphatase | Dual specificity phosphatase, catalytic domain |
| 14907 | Dead_box_helic | DEAD and DEAH box helicases |
| 14908 | Dead_box_helic | DEAD and DEAH box helicases |
| 15014 | WD_domain | WD domain, G-beta repeats |
| 15029 | BZIP | Basic region plus leucine zipper transcription factors |
| 15263 | WD_domain | WD domain, G-beta repeats |
| 15353 | WD_domain | WD domain, G-beta repeats |
| 15479 | ATPases | ATPases Associated with Various Cellular Activities |
| 15498 | ras | Ras family |
| 15557 | ras | Ras family |
| 15570 | neur_chan | Neurotransmitter-gated ion-channel |
| 15572 | tor_domain2 | kinase domain of tors (Christoph Reinhard) |
| 15576 | homeobox | Homeobox Domain |
| 15588 | Metallothion | Metallothioneins |
| 15597 | asp | Eukaryotic aspartyl proteases |

Some polynucleotides exhibited multiple profile hits where the query sequence contains overlapping profile regions, and/or where the sequence contains two different functional domains. Each of the profile hits of Table 108 are described in more detail below. The acronyms for the profiles (provided in parentheses) are those used to identify the profile in the Pfam and Prosite databases. The Pfam database can be accessed through web sites supported by the Washington University, St. Louis (Mo.), The Sanger Centre (United Kingdom); and The Karolinska Institute Center for Genomics Research. The Prosite database is publicaly available through the ExPASy Molecular Biology Server. The public information available on the Pfam and Prosite databases regarding the various profiles, including but not limited to the activities, function, and consensus sequences of various proteins families and protein domains, is incorporated herein by reference.

Eukaryotic Aspartyl Proteases (asp; Pfam Accession No. PF00026). One SEQ ID NO corresponds to a gene encoding a novel eukaryotic aspartyl protease. Aspartyl proteases, known as acid proteases, (EC 3.4.23.-) are a widely distributed family of proteolytic enzymes (Foltmann B., *Essays Biochem.* (1981) 17:52; Davies D. R., *Annu. Rev. Biophys. Chem.* (1990) 19:189; Rao J. K. M., et al., *Biochemistry* (1991) 30:4663) known to exist in vertebrates, fungi, plants, retroviruses and some plant viruses. Aspartate proteases of eukaryotes are monomeric enzymes which consist of two domains.

ATPases Associated with Various Cellular Activities (ATPases; Pfam Accession No. PF0004). Some SEQ ID NOS correspond to a sequence that encodes a member of a family of ATPases Associated with diverse cellular Activities (AAA). The AAA protein family is composed of a large number of ATPases that share a conserved region of about 220 amino acids containing an ATP-binding site (Froehlich et al., *J. Cell Biol.* (1991) 114:443; Erdmann et al. *Cell* (1991) 64:499; Peters et al., *EMBO J.* (1990) 9:1757; Kunau et al., *Biochimie* (1993) 75:209-224; Confalonieri et al., *BioEssays* (1995) 17:639; see also the AAA Server Homepage). The AAA domain, which can be present in one or two copies, acts as an ATP-dependent protein clamp (Confalonieri et al. (1995) BioEssays 17:639) and contains a highly conserved region located in the central part of the domain.

Basic Region Plus Leucine Zipper Transcription Factors (BZIP; Pfam Accession No. PF00170). One SEQ ID NO represents a polynucleotide encoding a novel member of the family of basic region plus leucine zipper transcription factors. The bZIP superfamily (Hurst, *Protein Prof.* (1995) 2:105; and Ellenberger, *Curr. Opin. Struct. Biol.* (1994) 4:12) of eukaryotic DNA-binding transcription factors encompasses proteins that contain a basic region mediating sequence-specific DNA-binding followed by a leucine zipper required for dimerization.

C2 domain (C2; Pfam Accession No. PF00168). ONe SEQ ID NO corresponds to a sequence encoding a C2 domain, which is involved in calcium-dependent phospholipid binding (Davletov *J. Biol. Chem.* (1993) 268:26386-26390) or, in proteins that do not bind calcium, the domain may facilitate binding to inositol-1,3,4,5-tetraphosphate (Fukuda et al. *J. Biol. Chem.* (1994) 269:29206-29211; Sutton et al. *Cell* (1995) 80:929-938).

DEAD and DEAH box families ATP-dependent helicases (Dead_box_helic; Pfam Accession No. PF00270). Some SEQ ID NOS represent polynucleotides encoding a novel member of the DEAD and DEAH box families (Schmid et al., *Mol. Microbiol.* (1992) 6:283; Linder et al., *Nature* (1989) 337:121; Wassarman, et al., *Nature* (1991) 349:463). All members of these families are involved in ATP-dependent, nucleic-acid unwinding. All DEAD box family members share a number of conserved sequence motifs, some of which are specific to the DEAD family, with others shared by other ATP-binding proteins or by proteins belonging to the helicases 'superfamily' (Hodgman *Nature* (1988) 333:22 and *Nature* (1988) 333:578 (Errata)). One of these motifs, called the 'D-E-A-D-box', represents a special version of the B motif of ATP-binding proteins. Proteins that have His instead of the second Asp and are 'D-E-A-H-box' proteins (Wassarman et al., *Nature* (1991) 349:463; Harosh, et al., *Nucleic Acids Res.* (1991) 19:6331; Koonin, et al., *J. Gen. Virol.* (1992) 73:989).

Dual specificity phosphatase (DSPc; Pfam Accession No. PF00782). Some SEQ ID NOS correspond to sequences that encode members of a family of dual specificity phosphatases (DSPs). DSPs are Ser/Thr and Tyr protein phosphatases that comprise a tertiary fold highly similar to that of tyrosine-specific phosphatases, except for a "recognition" region connecting helix alpha1 to strand beta1. This tertiary fold may determine differences in substrate specific between VH-1 related dual specificity phosphatase (VHR), the protein tyrosine phosphatases (PTPs), and other DSPs. Phosphatases are important in the control of cell growth, proliferation, differentiation and transformation.

EF Hand (Efhand; Pfam Accession No. PF00036). One SEQ ID NO corresponds to a polynucleotide encoding a member of the EF-hand protein family, a calcium binding domain shared by many calcium-binding proteins belonging to the same evolutionary family (Kawasaki et al., *Protein. Prof.* (1995) 2:305-490). The domain is a twelve residue loop flanked on both sides by a twelve residue alpha-helical domain, with a calcium ion coordinated in a pentagonal bipyramidal configuration. The six residues involved in the binding are in positions 1, 3, 5, 7, 9 and 12; these residues are denoted by X, Y, Z, –Y, –X and –Z. The invariant Glu or Asp at position 12 provides two oxygens for liganding Ca (bidentate ligand).

Homeobox domain (homeobox; Pfam Accession No. PF00046). One SEQ ID NO represents a polynucleotide encoding a protein having a homeobox domain. The 'homeobox' is a protein domain of 60 amino acids (Gehring In: *Guidebook to the Homebox Genes*, Duboule D., Ed., pp 1-10, Oxford University Press, Oxford, (1994); Buerglin In: *Guidebook to the Homebox Genes*, pp 25-72, Oxford University Press, Oxford, (1994); Gehring *Trends Biochem. Sci.* (1992) 17:277-280; Gehring et al *Annu. Rev. Genet.* (1986) 20:147-173; Schofield *Trends Neurosci.* (1987) 10:3-6) first identified in number of *Drosophila* homeotic and segmentation proteins. It is extremely well conserved in many other animals, including vertebrates. This domain binds DNA through a helix-turn-helix type of structure. Several proteins that contain a homeobox domain play an important role in development. Most of these proteins are sequence-specific DNA-binding transcription factors. The homeobox domain is also very similar to a region of the yeast mating type proteins. These are sequence-specific DNA-binding proteins that act as master switches in yeast differentiation by controlling gene expression in a cell type-specific fashion.

A schematic representation of the homeobox domain is shown below. The helix-turn-helix region is shown by the symbols 'H' (for helix), and 't' (for turn).

```
xxxxxxxxxxxxxxxxxxxxxxxxxxxxxxxxxHHHHHHHHtttHHHHHHHHHxxxxxxxxx
1                                                            60
```

The pattern detects homeobox sequences 24 residues long and spans positions 34 to 57 of the homeobox domain.

Metallothioneins (metalthio; Pfam Accession No. PF00131). One SEQ ID NO corresponds to a polynucleotide encoding a member of the metallothionein (MT) protein family (Hamer *Annu. Rev. Biochem.* (1986) 55:913-951; and Kagi et al. *Biochemistry* (1988) 27:8509-8515), small proteins which bind heavy metals such as zinc, copper, cadmium, nickel, etc., through clusters of thiolate bonds. MT's occur throughout the animal kingdom and are also found in higher plants, fungi and some prokaryotes. On the basis of structural relationships MT's have been subdivided into three classes. Class I includes mammalian MT's as well as MT's from crustacean and molluscs, but with clearly related primary structure. Class II groups together MT's from various species such as sea urchins, fungi, insects and cyanobacteria which display none or only very distant correspondence to class I MT's. Class III MT's are atypical polypeptides containing gamma-glutamylcysteinyl units.

Neurotransmitter-Gated Ion-Channel (neur_chan; Pfam Accession No. PF00065). One SEQ ID NO corresponds to a sequence encoding a neurotransmitter-gated ion channel. Neurotransmitter-gated ion-channels, which provide the molecular basis for rapid signal transmission at chemical synapses, are post-synaptic oligomeric transmembrane complexes that transiently form a ionic channel upon the binding of a specific neurotransmitter. Five types of neurotransmitter-gated receptors are known: 1) nicotinic acetylcholine receptor (AchR); 2) glycine receptor; 3) gamma-aminobutyric-acid (GABA) receptor; 4) serotonin 5HT3 receptor; and 5) glutamate receptor. All known sequences of subunits from neurotransmitter-gated ion-channels are structurally related, and are composed of a large extracellular glycosylated N-terminal ligand-binding domain, followed by three hydrophobic transmembrane regions that form the ionic channel, followed by an intracellular region of variable length. A fourth hydrophobic region is found at the C-terminal of the sequence.

Ras family proteins (ras; Pfam Accession No. PF00071). Some SEQ ID NOS represent polynucleotides encoding the ras family of small GTP/GDP-binding proteins (Valencia et al., 1991, Biochemistry 30:4637-4648). Ras family members generally require a specific guanine nucleotide exchange factor (GEF) and a specific GTPase activating protein (GAP) as stimulators of overall GTPase activity. Among ras-related proteins, the highest degree of sequence conservation is found in four regions that are directly involved in guanine nucleotide binding. The first two constitute most of the phosphate and Mg2+ binding site (PM site) and are located in the first half of the G-domain. The other two regions are involved in guanosine binding and are located in the C-terminal half of the molecule. Motifs and conserved structural features of the ras-related proteins are described in Valencia et al., 1991, Biochemistry 30:4637-4648.

RNA Recognition Motif (rrm; Pfam Accession No. PF00076). Some SEQ ID NOS correspond to sequence encoding an RNA recognition motif, also known as an RRM, RBD, or RNP domain. This domain, which is about 90 amino acids long, is contained in eukaryotic proteins that bind single-stranded RNA (Bandziulis et al. *Genes Dev.* (1989) 3:431-437; Dreyfuss et al. *Trends Biochem. Sci.* (1988) 13:86-91). Two regions within the RNA-binding domain are highly conserved: the first is a hydrophobic segment of six residues (which is called the RNP-2 motif), the second is an octapeptide motif (which is called RNP-1 or RNP-CS).

Kinase Domain of Tors (tor_domain2). One SEQ ID NO corresponds to a member of the TOR lipid kinase protein family. This family is composed of large proteins with a lipid and protein kinase domain and characterized through their sensitivity to rapamycin (an antifungal compound). TOR proteins are involved in signal transduction downstream of PI3 kinase and many other signals. TOR (also called FRAP, RAFT) plays a role in regulating protein synthesis and cell growth, and in yeast controls translation initiation and early G1 progression. See, e.g., Barbet et al. *Mol Biol Cell*. (1996) 7(1):25-42; Helliwell et al. *Genetics* (1998) 148:99-112.

WD Domain, G-Beta Repeats (WD_domain: Pfam Accession No. PF00400). Some SEQ ID NOS represent novel members of the WD domain/G-beta repeat family. Beta-transducin (G-beta) is one of the three subunits (alpha, beta, and gamma) of the guanine nucleotide-binding proteins (G proteins) which act as intermediaries in the transduction of signals generated by transmembrane receptors (Gilman, *Annu. Rev. Biochem.* (1987) 56:615). The alpha subunit binds to and hydrolyzes GTP; the functions of the beta and gamma subunits are less clear but they seem to be required for the replacement of GDP by GTP as well as for membrane anchoring and receptor recognition. In higher eukaryotes, G-beta exists as a small multigene family of highly conserved proteins of about 340 amino acid residues. Structurally, G-beta consists of eight tandem repeats of about 40 residues, each containing a central Trp-Asp motif (this type of repeat is sometimes called a WD-40 repeat).

Zinc Finger, C2H2 Type (Zincfing_C2H2; Pfam Accession No. PF00096). One SEQ ID NO corresponds to a polynucleotide encoding a member of the C2H2 type zinc finger protein family, which contain zinc finger domains that facilitate nucleic acid binding (Klug et al., *Trends Biochem. Sci.* (1987) 12:464; Evans et al., *Cell* (1988) 52:1; Payre et al., *FEBS Lett.* (1988) 234:245; Miller et al., *EMBO J.* (1985) 4:1609; and Berg, *Proc. Natl. Acad. Sci. USA* (1988) 85:99).

In addition to the conserved zinc ligand residues, a number of other positions are also important for the structural integrity of the C2H2 zinc fingers. (Rosenfeld et al., *J. Biomol. Struct. Dyn.* (1993) 11:557) The best conserved position, which is generally an aromatic or aliphatic residue, is located four residues after the second cysteine.

Example 71

Differential Expression of Polynucleotides of the Invention: Description of Libraries and Detection of Differential Expression The relative expression levels of the polynucleotides of the invention was assessed in several libraries prepared from various sources, including cell lines and patient tissue samples. Table 109 provides a summary of these libraries, including the shortened library name (used hereafter), the mRNA source used to prepared the cDNA library, and the approximate number of clones in the library.

The KM12L4 cell line (Morikawa, et al., *Cancer Research* (1988) 48:6863) is derived from the KM12C cell line (Morikawa et al. *Cancer Res.* (1988) 48:1943-1948). The KM12C cell line, which is poorly metastatic (low metastatic) was established in culture from a Dukes' stage $B_2$ surgical specimen (Morikawa et al. *Cancer Res.* (1988) 48:6863). The KM12L4-A is a highly metastatic subline derived from KM12C (Yeatman et al. *Nucl. Acids. Res.* (1995) 23:4007; Bao-Ling et al. *Proc. Annu. Meet. Am. Assoc. Cancer Res.* (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res.* (1995) 1:19; Yeatman et al., (1995) supra; Yeatman et al. *Clin. Exp. Metastasis* (1996) 14:246). The MDA-MB-231 cell line was originally isolated from pleural effusions (Cailleau, *J. Natl. Cancer. Inst.* (1974) 53:661), is of high metastatic potential, and forms poorly differentiated adenocarcinoma grade II in nude mice consistent with breast carcinoma. The MCF7 cell line was derived from a pleural effusion of a breast adenocarcinoma and is non-metastatic. The MDA-MB-231 and MCF-7 cell lines are well-recognized in the art as a models for the study of human breast cancer (see, e.g., Chandrasekaran et al., *Cancer Res.* (1979) 39:870; Gastpar et al., *J Med Chem* (1998) 41:4965; Ranson et al., *Br J Cancer* (1998) 77:1586; and Kuang et al., *Nucleic Acids Res* (1998) 26:1116).

TABLE 109

Description of cDNA Libraries

| Library (Lib#) | Description | Number of Clones in Library |
|---|---|---|
| 1 | Human Colon Cell Line Km12 L4: High Metastatic Potential (derived from Km12C) | 308731 |
| 2 | Human Colon Cell Line Km12C: Low Metastatic Potential | 284771 |
| 3 | Human Breast Cancer Cell Line MDA-MB-231: High Metastatic Potential; micro-mets in lung | 326937 |
| 4 | Human Breast Cancer Cell Line MCF7: Non Metastatic | 318979 |
| 8 | Human Lung Cancer Cell Line MV-522: High Metastatic Potential | 223620 |
| 9 | Human Lung Cancer Cell Line UCP-3: Low Metastatic Potential | 312503 |
| 12 | Human microvascular endothelial cells (HMVEC) - UNTREATED (PCR (OligodT) cDNA library) | 41938 |
| 13 | Human microvascular endothelial cells (HMVEC) - bFGF TREATED (PCR (OligodT) cDNA library) | 42100 |
| 14 | Human microvascular endothelial cells (HMVEC) - VEGF TREATED (PCR (OligodT) cDNA library) | 42825 |
| 15 | Normal Colon - UC#2 Patient (MICRODISSECTED PCR (OligodT) cDNA library) | 282722 |
| 16 | Colon Tumor - UC#2 Patient (MICRODISSECTED PCR (OligodT) cDNA library) | 298831 |
| 17 | Liver Metastasis from Colon Tumor of UC#2 Patient (MICRODISSECTED PCR (OligodT) cDNA library) | 303467 |
| 18 | Normal Colon - UC#3 Patient (MICRODISSECTED PCR (OligodT) cDNA library) | 36216 |
| 19 | Colon Tumor - UC#3 Patient (MICRODISSECTED PCR (OligodT) cDNA library) | 41388 |
| 20 | Liver Metastasis from Colon Tumor of UC#3 Patient (MICRODISSECTED PCR (OligodT) cDNA library) | 30956 |
| 21 | GRRpz Cells derived from normal prostate epithelium | 164801 |
| 22 | WOca Cells derived from Gleason Grade 4 prostate cancer epithelium | 162088 |
| 23 | Normal Lung Epithelium of Patient #1006 (MICRODISSECTED PCR (OligodT) cDNA library) | 306198 |
| 24 | Primary tumor, Large Cell Carcinoma of Patient #1006 (MICRODISSECTED PCR (OligodT) cDNA library) | 309349 |

The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human lung cancer (see, e.g., Varki et al., *Int J Cancer* (1987) 40:46 (UCP-3); Varki et al., *Tumour Biol.* (1990) 11:327; (MV-522 and UCP-3); Varki et al., *Anticancer Res.* (1990) 10:637; (MV-522); Kelner et al., *Anticancer Res* (1995) 15:867 (MV-522); and Zhang et al., *Anticancer Drugs* (1997) 8:696 (MV522)). The samples of libraries 15-20 are derived from two different patients (UC#2, and UC#3). The bFGF-treated HMVEC were prepared by incubation with bFGF at 10 ng/ml for 2 hrs; the VEGF-treated HMVEC were prepared by incubation with 20 ng/ml VEGF for 2 hrs. Following incubation with the respective growth factor, the cells were washed and lysis buffer added for RNA preparation. The GRRpz and WOca cell lines were provided by Dr. Donna M. Peehl, Department of Medicine, Stanford University School of Medicine. GRRpz was derived from normal prostate epithelium. The WOca cell line is a Gleason Grade 4 cell line.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., *Genomics* (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences between Proportions," pp 296-298 (1974).

Example 72

Differential Expression of Genes Corresponding to Polynucleotides of the Invention A number of polynucleotide sequences have been identified that are differentially expressed between, for example, cells derived from high metastatic potential cancer tissue and low metastatic cancer cells, and between cells derived from metastatic cancer tissue and normal tissue. Evaluation of the levels of expression of the genes corresponding to these sequences can be valuable in diagnosis, prognosis, and/or treatment (e.g., to facilitate rationale design of therapy, monitoring during and after therapy, etc.). Moreover, the genes corresponding to differentially expressed sequences described herein can be therapeutic targets due to their involvement in regulation (e.g., inhibition or promotion) of development of, for example, the metastatic phenotype. For example, sequences that correspond to genes that are increased in expression in high metastatic potential cells relative to normal or non-metastatic tumor cells may encode genes or regulatory sequences involved in processes such as angiogenesis, differentiation, cell replication, and metastasis.

Detection of the relative expression levels of differentially expressed polynucleotides described herein can provide valuable information to guide the clinician in the choice of therapy. For example, a patient sample exhibiting an expression level of one or more of these polynucleotides that corresponds to a gene that is increased in expression in metastatic or high metastatic potential cells may warrant more aggressive treatment for the patient. In contrast, detection of expression levels of a polynucleotide sequence that corresponds to expression levels associated with that of low metastatic potential cells may warrant a more positive prognosis than the gross pathology would suggest.

The differential expression of the polynucleotides described herein can thus be used as, for example, diagnostic markers, prognostic markers, for risk assessment, patient treatment and the like. These polynucleotide sequences can also be used in combination with other known molecular and/or biochemical markers. The following examples provide relative expression levels of polynucleotides from specified cell lines and patient tissue samples.

The differential expression data for polynucleotides of the invention that have been identified as being differentially expressed across various combinations of the libraries described above is summarized in Table 110 (inserted prior to the claims). Table 110 provides: 1) the Sequence Identification Number ("SEQ") assigned to the polynucleotide; 2) the cluster ("CLST") to which the polynucleotide has been assigned as described above; 3) the library comparisons that resulted in identification of the polynucleotide as being differentially expressed ("Library Pair A,B"), with shorthand names of the compared libraries provided in parentheses following the library numbers; 4) the number of clones corresponding to the polynucleotide in the first library listed ("A"); 5) the number of clones corresponding to the polynucleotide in the second library listed ("B"); 6) the "A/B" where the comparison resulted in a finding that the number of clones in library A is greater than the number of clones in library B; and 7) the "B/A" where the comparison resulted in a finding that the number of clones in library B is greater than the number of clones in library A.

Example 73

Source of Biological Materials for Microarray-Based Experiments

The biological materials used in the experiments described in the subsequent examples relating to microarry data are described below.

Source of Patient Tissue Samples

Normal and cancerous tissues were collected from patients using laser capture microdissection (LCM) techniques, which techniques are well known in the art (see, e.g., Ohyama et al. (2000) *Biotechniques* 29:530-6; Curran et al. (2000) *Mol. Pathol.* 53:64-8; Suarez-Quian et al. (1999) *Biotechniques* 26:328-35; Simone et al. (1998) *Trends Genet* 14:272-6; Conia et al. (1997) *J. Clin. Lab. Anal.* 11:28-38; Emmert-Buck et al. (1996) *Science* 274:998-1001). Table 114 provides information about each patient from which the samples were isolated, including: the Patient ID and Path ReportID, numbers assigned to the patient and the pathology reports for identification purposes; the anatomical location of the tumor (AnatomicalLoc); The Primary Tumor Size; the Primary Tumor Grade; the Histopathologic Grade; a description of local sites to which the tumor had invaded (Local Invasion); the presence of lymph node metastases (Lymph Node Metastasis); incidence of lymph node metastases (provided as number of lymph nodes positive for metastasis over the number of lymph nodes examined) (Incidence Lymphnode Metastasis); the Regional Lymphnode Grade; the identification or detection of metastases to sites distant to the tumor and their location (Distant Met & Loc); a description of the distant metastases (Description Distant Met); the grade of distant metastasis (Distant Met Grade); and general comments about the patient or the tumor (Comments). Adenoma was not described in any of the patients; adenoma dysplasia (described as hyperplasia by the pathologist) was described in Patient ID No. 695. Extranodal extensions were described in two patients, Patient ID Nos. 784 and 791. Lymphovascular invasion was described in seven patients, Patient ID Nos. 128, 278, 517, 534, 784, 786, and 791. Crohn's-like infiltrates were described in seven patients, Patient ID Nos. 52, 264, 268, 392, 393, 784, and 791.

Polynucleotides on Arrays

Polynucleotides spotted on the arrays were generated by PCR amplification of clones derived from cDNA libraries. The clones used for amplification were either the clones from which the sequences described herein (SEQ ID NOS: 13271-15666) were derived, or are clones having inserts with significant polynucleotide sequence overlap with the sequences described herein (SEQ ID NO: 13271-15666) as determined by BLAST2 homology searching.

Example 74

Microarray Design

Each array used in the examples below had an identical spatial layout and control spot set. Each microarray was divided into two areas, each area having an array with, on each half, twelve groupings of 32×12 spots for a total of about 9,216 spots on each array. The two areas are spotted identically which provide for at least two duplicates of each clone per array. Spotting was accomplished using PCR amplified products from 0.5 kb to 2.0 kb and spotted using a Molecular Dynamics Gen III spotter according to the manufacturer's recommendations. The first row of each of the 24 regions on the array had about 32 control spots, including 4 negative control spots and 8 test polynucleotides.

The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about 4 duplicate measurements for each clone, two of one color and two of the other, for each sample.

Example 75

Identification of Differentially Expressed Genes cDNA probes were prepared from total RNA isolated from the patient cells described in Example 6. Since LCM provides for the isolation of specific cell types to provide a substantially homogenous cell sample, this provided for a similarly pure RNA sample.

Total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) *Nature Med* 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling. Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from normal cell RNA sample. For example, the cDNA probes from the normal cells were labeled with Cy3 fluorescent dye (green) and the cDNA probes prepared from the tumor cells were labeled with Cy5 fluorescent dye (red).

The differential expression assay was performed by mixing equal amounts of probes from tumor cells and normal cells of the same patient. The arrays were prehybridized by incubation for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction). The level fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. During initial analysis of the microarrays, the hypothesis was accepted if $p > 10^{-3}$, and the differential ratio was set to 1.000 for those spots. All other spots have a significant difference in expression between the tumor and normal sample. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level ($p > 0.05$).

Tables 115-119 summarizes the results of the differential expression analysis, where the difference in the expression level in the colon tumor cell relative to the matched normal colon cells is greater than or equal to 2 fold (">=2×"), 2.5 fold (">=2.5×"), or 5 fold (">=5×") in at least 20% or more of the patients analyzed. Each table provides: the SEQ ID NO; the percentage of patients tested having a colon tumor that exhibited at least 2 fold (">=2×"), 2.5 fold (">=2.5×"), or 5 fold (">=5×") increase in expression levels of the indicated gene relative to matched normal colon tissue; and the ratio data for each patient sample tested (columns headed by "P#," indicating the Patient Identification Number, e.g., "P15" indicates the ration data for patient 15).

TABLE 115

| SEQ ID NO | % Pts >=2x T/N | % Pts >=2_5x T/N | % Pts >=5x T/N | P15 | P52 | P121 | P125 |
|---|---|---|---|---|---|---|---|
| 13288 | 30.3 | 15.2 | 3.0 | 1.855 | 2.705 | 1.000 | 2.280 |
| 13292 | 45.5 | 39.4 | 18.2 | 2.196 | 1.719 | 0.604 | 2.388 |
| 13397 | 27.3 | 18.2 | 6.1 | 1.000 | 1.620 | 1.822 | 1.692 |
| 13409 | 21.2 | 18.2 | 15.2 | 1000.000 | 0.001 | 2.345 | 1.000 |
| 13418 | 27.3 | 18.2 | 6.1 | 1.000 | 1.620 | 1.822 | 1.692 |
| 13425 | 45.5 | 12.1 | 3.0 | 1.870 | 3.104 | 1.361 | 2.388 |
| 13516 | 42.4 | 9.1 | 0.0 | 2.211 | 2.347 | 1.000 | 1.493 |
| 13542 | 48.5 | 27.3 | 12.1 | 1.735 | 3.110 | 1.379 | 2.277 |
| 13543 | 21.2 | 18.2 | 18.2 | 1.000 | 1.000 | 0.330 | 1.349 |
| 13549 | 24.2 | 12.1 | 0.0 | 1.614 | 2.348 | 1.498 | 1.916 |
| 13568 | 21.2 | 18.2 | 18.2 | 1.000 | 1.000 | 0.330 | 1.349 |
| 13599 | 21.2 | 9.1 | 6.1 | 1.000 | 1.000 | 2.211 | 1.182 |
| 13623 | 45.5 | 12.1 | 3.0 | 1.870 | 3.104 | 1.361 | 2.388 |
| 13624 | 48.5 | 30.3 | 3.0 | 1.000 | 1.592 | 2.248 | 2.315 |
| 13651 | 27.3 | 18.2 | 6.1 | 1.000 | 1.620 | 1.822 | 1.692 |
| 13659 | 21.2 | 9.1 | 6.1 | 1.000 | 1.000 | 2.211 | 1.182 |
| 13675 | 21.2 | 9.1 | 3.0 | 1.000 | 2.366 | 1.546 | 1.562 |
| 13676 | 21.2 | 9.1 | 3.0 | 1.000 | 2.366 | 1.546 | 1.562 |
| 13682 | 36.4 | 18.2 | 0.0 | 2.584 | 1.332 | 1.952 | 1.641 |
| 13691 | 51.5 | 24.2 | 3.0 | 2.481 | 2.253 | 2.234 | 1.431 |
| 13735 | 21.2 | 18.2 | 15.2 | 1000.000 | 0.001 | 2.345 | 1.000 |
| 13804 | 21.2 | 9.1 | 3.0 | 1.000 | 2.366 | 1.546 | 1.562 |
| 13808 | 42.4 | 15.2 | 0.0 | 1.489 | 2.019 | 3.022 | 1.121 |
| 13835 | 45.5 | 12.1 | 3.0 | 1.870 | 3.104 | 1.361 | 2.388 |
| 13927 | 45.5 | 30.3 | 3.0 | 1.512 | 2.748 | 0.784 | 2.162 |
| 13940 | 24.2 | 6.1 | 0.0 | 1.190 | 1.000 | 0.656 | 1.456 |
| 14009 | 21.2 | 12.1 | 0.0 | 1.936 | 1.830 | 0.831 | 1.347 |
| 14011 | 48.5 | 18.2 | 0.0 | 2.750 | 2.458 | 1.485 | 1.151 |
| 14014 | 48.5 | 21.2 | 0.0 | 2.069 | 3.002 | 1.229 | 1.631 |
| 14025 | 30.3 | 18.2 | 3.0 | 1.000 | 1.414 | 1.236 | 1.738 |
| 14027 | 21.2 | 15.2 | 6.1 | 1.000 | 0.839 | 2.032 | 2.557 |
| 14080 | 30.3 | 18.2 | 3.0 | 1.000 | 1.414 | 1.236 | 1.738 |
| 14081 | 30.3 | 18.2 | 3.0 | 1.000 | 1.414 | 1.236 | 1.738 |
| 14115 | 30.3 | 15.2 | 9.1 | 1.000 | 0.271 | 0.860 | 1.310 |
| 14131 | 24.2 | 21.2 | 15.2 | 1000.000 | 1000.000 | 1.000 | 1.320 |
| 14185 | 30.3 | 15.2 | 3.0 | 1.855 | 2.705 | 1.000 | 2.280 |

TABLE 115-continued

| SEQ ID NO | % Pts >=2x T/N | % Pts >=2_5x T/N | % Pts >=5x T/N | P15 | P52 | P121 | P125 |
|---|---|---|---|---|---|---|---|
| 14224 | 24.2 | 21.2 | 15.2 | 1000.000 | 1000.000 | 1.000 | 1.320 |
| 14225 | 39.4 | 21.2 | 3.0 | 1.612 | 2.281 | 0.785 | 2.045 |
| 14261 | 39.4 | 21.2 | 3.0 | 1.612 | 2.281 | 0.785 | 2.045 |
| 14305 | 24.2 | 6.1 | 0.0 | 1.190 | 1.000 | 0.656 | 1.456 |
| 14319 | 21.2 | 12.1 | 0.0 | 1.936 | 1.830 | 0.831 | 1.347 |
| 14320 | 39.4 | 21.2 | 3.0 | 1.612 | 2.281 | 0.785 | 2.045 |
| 14505 | 45.5 | 12.1 | 3.0 | 1.870 | 3.104 | 1.361 | 2.388 |
| 14562 | 21.2 | 3.0 | 0.0 | 1.558 | 2.014 | 2.250 | 1.643 |
| 14583 | 24.2 | 6.1 | 0.0 | 1.190 | 1.000 | 0.656 | 1.456 |
| 14601 | 27.3 | 9.1 | 3.0 | 1.327 | 3.749 | 1.000 | 2.045 |
| 14604 | 48.5 | 30.3 | 3.0 | 1.000 | 1.592 | 2.248 | 2.315 |
| 14688 | 30.3 | 15.2 | 3.0 | 1.855 | 2.705 | 1.000 | 2.280 |
| 14689 | 45.5 | 12.1 | 3.0 | 1.870 | 3.104 | 1.361 | 2.388 |
| 14690 | 39.4 | 18.2 | 3.0 | 1.759 | 1.566 | 1.000 | 2.302 |
| 14747 | 39.4 | 18.2 | 3.0 | 1.759 | 1.566 | 1.000 | 2.302 |
| 14824 | 33.3 | 15.2 | 0.0 | 1.829 | 1.622 | 1.882 | 1.957 |
| 14849 | 42.4 | 9.1 | 0.0 | 2.211 | 2.347 | 1.000 | 1.493 |
| 14870 | 45.5 | 12.1 | 3.0 | 1.870 | 3.104 | 1.361 | 2.388 |
| 14909 | 48.5 | 27.3 | 12.1 | 1.735 | 3.110 | 1.379 | 2.277 |
| 14927 | 42.4 | 24.2 | 0.0 | 1.000 | 1.908 | 2.267 | 1.188 |
| 14949 | 33.3 | 15.2 | 0.0 | 1.829 | 1.622 | 1.882 | 1.957 |
| 15014 | 42.4 | 15.2 | 3.0 | 2.059 | 2.753 | 1.679 | 1.587 |
| 15117 | 78.8 | 63.6 | 9.1 | 2.625 | 4.493 | 1.642 | 2.743 |
| 15147 | 45.5 | 12.1 | 3.0 | 1.870 | 3.104 | 1.361 | 2.388 |
| 15150 | 66.7 | 48.5 | 6.1 | 1.000 | 4.075 | 1.754 | 2.436 |
| 15159 | 45.5 | 12.1 | 3.0 | 1.870 | 3.104 | 1.361 | 2.388 |
| 15279 | 30.3 | 15.2 | 3.0 | 1.855 | 2.705 | 1.000 | 2.280 |
| 15293 | 30.3 | 18.2 | 0.0 | 1.285 | 2.400 | 0.767 | 1.270 |
| 15299 | 42.4 | 9.1 | 0.0 | 2.211 | 2.347 | 1.000 | 1.493 |
| 15341 | 24.2 | 6.1 | 0.0 | 1.190 | 1.000 | 0.656 | 1.456 |
| 15347 | 24.2 | 6.1 | 0.0 | 1.190 | 1.000 | 0.656 | 1.456 |
| 15373 | 27.3 | 21.2 | 0.0 | 3.505 | 0.793 | 0.809 | 1.348 |
| 15379 | 24.2 | 6.1 | 0.0 | 1.190 | 1.000 | 0.656 | 1.456 |
| 15408 | 33.3 | 21.2 | 9.1 | 1.000 | 0.296 | 3.016 | 0.794 |
| 15413 | 60.6 | 48.5 | 12.1 | 6.263 | 1.000 | 1.832 | 1.937 |
| 15453 | 63.6 | 45.5 | 12.1 | 1.945 | 2.010 | 0.547 | 3.325 |
| 15455 | 30.3 | 18.2 | 3.0 | 1.000 | 1.414 | 1.236 | 1.738 |
| 15460 | 24.2 | 6.1 | 0.0 | 1.190 | 1.000 | 0.656 | 1.456 |
| 15470 | 45.5 | 12.1 | 3.0 | 1.870 | 3.104 | 1.361 | 2.388 |
| 15476 | 60.6 | 27.3 | 3.0 | 2.256 | 2.228 | 1.673 | 1.937 |
| 15490 | 33.3 | 24.2 | 3.0 | 2.591 | 0.483 | 2.580 | 1.440 |
| 15494 | 48.5 | 36.4 | 3.0 | 1.602 | 3.209 | 1.000 | 2.942 |
| 15519 | 45.5 | 12.1 | 3.0 | 1.870 | 3.104 | 1.361 | 2.388 |
| 15525 | 24.2 | 3.0 | 0.0 | 1.985 | 2.261 | 1.000 | 0.904 |
| 15535 | 54.5 | 42.4 | 6.1 | 1.886 | 1.000 | 1.503 | 3.375 |
| 15537 | 84.8 | 57.6 | 18.2 | 2.529 | 3.042 | 2.471 | 1.669 |
| 15551 | 54.5 | 36.4 | 3.0 | 2.008 | 0.686 | 3.104 | 1.362 |
| 15564 | 30.3 | 15.2 | 3.0 | 1.855 | 2.705 | 1.000 | 2.280 |
| 15570 | 30.3 | 15.2 | 3.0 | 1.855 | 2.705 | 1.000 | 2.280 |
| 15577 | 42.4 | 9.1 | 0.0 | 2.211 | 2.347 | 1.000 | 1.493 |
| 15579 | 42.4 | 21.2 | 9.1 | 2.497 | 1.837 | 3.249 | 1.497 |
| 15583 | 57.6 | 48.5 | 9.1 | 2.603 | 2.642 | 1.000 | 1.939 |
| 15584 | 48.5 | 27.3 | 12.1 | 1.735 | 3.110 | 1.379 | 2.277 |
| 15586 | 42.4 | 9.1 | 0.0 | 2.211 | 2.347 | 1.000 | 1.493 |
| 15597 | 39.4 | 24.2 | 3.0 | 2.006 | 1.692 | 1.778 | 1.662 |
| 15618 | 72.7 | 45.5 | 0.0 | 2.961 | 3.152 | 2.712 | 1.346 |

TABLE 116

| SEQ ID NO | P128 | P130 | P133 | P141 | P156 | P228 | P264 | P266 |
|---|---|---|---|---|---|---|---|---|
| 13288 | 0.713 | 1.800 | 1.955 | 0.663 | 0.466 | 1.457 | 2.262 | 1.236 |
| 13292 | 1.594 | 6.800 | 1.340 | 1.131 | 1.000 | 2.647 | 1.628 | 1.190 |
| 13397 | 3.761 | 1.000 | 1.000 | 1.587 | 2.127 | 1.000 | 1.000 | 1.000 |
| 13409 | 1000.000 | 1.000 | 1000.000 | 0.482 | 2.846 | 0.767 | 1.631 | 1.000 |
| 13418 | 3.761 | 1.000 | 1.000 | 1.587 | 2.127 | 1.000 | 1.000 | 1.000 |
| 13425 | 2.062 | 1.781 | 2.302 | 1.000 | 1.000 | 1.306 | 2.099 | 1.357 |
| 13516 | 1.779 | 1.337 | 2.865 | 1.515 | 1.617 | 1.301 | 2.098 | 1.733 |
| 13542 | 2.044 | 2.219 | 4.257 | 0.744 | 1.000 | 1.127 | 1.588 | 1.634 |
| 13543 | 1000.000 | 1000.000 | 1.000 | 1.000 | 0.566 | 1.554 | 1.000 | 1.000 |
| 13549 | 1.202 | 1.852 | 2.370 | 1.000 | 1.000 | 1.114 | 1.399 | 1.239 |
| 13568 | 1000.000 | 1000.000 | 1.000 | 1.000 | 0.566 | 1.554 | 1.000 | 1.000 |
| 13599 | 3.234 | 0.001 | 1.000 | 8.480 | 2.077 | 1.000 | 0.001 | 1.445 |

TABLE 116-continued

| SEQ ID NO | P128 | P130 | P133 | P141 | P156 | P228 | P264 | P266 |
|---|---|---|---|---|---|---|---|---|
| 13623 | 2.062 | 1.781 | 2.302 | 1.000 | 1.000 | 1.306 | 2.099 | 1.357 |
| 13624 | 1.664 | 1.987 | 2.307 | 2.728 | 1.000 | 1.239 | 1.469 | 2.059 |
| 13651 | 3.761 | 1.000 | 1.000 | 1.587 | 2.127 | 1.000 | 1.000 | 1.000 |
| 13659 | 3.234 | 0.001 | 1.000 | 8.480 | 2.077 | 1.000 | 0.001 | 1.445 |
| 13675 | 1.531 | 1.553 | 1.854 | 2.044 | 1.363 | 1.786 | 1.877 | 1.644 |
| 13676 | 1.531 | 1.553 | 1.854 | 2.044 | 1.363 | 1.786 | 1.877 | 1.644 |
| 13682 | 1.831 | 1.503 | 2.326 | 1.130 | 1.773 | 1.379 | 2.318 | 2.019 |
| 13691 | 2.209 | 1.889 | 3.114 | 1.776 | 1.788 | 1.879 | 2.666 | 2.257 |
| 13735 | 1000.000 | 1.000 | 1000.000 | 0.482 | 2.846 | 0.767 | 1.631 | 1.000 |
| 13804 | 1.531 | 1.553 | 1.854 | 2.044 | 1.363 | 1.786 | 1.877 | 1.644 |
| 13808 | 1.559 | 1.000 | 1.740 | 3.133 | 2.186 | 1.869 | 2.023 | 2.483 |
| 13835 | 2.062 | 1.781 | 2.302 | 1.000 | 1.000 | 1.306 | 2.099 | 1.357 |
| 13927 | 1.524 | 1.770 | 2.846 | 1.185 | 1.000 | 1.460 | 1.831 | 2.261 |
| 13940 | 1.182 | 1.636 | 1.418 | 1.298 | 1.000 | 1.000 | 1.127 | 0.774 |
| 14009 | 0.845 | 1.286 | 1.872 | 1.000 | 1.000 | 1.295 | 1.722 | 1.785 |
| 14011 | 1.819 | 1.801 | 3.227 | 1.457 | 2.960 | 1.388 | 2.086 | 2.410 |
| 14014 | 2.515 | 1.605 | 2.399 | 1.803 | 2.524 | 1.551 | 2.284 | 1.574 |
| 14025 | 1.000 | 0.754 | 2.234 | 3.723 | 1.000 | 1.285 | 1.771 | 2.246 |
| 14027 | 0.745 | 1.332 | 1000.000 | 1.000 | 1.000 | 1.781 | 1.515 | 1.747 |
| 14080 | 1.000 | 0.754 | 2.234 | 3.723 | 1.000 | 1.285 | 1.771 | 2.246 |
| 14081 | 1.000 | 0.754 | 2.234 | 3.723 | 1.000 | 1.285 | 1.771 | 2.246 |
| 14115 | 2.331 | 1.641 | 1000.000 | 1.252 | 1.000 | 0.595 | 1.950 | 0.616 |
| 14131 | 2.888 | 1.000 | 0.001 | 1.000 | 1.694 | 0.001 | 1000.000 | 1.423 |
| 14185 | 0.713 | 1.800 | 1.955 | 0.663 | 0.466 | 1.457 | 2.262 | 1.236 |
| 14224 | 2.888 | 1.000 | 0.001 | 1.000 | 1.694 | 0.001 | 1000.000 | 1.423 |
| 14225 | 1.415 | 2.042 | 2.733 | 0.898 | 1.431 | 1.000 | 1.459 | 2.009 |
| 14261 | 1.415 | 2.042 | 2.733 | 0.898 | 1.431 | 1.000 | 1.459 | 2.009 |
| 14305 | 1.182 | 1.636 | 1.418 | 1.298 | 1.000 | 1.000 | 1.127 | 0.774 |
| 14319 | 0.845 | 1.286 | 1.872 | 1.000 | 1.000 | 1.295 | 1.722 | 1.785 |
| 14320 | 1.415 | 2.042 | 2.733 | 0.898 | 1.431 | 1.000 | 1.459 | 2.009 |
| 14505 | 2.062 | 1.781 | 2.302 | 1.000 | 1.000 | 1.306 | 2.099 | 1.357 |
| 14562 | 1.804 | 1.641 | 1.876 | 1.335 | 0.766 | 1.245 | 1.500 | 1.000 |
| 14583 | 1.182 | 1.636 | 1.418 | 1.298 | 1.000 | 1.000 | 1.127 | 0.774 |
| 14601 | 1.427 | 1.669 | 1.837 | 1.265 | 1.000 | 1.667 | 1.000 | 1.374 |
| 14604 | 1.664 | 1.987 | 2.307 | 2.728 | 1.000 | 1.239 | 1.469 | 2.059 |
| 14688 | 0.713 | 1.800 | 1.955 | 0.663 | 0.466 | 1.457 | 2.262 | 1.236 |
| 14689 | 2.062 | 1.781 | 2.302 | 1.000 | 1.000 | 1.306 | 2.099 | 1.357 |
| 14690 | 1.518 | 1.997 | 2.298 | 2.273 | 1.000 | 1.234 | 1.186 | 1.730 |
| 14747 | 1.518 | 1.997 | 2.298 | 2.273 | 1.000 | 1.234 | 1.186 | 1.730 |
| 14824 | 2.959 | 1.821 | 2.234 | 1.181 | 1.827 | 1.000 | 2.042 | 1.970 |
| 14849 | 1.779 | 1.337 | 2.865 | 1.515 | 1.617 | 1.301 | 2.098 | 1.733 |
| 14870 | 2.062 | 1.781 | 2.302 | 1.000 | 1.000 | 1.306 | 2.099 | 1.357 |
| 14909 | 2.044 | 2.219 | 4.257 | 0.744 | 1.000 | 1.127 | 1.588 | 1.634 |
| 14927 | 2.160 | 1.416 | 1.000 | 3.531 | 2.974 | 1.798 | 1.899 | 2.065 |
| 14949 | 2.959 | 1.821 | 2.234 | 1.181 | 1.827 | 1.000 | 2.042 | 1.970 |
| 15014 | 1.479 | 1.669 | 2.442 | 1.352 | 1.367 | 1.605 | 2.145 | 2.098 |
| 15117 | 1.839 | 2.548 | 2.954 | 2.234 | 1.816 | 1.352 | 3.390 | 2.541 |
| 15147 | 2.062 | 1.781 | 2.302 | 1.000 | 1.000 | 1.306 | 2.099 | 1.357 |
| 15150 | 2.762 | 2.081 | 4.111 | 2.306 | 2.391 | 1.675 | 2.572 | 3.031 |
| 15159 | 2.062 | 1.781 | 2.302 | 1.000 | 1.000 | 1.306 | 2.099 | 1.357 |
| 15279 | 0.713 | 1.800 | 1.955 | 0.663 | 0.466 | 1.457 | 2.262 | 1.236 |
| 15293 | 1.871 | 1.869 | 2.588 | 1.834 | 1.718 | 1.197 | 1.965 | 2.023 |
| 15299 | 1.779 | 1.337 | 2.865 | 1.515 | 1.617 | 1.301 | 2.098 | 1.733 |
| 15341 | 1.182 | 1.636 | 1.418 | 1.298 | 1.000 | 1.000 | 1.127 | 0.774 |
| 15347 | 1.182 | 1.636 | 1.418 | 1.298 | 1.000 | 1.000 | 1.127 | 0.774 |
| 15373 | 2.297 | 0.855 | 1.659 | 1.607 | 0.252 | 1.602 | 2.866 | 1.292 |
| 15379 | 1.182 | 1.636 | 1.418 | 1.298 | 1.000 | 1.000 | 1.127 | 0.774 |
| 15408 | 2.074 | 1.438 | 1.552 | 2.403 | 0.647 | 0.605 | 0.469 | 0.528 |
| 15413 | 2.828 | 2.795 | 2.732 | 2.548 | 0.073 | 1.201 | 1.722 | 1.181 |
| 15453 | 1.714 | 3.061 | 4.635 | 1.688 | 1.230 | 1.241 | 1.237 | 1.852 |
| 15455 | 1.000 | 0.754 | 2.234 | 3.723 | 1.000 | 1.285 | 1.771 | 2.246 |
| 15460 | 1.182 | 1.636 | 1.418 | 1.298 | 1.000 | 1.000 | 1.127 | 0.774 |
| 15470 | 2.062 | 1.781 | 2.302 | 1.000 | 1.000 | 1.306 | 2.099 | 1.357 |
| 15476 | 2.229 | 2.131 | 2.194 | 2.235 | 2.121 | 1.388 | 3.468 | 2.115 |
| 15490 | 2.650 | 0.815 | 1.629 | 1.586 | 0.155 | 1.408 | 2.830 | 1.636 |
| 15494 | 1.385 | 2.044 | 2.510 | 0.628 | 1.763 | 1.000 | 1.000 | 1.687 |
| 15519 | 2.062 | 1.781 | 2.302 | 1.000 | 1.000 | 1.306 | 2.099 | 1.357 |
| 15525 | 1.454 | 1.000 | 1.567 | 2.350 | 1.729 | 2.071 | 1.439 | 1.540 |
| 15535 | 2.843 | 2.931 | 1.690 | 1.678 | 0.724 | 2.656 | 2.035 | 3.526 |
| 15537 | 2.490 | 1.937 | 3.729 | 2.105 | 2.224 | 2.547 | 2.605 | 4.402 |
| 15551 | 3.412 | 2.374 | 1.404 | 4.761 | 3.241 | 2.253 | 1.384 | 1.912 |
| 15564 | 0.713 | 1.800 | 1.955 | 0.663 | 0.466 | 1.457 | 2.262 | 1.236 |
| 15570 | 0.713 | 1.800 | 1.955 | 0.663 | 0.466 | 1.457 | 2.262 | 1.236 |
| 15577 | 1.779 | 1.337 | 2.865 | 1.515 | 1.617 | 1.301 | 2.098 | 1.733 |
| 15579 | 1.496 | 1.483 | 2.427 | 1.764 | 1.000 | 1.231 | 1.413 | 1.000 |
| 15583 | 1.452 | 1.915 | 2.252 | 1.342 | 2.516 | 1.278 | 2.179 | 4.223 |
| 15584 | 2.044 | 2.219 | 4.257 | 0.744 | 1.000 | 1.127 | 1.588 | 1.634 |
| 15586 | 1.779 | 1.337 | 2.865 | 1.515 | 1.617 | 1.301 | 2.098 | 1.733 |

TABLE 116-continued

| SEQ ID NO | P128 | P130 | P133 | P141 | P156 | P228 | P264 | P266 |
|---|---|---|---|---|---|---|---|---|
| 15597 | 1.778 | 1.200 | 2.169 | 1.462 | 1.570 | 1.784 | 1.937 | 2.633 |
| 15618 | 2.064 | 1.288 | 2.075 | 2.527 | 2.239 | 1.745 | 3.772 | 3.393 |
| 15654 | 2.340 | 0.001 | 0.001 | 2.927 | 4.830 | 1.708 | 1.651 | 1.586 |

TABLE 117

| SEQ ID NO | P268 | P278 | P295 | P339 | P341 | P356 | P360 | P392 |
|---|---|---|---|---|---|---|---|---|
| 13288 | 1.000 | 2.819 | 1.000 | 1.589 | 1.238 | 1.784 | 0.748 | 2.486 |
| 13292 | 1.194 | 1.000 | 1.000 | 1.474 | 3.006 | 2.766 | 1.622 | 10.061 |
| 13397 | 2.953 | 2.030 | 8.118 | 1.000 | 2.854 | 1.000 | 1000.000 | 0.001 |
| 13409 | 1000.000 | 1.332 | 1.000 | 0.344 | 1.537 | 1.000 | 0.001 | 0.464 |
| 13418 | 2.953 | 2.030 | 8.118 | 1.000 | 2.854 | 1.000 | 1000.000 | 0.001 |
| 13425 | 1.187 | 1.447 | 1.000 | 1.484 | 3.621 | 3.844 | 1.995 | 1.313 |
| 13516 | 1.422 | 2.018 | 2.385 | 1.218 | 2.039 | 3.486 | 1.636 | 1.623 |
| 13542 | 1.268 | 1.563 | 1.870 | 2.056 | 6.240 | 6.491 | 2.230 | 1.427 |
| 13543 | 1.000 | 1000.000 | 1.000 | 1.196 | 2.209 | 1000.000 | 0.001 | 1.000 |
| 13549 | 1.000 | 1.000 | 1.000 | 1.737 | 2.382 | 3.061 | 2.679 | 1.361 |
| 13568 | 1.000 | 1000.000 | 1.000 | 1.196 | 2.209 | 1000.000 | 0.001 | 1.000 |
| 13599 | 2.467 | 2.166 | 21.707 | 0.615 | 1.616 | 1.000 | 1.000 | 1.000 |
| 13623 | 1.187 | 1.447 | 1.000 | 1.484 | 3.621 | 3.844 | 1.995 | 1.313 |
| 13624 | 2.359 | 1.552 | 2.918 | 1.647 | 4.706 | 3.623 | 1.979 | 1.677 |
| 13651 | 2.953 | 2.030 | 8.118 | 1.000 | 2.854 | 1.000 | 1000.000 | 0.001 |
| 13659 | 2.467 | 2.166 | 21.707 | 0.615 | 1.616 | 1.000 | 1.000 | 1.000 |
| 13675 | 1.221 | 1.796 | 1.995 | 1.780 | 1.726 | 2.970 | 1.792 | 1.581 |
| 13676 | 1.221 | 1.796 | 1.995 | 1.780 | 1.726 | 2.970 | 1.792 | 1.581 |
| 13682 | 2.677 | 2.809 | 2.969 | 1.373 | 2.087 | 3.804 | 1.612 | 1.163 |
| 13691 | 2.468 | 5.262 | 4.008 | 1.487 | 4.366 | 2.078 | 1.781 | 1.332 |
| 13735 | 1000.000 | 1.332 | 1.000 | 0.344 | 1.537 | 1.000 | 0.001 | 0.464 |
| 13804 | 1.221 | 1.796 | 1.995 | 1.780 | 1.726 | 2.970 | 1.792 | 1.581 |
| 13808 | 2.565 | 1.856 | 1.000 | 1.000 | 2.449 | 1.000 | 2.097 | 2.647 |
| 13835 | 1.187 | 1.447 | 1.000 | 1.484 | 3.621 | 3.844 | 1.995 | 1.313 |
| 13927 | 1.369 | 1.000 | 1.000 | 1.679 | 3.084 | 2.855 | 2.104 | 0.927 |
| 13940 | 1.677 | 2.420 | 2.263 | 1.314 | 1.473 | 2.523 | 1.776 | 2.244 |
| 14009 | 1.412 | 1.431 | 3.103 | 1.000 | 2.847 | 2.621 | 1.000 | 1.117 |
| 14011 | 2.240 | 2.040 | 1.000 | 1.000 | 2.450 | 3.440 | 2.045 | 1.998 |
| 14014 | 1.837 | 2.201 | 2.518 | 1.604 | 2.248 | 2.989 | 1.570 | 1.409 |
| 14025 | 1.000 | 1.320 | 0.556 | 1.385 | 1.321 | 1.000 | 1.000 | 6.185 |
| 14027 | 0.713 | 1000.000 | 0.632 | 2.389 | 0.202 | 1.000 | 1.000 | 0.356 |
| 14080 | 1.000 | 1.320 | 0.556 | 1.385 | 1.321 | 1.000 | 1.000 | 6.185 |
| 14081 | 1.000 | 1.320 | 0.556 | 1.385 | 1.321 | 1.000 | 1.000 | 6.185 |
| 14115 | 2.151 | 2.384 | 2.417 | 0.573 | 1.451 | 2.652 | 1.000 | 0.734 |
| 14131 | 1.000 | 1.509 | 9.879 | 1000.000 | 2.327 | 0.001 | 1.236 | 0.870 |
| 14185 | 1.000 | 2.819 | 1.000 | 1.589 | 1.238 | 1.784 | 0.748 | 2.486 |
| 14224 | 1.000 | 1.509 | 9.879 | 1000.000 | 2.327 | 0.001 | 1.236 | 0.870 |
| 14225 | 1.657 | 1.732 | 3.510 | 1.652 | 4.946 | 4.071 | 2.194 | 1.932 |
| 14261 | 1.657 | 1.732 | 3.510 | 1.652 | 4.946 | 4.071 | 2.194 | 1.932 |
| 14305 | 1.677 | 2.420 | 2.263 | 1.314 | 1.473 | 2.523 | 1.776 | 2.244 |
| 14319 | 1.412 | 1.431 | 3.103 | 1.000 | 2.847 | 2.621 | 1.000 | 1.117 |
| 14320 | 1.657 | 1.732 | 3.510 | 1.652 | 4.946 | 4.071 | 2.194 | 1.932 |
| 14505 | 1.187 | 1.447 | 1.000 | 1.484 | 3.621 | 3.844 | 1.995 | 1.313 |
| 14562 | 0.718 | 1.000 | 1.000 | 1.675 | 2.301 | 1.361 | 2.161 | 1.825 |
| 14583 | 1.677 | 2.420 | 2.263 | 1.314 | 1.473 | 2.523 | 1.776 | 2.244 |
| 14601 | 0.789 | 1.609 | 1.000 | 0.797 | 1.000 | 2.075 | 2.491 | 2.505 |
| 14604 | 2.359 | 1.552 | 2.918 | 1.647 | 4.706 | 3.623 | 1.979 | 1.677 |
| 14688 | 1.000 | 2.819 | 1.000 | 1.589 | 1.238 | 1.784 | 0.748 | 2.486 |
| 14689 | 1.187 | 1.447 | 1.000 | 1.484 | 3.621 | 3.844 | 1.995 | 1.313 |
| 14690 | 1.864 | 1.428 | 2.631 | 1.854 | 3.430 | 3.182 | 1.892 | 1.581 |
| 14747 | 1.864 | 1.428 | 2.631 | 1.854 | 3.430 | 3.182 | 1.892 | 1.581 |
| 14824 | 2.495 | 2.090 | 3.320 | 1.000 | 3.907 | 2.976 | 1.875 | 1.000 |
| 14849 | 1.422 | 2.018 | 2.385 | 1.218 | 2.039 | 3.486 | 1.636 | 1.623 |
| 14870 | 1.187 | 1.447 | 1.000 | 1.484 | 3.621 | 3.844 | 1.995 | 1.313 |
| 14909 | 1.268 | 1.563 | 1.870 | 2.056 | 6.240 | 6.491 | 2.230 | 1.427 |
| 14927 | 2.183 | 2.285 | 3.554 | 1.247 | 2.093 | 1.840 | 1.855 | 1.504 |
| 14949 | 2.495 | 2.090 | 3.320 | 1.000 | 3.907 | 2.976 | 1.875 | 1.000 |
| 15014 | 2.006 | 1.696 | 2.261 | 1.611 | 2.154 | 3.791 | 1.816 | 1.356 |
| 15117 | 1.535 | 2.851 | 4.154 | 2.055 | 6.047 | 4.103 | 3.367 | 2.029 |
| 15147 | 1.187 | 1.447 | 1.000 | 1.484 | 3.621 | 3.844 | 1.995 | 1.313 |
| 15150 | 2.274 | 1.266 | 4.526 | 2.591 | 5.409 | 3.138 | 2.675 | 1.391 |
| 15159 | 1.187 | 1.447 | 1.000 | 1.484 | 3.621 | 3.844 | 1.995 | 1.313 |
| 15279 | 1.000 | 2.819 | 1.000 | 1.589 | 1.238 | 1.784 | 0.748 | 2.486 |
| 15293 | 1.971 | 1.699 | 2.355 | 1.453 | 3.122 | 2.528 | 1.949 | 1.326 |
| 15299 | 1.422 | 2.018 | 2.385 | 1.218 | 2.039 | 3.486 | 1.636 | 1.623 |
| 15341 | 1.677 | 2.420 | 2.263 | 1.314 | 1.473 | 2.523 | 1.776 | 2.244 |

TABLE 117-continued

| SEQ ID NO | P268 | P278 | P295 | P339 | P341 | P356 | P360 | P392 |
|---|---|---|---|---|---|---|---|---|
| 15347 | 1.677 | 2.420 | 2.263 | 1.314 | 1.473 | 2.523 | 1.776 | 2.244 |
| 15373 | 2.516 | 0.852 | 1.775 | 0.818 | 4.294 | 2.281 | 1.119 | 0.890 |
| 15379 | 1.677 | 2.420 | 2.263 | 1.314 | 1.473 | 2.523 | 1.776 | 2.244 |
| 15408 | 1.794 | 1.486 | 5.006 | 0.398 | 4.768 | 0.001 | 2.344 | 2.434 |
| 15413 | 2.079 | 1.664 | 1.000 | 1.871 | 2.812 | 2.693 | 5.094 | 1.947 |
| 15453 | 2.325 | 2.043 | 2.530 | 2.411 | 5.749 | 5.509 | 3.490 | 2.008 |
| 15455 | 1.000 | 1.320 | 0.556 | 1.385 | 1.321 | 1.000 | 1.000 | 6.185 |
| 15460 | 1.677 | 2.420 | 2.263 | 1.314 | 1.473 | 2.523 | 1.776 | 2.244 |
| 15470 | 1.187 | 1.447 | 1.000 | 1.484 | 3.621 | 3.844 | 1.995 | 1.313 |
| 15476 | 1.977 | 1.676 | 1.774 | 1.542 | 2.538 | 1.867 | 2.312 | 1.000 |
| 15490 | 2.942 | 0.729 | 1.772 | 0.861 | 15.794 | 2.349 | 1.363 | 0.808 |
| 15494 | 1.457 | 1.690 | 2.551 | 1.860 | 4.114 | 3.548 | 3.125 | 0.792 |
| 15519 | 1.187 | 1.447 | 1.000 | 1.484 | 3.621 | 3.844 | 1.995 | 1.313 |
| 15525 | 1.586 | 1.943 | 1.000 | 0.699 | 1.593 | 2.039 | 1.798 | 0.774 |
| 15535 | 2.157 | 1.922 | 3.895 | 4.143 | 2.655 | 1.914 | 2.159 | 3.312 |
| 15537 | 3.442 | 3.933 | 5.994 | 1.448 | 8.695 | 7.488 | 2.687 | 2.449 |
| 15551 | 2.467 | 1.000 | 7.584 | 1.417 | 3.693 | 1.947 | 1.539 | 4.429 |
| 15564 | 1.000 | 2.819 | 1.000 | 1.589 | 1.238 | 1.784 | 0.748 | 2.486 |
| 15570 | 1.000 | 2.819 | 1.000 | 1.589 | 1.238 | 1.784 | 0.748 | 2.486 |
| 15577 | 1.422 | 2.018 | 2.385 | 1.218 | 2.039 | 3.486 | 1.636 | 1.623 |
| 15579 | 2.485 | 2.369 | 1.000 | 1.820 | 3.354 | 5.046 | 1.820 | 0.703 |
| 15583 | 3.203 | 1.593 | 4.012 | 1.593 | 6.374 | 6.940 | 3.158 | 0.947 |
| 15584 | 1.268 | 1.563 | 1.870 | 2.056 | 6.240 | 6.491 | 2.230 | 1.427 |
| 15586 | 1.422 | 2.018 | 2.385 | 1.218 | 2.039 | 3.486 | 1.636 | 1.623 |
| 15597 | 2.439 | 1.482 | 2.156 | 1.390 | 3.500 | 3.654 | 1.655 | 0.771 |
| 15618 | 2.448 | 2.617 | 4.003 | 1.289 | 2.940 | 3.894 | 2.277 | 1.202 |
| 15654 | 2.328 | 1.359 | 9.253 | 0.383 | 1.835 | 0.001 | 1.000 | 0.714 |

TABLE 118

| SEQ ID NO | P393 | P413 | P505 | P517 | P534 | P546 | P577 | P695 |
|---|---|---|---|---|---|---|---|---|
| 13288 | 1.058 | 2.471 | 1.583 | 1.726 | 0.506 | 1.431 | 2.632 | 5.930 |
| 13292 | 14.260 | 2.516 | 1.498 | 3.747 | 1.300 | 5.779 | 11.202 | 0.001 |
| 13397 | 1.000 | 0.001 | 1.000 | 1.000 | 0.001 | 1.000 | 3.303 | 1.000 |
| 13409 | 1.000 | 1.000 | 0.458 | 1.249 | 0.001 | 1000.000 | 0.702 | 1.000 |
| 13418 | 1.000 | 0.001 | 1.000 | 1.000 | 0.001 | 1.000 | 3.303 | 1.000 |
| 13425 | 1.137 | 2.268 | 2.414 | 1.382 | 2.107 | 2.210 | 2.384 | 5.256 |
| 13516 | 0.741 | 2.181 | 2.494 | 1.504 | 1.511 | 1.831 | 2.064 | 4.421 |
| 13542 | 1.348 | 2.222 | 2.506 | 1.355 | 1.670 | 2.535 | 1.556 | 8.411 |
| 13543 | 1.000 | 1.000 | 1000.000 | 1.477 | 1.645 | 1.000 | 1.389 | 1.000 |
| 13549 | 0.914 | 1.603 | 1.936 | 1.485 | 2.430 | 1.999 | 1.647 | 4.375 |
| 13568 | 1.000 | 1.000 | 1000.000 | 1.477 | 1.645 | 1.000 | 1.389 | 1.000 |
| 13599 | 1.000 | 1.000 | 1.436 | 0.517 | 1.000 | 1.469 | 1.000 | 1.000 |
| 13623 | 1.137 | 2.268 | 2.414 | 1.382 | 2.107 | 2.210 | 2.384 | 5.256 |
| 13624 | 1.224 | 3.432 | 2.806 | 1.328 | 2.470 | 2.592 | 1.929 | 6.973 |
| 13651 | 1.000 | 0.001 | 1.000 | 1.000 | 0.001 | 1.000 | 3.303 | 1.000 |
| 13659 | 1.000 | 1.000 | 1.436 | 0.517 | 1.000 | 1.469 | 1.000 | 1.000 |
| 13675 | 1.241 | 1.841 | 1.470 | 1.000 | 1.672 | 2.218 | 1.649 | 7.555 |
| 13676 | 1.241 | 1.841 | 1.470 | 1.000 | 1.672 | 2.218 | 1.649 | 7.555 |
| 13682 | 1.258 | 2.153 | 1.849 | 1.445 | 1.000 | 1.531 | 1.637 | 3.302 |
| 13691 | 1.000 | 1.327 | 2.871 | 1.116 | 1.903 | 2.200 | 2.644 | 0.001 |
| 13735 | 1.000 | 1.000 | 0.458 | 1.249 | 0.001 | 1000.000 | 0.702 | 1.000 |
| 13804 | 1.241 | 1.841 | 1.470 | 1.000 | 1.672 | 2.218 | 1.649 | 7.555 |
| 13808 | 1.560 | 1.982 | 2.159 | 1.278 | 1.425 | 1.204 | 3.046 | 2.068 |
| 13835 | 1.137 | 2.268 | 2.414 | 1.382 | 2.107 | 2.210 | 2.384 | 5.256 |
| 13927 | 0.763 | 1.602 | 2.797 | 1.265 | 2.765 | 2.236 | 2.548 | 5.071 |
| 13940 | 1.710 | 2.337 | 1.898 | 0.892 | 1.347 | 1.908 | 1.136 | 3.404 |
| 14009 | 2.102 | 1.689 | 4.429 | 0.830 | 1.000 | 1.000 | 2.108 | 2.208 |
| 14011 | 1.935 | 1.911 | 2.812 | 1.000 | 1.854 | 1.793 | 2.441 | 0.001 |
| 14014 | 1.320 | 1.404 | 1.553 | 1.000 | 1.957 | 1.816 | 2.156 | 3.745 |
| 14025 | 1.219 | 2.547 | 1.288 | 2.539 | 3.936 | 3.625 | 2.363 | 1.955 |
| 14027 | 0.851 | 0.750 | 0.815 | 0.258 | 0.712 | 1.229 | 0.190 | 1.000 |
| 14080 | 1.219 | 2.547 | 1.288 | 2.539 | 3.936 | 3.625 | 2.363 | 1.955 |
| 14081 | 1.219 | 2.547 | 1.288 | 2.539 | 3.936 | 3.625 | 2.363 | 1.955 |
| 14115 | 2.765 | 1.000 | 2.202 | 0.472 | 0.490 | 1.417 | 0.725 | 0.001 |
| 14131 | 1.000 | 1.000 | 1.000 | 1.000 | 1.000 | 1.530 | 0.769 | 1.000 |
| 14185 | 1.058 | 2.471 | 1.583 | 1.726 | 0.506 | 1.431 | 2.632 | 5.930 |
| 14224 | 1.000 | 1.000 | 1.000 | 1.000 | 1.000 | 1.530 | 0.769 | 1.000 |
| 14225 | 1.322 | 2.608 | 1.910 | 1.199 | 1.635 | 1.893 | 1.473 | 5.842 |
| 14261 | 1.322 | 2.608 | 1.910 | 1.199 | 1.635 | 1.893 | 1.473 | 5.842 |
| 14305 | 1.710 | 2.337 | 1.898 | 0.892 | 1.347 | 1.908 | 1.136 | 3.404 |
| 14319 | 2.102 | 1.689 | 4.429 | 0.830 | 1.000 | 1.000 | 2.108 | 2.208 |

TABLE 118-continued

| SEQ ID NO | P393 | P413 | P505 | P517 | P534 | P546 | P577 | P695 |
|---|---|---|---|---|---|---|---|---|
| 14320 | 1.322 | 2.608 | 1.910 | 1.199 | 1.635 | 1.893 | 1.473 | 5.842 |
| 14505 | 1.137 | 2.268 | 2.414 | 1.382 | 2.107 | 2.210 | 2.384 | 5.256 |
| 14562 | 1.000 | 1.518 | 1.980 | 1.518 | 2.526 | 1.588 | 1.865 | 2.251 |
| 14583 | 1.710 | 2.337 | 1.898 | 0.892 | 1.347 | 1.908 | 1.136 | 3.404 |
| 14601 | 0.743 | 2.126 | 1.613 | 1.177 | 2.128 | 1.000 | 1.951 | 6.931 |
| 14604 | 1.224 | 3.432 | 2.806 | 1.328 | 2.470 | 2.592 | 1.929 | 6.973 |
| 14688 | 1.058 | 2.471 | 1.583 | 1.726 | 0.506 | 1.431 | 2.632 | 5.930 |
| 14689 | 1.137 | 2.268 | 2.414 | 1.382 | 2.107 | 2.210 | 2.384 | 5.256 |
| 14690 | 1.205 | 3.301 | 2.749 | 1.256 | 2.474 | 2.345 | 1.826 | 8.108 |
| 14747 | 1.205 | 3.301 | 2.749 | 1.256 | 2.474 | 2.345 | 1.826 | 8.108 |
| 14824 | 1.000 | 1.793 | 2.719 | 1.679 | 1.000 | 1.549 | 2.076 | 0.001 |
| 14849 | 0.741 | 2.181 | 2.494 | 1.504 | 1.511 | 1.831 | 2.064 | 4.421 |
| 14870 | 1.137 | 2.268 | 2.414 | 1.382 | 2.107 | 2.210 | 2.384 | 5.256 |
| 14909 | 1.348 | 2.222 | 2.506 | 1.355 | 1.670 | 2.535 | 1.556 | 8.411 |
| 14927 | 2.809 | 1.534 | 1.366 | 1.197 | 2.545 | 1.964 | 1.506 | 0.001 |
| 14949 | 1.000 | 1.793 | 2.719 | 1.679 | 1.000 | 1.549 | 2.076 | 0.001 |
| 15014 | 1.249 | 2.009 | 1.832 | 1.488 | 1.379 | 1.975 | 2.128 | 13.930 |
| 15117 | 1.781 | 2.929 | 2.183 | 2.759 | 3.853 | 3.092 | 2.051 | 7.549 |
| 15147 | 1.137 | 2.268 | 2.414 | 1.382 | 2.107 | 2.210 | 2.384 | 5.256 |
| 15150 | 1.000 | 3.187 | 2.564 | 0.756 | 1.226 | 3.841 | 3.201 | 16.724 |
| 15159 | 1.137 | 2.268 | 2.414 | 1.382 | 2.107 | 2.210 | 2.384 | 5.256 |
| 15279 | 1.058 | 2.471 | 1.583 | 1.726 | 0.506 | 1.431 | 2.632 | 5.930 |
| 15293 | 1.952 | 1.472 | 1.917 | 1.516 | 2.305 | 2.677 | 2.620 | 2.660 |
| 15299 | 0.741 | 2.181 | 2.494 | 1.504 | 1.511 | 1.831 | 2.064 | 4.421 |
| 15341 | 1.710 | 2.337 | 1.898 | 0.892 | 1.347 | 1.908 | 1.136 | 3.404 |
| 15347 | 1.710 | 2.337 | 1.898 | 0.892 | 1.347 | 1.908 | 1.136 | 3.404 |
| 15373 | 0.537 | 1.790 | 0.727 | 0.750 | 0.329 | 1.100 | 1.239 | 0.001 |
| 15379 | 1.710 | 2.337 | 1.898 | 0.892 | 1.347 | 1.908 | 1.136 | 3.404 |
| 15408 | 0.852 | 1.789 | 3.765 | 0.686 | 3.176 | 1.591 | 1.852 | 0.001 |
| 15413 | 2.044 | 17.760 | 4.034 | 1.988 | 0.026 | 3.908 | 2.394 | 42.662 |
| 15453 | 1.088 | 5.833 | 3.519 | 1.572 | 2.641 | 4.011 | 1.695 | 7.783 |
| 15455 | 1.219 | 2.547 | 1.288 | 2.539 | 3.936 | 3.625 | 2.363 | 1.955 |
| 15460 | 1.710 | 2.337 | 1.898 | 0.892 | 1.347 | 1.908 | 1.136 | 3.404 |
| 15470 | 1.137 | 2.268 | 2.414 | 1.382 | 2.107 | 2.210 | 2.384 | 5.256 |
| 15476 | 1.000 | 3.033 | 1.912 | 1.699 | 2.147 | 2.780 | 2.155 | 2.518 |
| 15490 | 0.337 | 2.339 | 0.768 | 0.563 | 0.359 | 1.242 | 1.492 | 1.000 |
| 15494 | 1.000 | 2.266 | 2.040 | 1.000 | 2.747 | 2.620 | 1.718 | 14.145 |
| 15519 | 1.137 | 2.268 | 2.414 | 1.382 | 2.107 | 2.210 | 2.384 | 5.256 |
| 15525 | 1.243 | 1.766 | 1.547 | 0.843 | 1.000 | 1.498 | 2.122 | 4.421 |
| 15535 | 5.268 | 1.518 | 2.253 | 3.678 | 0.766 | 1.565 | 1.000 | 1.853 |
| 15537 | 0.815 | 2.497 | 3.234 | 2.275 | 2.344 | 3.596 | 5.023 | 12.124 |
| 15551 | 1.128 | 0.885 | 1.237 | 1.434 | 3.327 | 3.206 | 1.355 | 0.001 |
| 15564 | 1.058 | 2.471 | 1.583 | 1.726 | 0.506 | 1.431 | 2.632 | 5.930 |
| 15570 | 1.058 | 2.471 | 1.583 | 1.726 | 0.506 | 1.431 | 2.632 | 5.930 |
| 15577 | 0.741 | 2.181 | 2.494 | 1.504 | 1.511 | 1.831 | 2.064 | 4.421 |
| 15579 | 1.240 | 2.239 | 2.841 | 1.000 | 2.270 | 2.614 | 0.583 | 5.244 |
| 15583 | 0.633 | 2.821 | 2.976 | 1.253 | 1.675 | 3.657 | 2.284 | 8.587 |
| 15584 | 1.348 | 2.222 | 2.506 | 1.355 | 1.670 | 2.535 | 1.556 | 8.411 |
| 15586 | 0.741 | 2.181 | 2.494 | 1.504 | 1.511 | 1.831 | 2.064 | 4.421 |
| 15597 | 1.000 | 1.801 | 1.978 | 1.000 | 3.188 | 1.607 | 2.276 | 13.068 |
| 15618 | 0.790 | 3.524 | 3.377 | 2.062 | 2.123 | 1.959 | 1.626 | 1.000 |
| 15654 | 0.001 | 1.346 | 1.831 | 1.000 | 1.646 | 1.944 | 1.549 | 1.000 |

TABLE 119

| SEQ ID NO | P784 | P786 | P791 | P888 | P889 |
|---|---|---|---|---|---|
| 13288 | 1.000 | 1.000 | 4.202 | 1.464 | 2.147 |
| 13292 | 1.000 | 1.276 | 14.034 | 4.139 | 3.640 |
| 13397 | 1.708 | 2.247 | 1.000 | 0.441 | 0.001 |
| 13409 | 1.391 | 1.857 | 1.000 | 0.402 | 1.000 |
| 13418 | 1.708 | 2.247 | 1.000 | 0.441 | 0.001 |
| 13425 | 1.328 | 1.421 | 2.456 | 1.910 | 2.069 |
| 13516 | 1.243 | 1.679 | 2.228 | 2.333 | 1.774 |
| 13542 | 0.819 | 1.632 | 2.808 | 5.465 | 2.307 |
| 13543 | 1000.000 | 0.758 | 1.000 | 1.000 | 1.000 |
| 13549 | 1.000 | 1.000 | 1.834 | 2.776 | 1.636 |
| 13568 | 1000.000 | 0.758 | 1.000 | 1.000 | 1.000 |
| 13599 | 1.000 | 1.000 | 1.000 | 0.642 | 1.000 |
| 13623 | 1.328 | 1.421 | 2.456 | 1.910 | 2.069 |
| 13624 | 1.000 | 1.416 | 2.862 | 2.690 | 1.645 |
| 13651 | 1.708 | 2.247 | 1.000 | 0.441 | 0.001 |
| 13659 | 1.000 | 1.000 | 1.000 | 0.642 | 1.000 |
| 13675 | 1.000 | 1.821 | 1.628 | 2.276 | 2.501 |
| 13676 | 1.000 | 1.821 | 1.628 | 2.276 | 2.501 |
| 13682 | 1.000 | 1.888 | 1.915 | 2.276 | 1.481 |
| 13691 | 3.336 | 1.677 | 2.208 | 1.000 | 1.976 |
| 13735 | 1.391 | 1.857 | 1.000 | 0.402 | 1.000 |
| 13804 | 1.000 | 1.821 | 1.628 | 2.276 | 2.501 |
| 13808 | 1.000 | 1.629 | 2.152 | 1.000 | 1.792 |
| 13835 | 1.328 | 1.421 | 2.456 | 1.910 | 2.069 |
| 13927 | 1.000 | 1.997 | 2.083 | 3.178 | 3.444 |
| 13940 | 1.000 | 1.780 | 1.000 | 2.177 | 2.258 |
| 14009 | 1.356 | 0.696 | 1.000 | 1.000 | 1.463 |
| 14011 | 2.324 | 1.000 | 2.379 | 1.407 | 2.833 |
| 14014 | 2.137 | 1.934 | 2.482 | 2.035 | 3.980 |
| 14025 | 0.796 | 1.000 | 1.737 | 1.000 | 2.218 |
| 14027 | 2.531 | 3.138 | 0.395 | 1.000 | 1.000 |
| 14080 | 0.796 | 1.000 | 1.737 | 1.000 | 2.218 |

TABLE 119-continued

| SEQ ID NO | P784 | P786 | P791 | P888 | P889 |
|---|---|---|---|---|---|
| 14081 | 0.796 | 1.000 | 1.737 | 1.000 | 2.218 |
| 14115 | 1000.000 | 1.984 | 1000.000 | 1.374 | 1.000 |
| 14131 | 3.031 | 1.000 | 1.000 | 1.000 | 1.000 |
| 14185 | 1.000 | 1.000 | 4.202 | 1.464 | 2.147 |
| 14224 | 3.031 | 1.000 | 1.000 | 1.000 | 1.000 |
| 14225 | 0.876 | 1.781 | 2.424 | 4.143 | 1.977 |
| 14261 | 0.876 | 1.781 | 2.424 | 4.143 | 1.977 |
| 14305 | 1.000 | 1.780 | 1.000 | 2.177 | 2.258 |
| 14319 | 1.356 | 0.696 | 1.000 | 1.000 | 1.463 |
| 14320 | 0.876 | 1.781 | 2.424 | 4.143 | 1.977 |
| 14505 | 1.328 | 1.421 | 2.456 | 1.910 | 2.069 |
| 14562 | 1.000 | 1.000 | 1.992 | 2.144 | 1.615 |
| 14583 | 1.000 | 1.780 | 1.000 | 2.177 | 2.258 |
| 14601 | 1.290 | 1.000 | 1.000 | 1.995 | 2.203 |
| 14604 | 1.000 | 1.416 | 2.862 | 2.690 | 1.645 |
| 14688 | 1.000 | 1.000 | 4.202 | 1.464 | 2.147 |
| 14689 | 1.328 | 1.421 | 2.456 | 1.910 | 2.069 |
| 14690 | 0.816 | 1.000 | 2.196 | 2.446 | 1.518 |
| 14747 | 0.816 | 1.000 | 2.196 | 2.446 | 1.518 |
| 14824 | 1.585 | 1.889 | 2.178 | 1.806 | 1.867 |
| 14849 | 1.243 | 1.679 | 2.228 | 2.333 | 1.774 |
| 14870 | 1.328 | 1.421 | 2.456 | 1.910 | 2.069 |
| 14909 | 0.819 | 1.632 | 2.808 | 5.465 | 2.307 |
| 14927 | 2.810 | 2.638 | 1.976 | 1.491 | 2.955 |
| 14949 | 1.585 | 1.889 | 2.178 | 1.806 | 1.867 |
| 15014 | 1.253 | 1.994 | 1.874 | 3.193 | 2.663 |
| 15117 | 1.559 | 2.762 | 5.043 | 4.135 | 3.753 |
| 15147 | 1.328 | 1.421 | 2.456 | 1.910 | 2.069 |
| 15150 | 1.306 | 1.940 | 2.293 | 3.897 | 1.624 |
| 15159 | 1.328 | 1.421 | 2.456 | 1.910 | 2.069 |
| 15279 | 1.000 | 1.000 | 4.202 | 1.464 | 2.147 |
| 15293 | 1.511 | 1.357 | 1.632 | 1.891 | 1.895 |
| 15299 | 1.243 | 1.679 | 2.228 | 2.333 | 1.774 |
| 15341 | 1.000 | 1.780 | 1.000 | 2.177 | 2.258 |
| 15347 | 1.000 | 1.780 | 1.000 | 2.177 | 2.258 |
| 15373 | 0.573 | 2.678 | 1.000 | 2.507 | 3.278 |
| 15379 | 1.000 | 1.780 | 1.000 | 2.177 | 2.258 |
| 15408 | 7.866 | 1.000 | 1000.000 | 1.719 | 1.000 |
| 15413 | 2.625 | 2.744 | 4.155 | 2.105 | 4.438 |
| 15453 | 1.000 | 2.139 | 3.014 | 3.159 | 3.381 |
| 15455 | 0.796 | 1.000 | 1.737 | 1.000 | 2.218 |
| 15460 | 1.000 | 1.780 | 1.000 | 2.177 | 2.258 |
| 15470 | 1.328 | 1.421 | 2.456 | 1.910 | 2.069 |
| 15476 | 1.489 | 2.750 | 2.910 | 5.049 | 4.006 |
| 15490 | 0.419 | 3.014 | 0.575 | 2.397 | 3.558 |
| 15494 | 1.000 | 1.815 | 2.513 | 3.487 | 2.180 |
| 15519 | 1.328 | 1.421 | 2.456 | 1.910 | 2.069 |
| 15525 | 1.000 | 1.493 | 2.186 | 1.000 | 2.222 |
| 15535 | 1.267 | 3.638 | 1.623 | 5.889 | 3.339 |
| 15537 | 1.746 | 2.363 | 5.515 | 2.674 | 3.637 |
| 15551 | 2.399 | 3.587 | 3.625 | 2.567 | 2.417 |
| 15564 | 1.000 | 1.000 | 4.202 | 1.464 | 2.147 |
| 15570 | 1.000 | 1.000 | 4.202 | 1.464 | 2.147 |
| 15577 | 1.243 | 1.679 | 2.228 | 2.333 | 1.774 |
| 15579 | 0.397 | 1.000 | 1.472 | 5.315 | 2.250 |
| 15583 | 1.000 | 1.939 | 2.505 | 4.525 | 2.674 |
| 15584 | 0.819 | 1.632 | 2.808 | 5.465 | 2.307 |
| 15586 | 1.243 | 1.679 | 2.228 | 2.333 | 1.774 |
| 15597 | 1.295 | 1.658 | 2.836 | 2.766 | 2.873 |
| 15618 | 2.167 | 2.157 | 3.410 | 2.828 | 3.794 |
| 15654 | 1.352 | 1.000 | 2.727 | 0.583 | 1.000 |

In general, a polynucleotide is said to represent a significantly differentially expressed gene between two samples when there is detectable levels of expression in at least one sample and the ratio value is greater than at least about 1.2 fold, preferably greater than at least about 1.5 fold, more preferably greater than at least about 2 fold, where the ratio value is calculated using the method described above.

A differential expression ratio of 1 indicates that the expression level of the gene in the tumor cell was not statistically different from expression of that gene in normal colon cells of the same patient. A differential expression ratio significantly greater than 1 in cancerous colon cells relative to normal colon cells indicates that the gene is increased in expression in cancerous cells relative to normal cells, indicating that the gene plays a role in the development of the cancerous phenotype, and may be involved in promoting metastasis of the cell. Detection of gene products from such genes can provide an indicator that the cell is cancerous, and may provide a therapeutic and/or diagnostic target.

Likewise, a differential expression ratio significantly less than 1 in cancerous colon cells relative to normal colon cells indicates that, for example, the gene is involved in suppression of the cancerous phenotype. Increasing activity of the gene product encoded by such a gene, or replacing such activity, can provide the basis for chemotherapy. Such gene can also serve as markers of cancerous cells, e.g., the absence or decreased presence of the gene product in a colon cell relative to a normal colon cell indicates that the cell may be cancerous.

Example 76

Functional Analysis of Gene Products Differentially Expressed in Cancer in Patients The gene products of genes differentially expressed in cancerous cells are further analyzed to confirm the role and function of the gene product in tumorgenesis, e.g., in promoting or inhibiting development of a metastatic phenotype.

Blocking Expression of Gene Products Using Antisense

The effect of single genes upon development of cancer is assessed through use of antisense oligonucleotides specific for sequences corresponding to a selected sequence. Antisense oligonucleotides are prepared based upon a selected sequence that corresponds to a gene of interest. The antisense oligonucleotide is introduced into a test cell and the effect upon expression of the corresponding gene, as well as the effect upon a phenotype of interest assessed (e.g., a normal cell is examined for induction of the cancerous phenotype, or a cancerous cell is examined for suppression of a cancerous phenotype (e.g., suppression of metastasis)).

Blocking Function of Gene Products Using Gene Product-Specific Antibodies and/or Small Molecule Inhibitors The function of gene products corresponding to genes/clusters identified herein can be assessed by blocking function of the gene products in the cell. For example, where the gene product is secreted, blocking antibodies can generated and added to cells to examine the effect upon the cell phenotype in the context of, for example, the transformation of the cell to a cancerous, particularly a metastatic, phenotype. In order to generate antibodies, a clone corresponding to a selected gene product/cluster is selected, and a sequence that represents a partial or complete coding sequence is obtained. The resulting clone is then expressed, the polypeptide produced isolated, and antibodies generated. The antibodies are then combined with cells and the effect upon tumorigenesis assessed.

Where the gene product of the gene/clusters identified herein exhibits sequence homology to a protein of known function (e.g., to a specific kinase or protease) and/or to a protein family of known function (e.g., contains a domain or other consensus sequence present in a protease family or in a kinase family), then the role of the gene product in tumorigenesis, as well as the activity of the gene product, can be examined using small molecule that inhibit or enhance function of the corresponding protein or protein family.

Those skilled in the art will recognize, or be able to ascertain, using not more than routine experimentation, many equivalents to the specific embodiments of the invention described herein. Such specific embodiments and equivalents are intended to be encompassed by the following claims.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

Deposit Information. The following materials were deposited with the American Type Culture Collection (CMCC=Chiron Master Culture Collection).

TABLE 111

Cell Lines Deposited with ATCC

| Cell Line | Deposit Date | ATCC Accession No. | CMCC Accession No. |
|---|---|---|---|
| KM12L4 | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

In addition, pools of selected clones, as well as libraries containing specific clones, were assigned an "ES" number (internal reference) and deposited with the ATCC. Table 112 (inserted before the claims) provides the ATCC Accession Nos. and internal references (CMCC Nos.) of the ES deposits, all of which were deposited on or before the filing date of the present application. The names of the clones contained within each of these deposits are provided in Table 113 (inserted before the claims).

TABLE 112

| ES # | CMCC# | ATCC Deposit# |
|---|---|---|
| 85 | 5175 | PTA-1313 |
| 86 | 5176 | PTA-1314 |
| 87 | 5177 | PTA-1315 |
| 88 | 5178 | PTA-1316 |
| 89 | 5179 | PTA-1317 |
| 90 | 5180 | PTA-1318 |
| 91 | 5181 | PTA-1319 |
| 92 | 5182 | PTA-1320 |
| 93 | 5183 | PTA-1321 |
| 94 | 5184 | PTA-1322 |
| 95 | 5185 | PTA-1323 |
| 96 | 5186 | PTA-1324 |
| 97 | 5187 | PTA-1325 |
| 98 | 5188 | PTA-1326 |
| 99 | 5189 | PTA-1327 |
| 100 | 5190 | PTA-1328 |
| 101 | 5191 | PTA-1329 |
| 102 | 5192 | PTA-1330 |
| 103 | 5193 | PTA-1331 |
| 104 | 5194 | PTA-1332 |
| 105 | 5195 | PTA-1333 |
| 106 | 5196 | PTA-1334 |
| 107 | 5197 | PTA-1335 |
| 108 | 5198 | PTA-1336 |
| 109 | 5199 | PTA-1372 |
| 110 | 5200 | PTA-1373 |

TABLE 112-continued

| ES # | CMCC# | ATCC Deposit# |
|---|---|---|
| 111 | 5201 | PTA-1374 |
| 112 | 5202 | PTA-1375 |
| 113 | 5203 | PTA-1376 |
| 114 | 5204 | PTA-1377 |
| 115 | 5205 | PTA-1378 |
| 116 | 5206 | PTA-1379 |
| 117 | 5207 | PTA-1380 |
| 118 | 5208 | PTA-1381 |
| 122 | 5212 | PTA-1382 |
| 123 | 5213 | PTA-1383 |
| 124 | 5214 | PTA-1384 |
| 125 | 5215 | PTA-1385 |
| 126 | 5216 | PTA-1386 |
| 127 | 5217 | PTA-1387 |
| 128 | 5218 | PTA-1388 |
| 129 | 5219 | PTA-1389 |
| 130 | 5220 | PTA-1390 |
| 131 | 5221 | PTA-1391 |
| 132 | 5222 | PTA-1392 |
| 133 | 5223 | PTA-1393 |
| 134 | 5209 | PTA-1431 |
| 135 | 5210 | PTA-1432 |
| 136 | 5238 | PTA-1497 |

TABLE 113

| ES No. | Clone Name |
|---|---|
| ES 85 | M00057077B:D02 |
| ES 85 | M00057078D:C12 |
| ES 85 | M00057079D:E09 |
| ES 85 | M00057080C:C02 |
| ES 85 | M00057085A:A03 |
| ES 85 | M00057088B:C02 |
| ES 85 | M00057091A:C03 |
| ES 85 | M00057091A:C04 |
| ES 85 | M00057091C:E12 |
| ES 85 | M00057093B:F09 |
| ES 85 | M00057099C:C08 |
| ES 85 | M00057100C:E09 |
| ES 85 | M00057100D:B03 |
| ES 85 | M00057103A:E11 |
| ES 85 | M00057103A:H09 |
| ES 85 | M00057104B:F08 |
| ES 85 | M00057106B:A03 |
| ES 85 | M00057106C:E02 |
| ES 85 | M00057106D:B06 |
| ES 85 | M00057108B:F04 |
| ES 85 | M00057108D:E09 |
| ES 85 | M00057108D:E09 |
| ES 85 | M00057112D:B09 |
| ES 85 | M00057114D:B10 |
| ES 85 | M00057117D:G11 |
| ES 85 | M00057118C:C02 |
| ES 85 | M00057120D:E12 |
| ES 85 | M00057124B:D10 |
| ES 85 | M00057127A:F11 |
| ES 85 | M00057127B:G07 |
| ES 85 | M00057130C:H11 |
| ES 85 | M00057131C:B01 |
| ES 85 | M00057132C:F08 |
| ES 85 | M00057133D:F01 |
| ES 85 | M00057134A:C01 |
| ES 85 | M00057134C:A01 |
| ES 85 | M00057134D:G10 |
| ES 85 | M00057135D:H04 |
| ES 85 | M00057136A:F01 |
| ES 85 | M00057141B:B02 |
| ES 85 | M00057141D:D02 |
| ES 85 | M00057142A:A07 |
| ES 85 | M00057143C:E05 |
| ES 85 | M00057145A:D05 |
| ES 85 | M00057146D:C09 |
| ES 85 | M00057147A:A01 |
| ES 85 | M00057150A:C10 |

TABLE 113-continued

| ES No. | Clone Name |
|---|---|
| ES 85 | M00057151A:B04 |
| ES 86 | M00057154A:D06 |
| ES 86 | M00057154C:B04 |
| ES 86 | M00057161B:E09 |
| ES 86 | M00057162A:C07 |
| ES 86 | M00057162B:H02 |
| ES 86 | M00057162D:D10 |
| ES 86 | M00057163D:B01 |
| ES 86 | M00057165D:E12 |
| ES 86 | M00057167B:E12 |
| ES 86 | M00057167B:G12 |
| ES 86 | M00057167D:B07 |
| ES 86 | M00057170C:H03 |
| ES 86 | M00057174B:C06 |
| ES 86 | M00057174B:G12 |
| ES 86 | M00057174C:H12 |
| ES 86 | M00057180A:H11 |
| ES 86 | M00057181C:D06 |
| ES 86 | M00057182D:B11 |
| ES 86 | M00057189B:G05 |
| ES 86 | M00057191A:A03 |
| ES 86 | M00057192B:E02 |
| ES 86 | M00057192D:G02 |
| ES 86 | M00057196A:E03 |
| ES 86 | M00057196C:F04 |
| ES 86 | M00057203C:E06 |
| ES 86 | M00057208A:A02 |
| ES 86 | M00057208C:C06 |
| ES 86 | M00057208C:D08 |
| ES 86 | M00057211B:F07 |
| ES 86 | M00057211D:A06 |
| ES 86 | M00057215B:B02 |
| ES 86 | M00057217B:B07 |
| ES 86 | M00057218D:C01 |
| ES 86 | M00057223C:C06 |
| ES 86 | M00057224B:C10 |
| ES 86 | M00057226D:C05 |
| ES 86 | M00057229D:F06 |
| ES 86 | M00057230C:D12 |
| ES 86 | M00057231C:G09 |
| ES 86 | M00057231D:A09 |
| ES 86 | M00057232B:D06 |
| ES 86 | M00057233A:F07 |
| ES 86 | M00057233D:E04 |
| ES 86 | M00057236B:H06 |
| ES 86 | M00057237A:B11 |
| ES 86 | M00057239A:G08 |
| ES 86 | M00057241B:B04 |
| ES 86 | M00057242B:F07 |
| ES 87 | M00057242D:B09 |
| ES 87 | M00057242D:H05 |
| ES 87 | M00057249A:C06 |
| ES 87 | M00057259A:H10 |
| ES 87 | M00057259B:B08 |
| ES 87 | M00057266C:D04 |
| ES 87 | M00057266C:G12 |
| ES 87 | M00057268C:E10 |
| ES 87 | M00057270B:H09 |
| ES 87 | M00057270C:E04 |
| ES 87 | M00057271C:E01 |
| ES 87 | M00057272A:B03 |
| ES 87 | M00057272C:H04 |
| ES 87 | M00057272D:A01 |
| ES 87 | M00057275B:A12 |
| ES 87 | M00057277B:C09 |
| ES 87 | M00057277B:E10 |
| ES 87 | M00057279A:G02 |
| ES 87 | M00057280C:A06 |
| ES 87 | M00057283A:E06 |
| ES 87 | M00057288D:E08 |
| ES 87 | M00057291C:B06 |
| ES 87 | M00057297A:F03 |
| ES 87 | M00057300B:F02 |
| ES 87 | M00057301B:H12 |
| ES 87 | M00057304A:E01 |
| ES 87 | M00057306B:H07 |
| ES 87 | M00057312B:E11 |
| ES 87 | M00057318B:B09 |
| ES 87 | M00057318C:A03 |
| ES 87 | M00057324A:D12 |
| ES 87 | M00057325C:C10 |
| ES 87 | M00057333A:F09 |
| ES 87 | M00057334B:F01 |
| ES 87 | M00057337B:G02 |
| ES 87 | M00057340B:C12 |
| ES 87 | M00042355A:G02 |
| ES 87 | M00042355D:C01 |
| ES 87 | M00042442D:A02 |
| ES 87 | M00042444D:G05 |
| ES 87 | M00042444D:H08 |
| ES 87 | M00042450D:H10 |
| ES 87 | M00042453C:E01 |
| ES 87 | M00042460D:A07 |
| ES 87 | M00042517C:F07 |
| ES 87 | M00042518D:A06 |
| ES 87 | M00042520A:F04 |
| ES 88 | M00042520A:F09 |
| ES 88 | M00042520A:F09 |
| ES 88 | M00043296C:B10 |
| ES 88 | M00043300A:H11 |
| ES 88 | M00043301A:F06 |
| ES 88 | M00043301D:H09 |
| ES 88 | M00043304A:D01 |
| ES 88 | M00043304B:C05 |
| ES 88 | M00043304B:C05 |
| ES 88 | M00043306D:B07 |
| ES 88 | M00043309D:H07 |
| ES 88 | M00043310C:B03 |
| ES 88 | M00043313A:A03 |
| ES 88 | M00043313A:G07 |
| ES 88 | M00043313D:C06 |
| ES 88 | M00043314C:H04 |
| ES 88 | M00043317A:H01 |
| ES 88 | M00043317C:F04 |
| ES 88 | M00043323C:D04 |
| ES 88 | M00043324D:D04 |
| ES 88 | M00043327D:H02 |
| ES 88 | M00043327D:H02 |
| ES 88 | M00043336B:E08 |
| ES 88 | M00043338B:B03 |
| ES 88 | M00043338B:A03 |
| ES 88 | M00043345B:C03 |
| ES 88 | M00043347B:G12 |
| ES 88 | M00043349A:C08 |
| ES 88 | M00043350B:H06 |
| ES 88 | M00043350C:H09 |
| ES 88 | M00043352A:E09 |
| ES 88 | M00043352D:B05 |
| ES 88 | M00043354D:C01 |
| ES 88 | M00043355D:H11 |
| ES 88 | M00043361D:D05 |
| ES 88 | M00043365A:C06 |
| ES 88 | M00043374A:B02 |
| ES 88 | M00043374B:B06 |
| ES 88 | M00043377A:C03 |
| ES 88 | M00043379D:C07 |
| ES 88 | M00043381B:E10 |
| ES 88 | M00043386D:A06 |
| ES 88 | M00043388D:C09 |
| ES 88 | M00043394B:B06 |
| ES 88 | M00043397B:B02 |
| ES 88 | M00043397C:B09 |
| ES 88 | M00043503C:C08 |
| ES 88 | M00043503E:E05 |
| ES 89 | M00043504A:G06 |
| ES 89 | M00043504D:G08 |
| ES 89 | M00043506A:H09 |
| ES 89 | M00043507A:D05 |
| ES 89 | M00043508A:A08 |
| ES 89 | M00043508D:C01 |
| ES 89 | M00054486A:B11 |
| ES 89 | M00054493A:A10 |
| ES 89 | M00054494A:E01 |
| ES 89 | M00054496A:B09 |
| ES 89 | M00054499B:E11 |
| ES 89 | M00054499B:E11 |

TABLE 113-continued

| ES No. | Clone Name |
|---|---|
| ES 89 | M00054502A:D01 |
| ES 89 | M00054502C:E02 |
| ES 89 | M00054507A:C11 |
| ES 89 | M00054510D:H09 |
| ES 89 | M00054513A:A12 |
| ES 89 | M00054518D:D03 |
| ES 89 | M00054520C:B05 |
| ES 89 | M00054521D:F04 |
| ES 89 | M00054522B:H11 |
| ES 89 | M00054523D:A10 |
| ES 89 | M00054524D:B02 |
| ES 89 | M00054534D:D02 |
| ES 89 | M00054535C:H09 |
| ES 89 | M00054542C:A08 |
| ES 89 | M00054551C:G03 |
| ES 89 | M00054555C:G12 |
| ES 89 | M00054561D:E06 |
| ES 89 | M00054563B:C09 |
| ES 89 | M00054568A:G11 |
| ES 89 | M00054569A:H07 |
| ES 89 | M00054571C:C01 |
| ES 89 | M00054572B:C01 |
| ES 89 | M00054575C:C01 |
| ES 89 | M00054580C:D11 |
| ES 89 | M00054583A:F05 |
| ES 89 | M00054587A:F09 |
| ES 89 | M00054590C:G02 |
| ES 89 | M00054591C:H07 |
| ES 89 | M00054595A:B02 |
| ES 89 | M00054595B:H09 |
| ES 89 | M00054596B:B07 |
| ES 89 | M00054600D:G07 |
| ES 89 | M00054601A:H10 |
| ES 89 | M00054601D:E08 |
| ES 89 | M00054602A:C04 |
| ES 90 | M00054602B:D02 |
| ES 90 | M00054604A:D09 |
| ES 90 | M00054604A:D09 |
| ES 90 | M00054605C:D01 |
| ES 90 | M00054609A:F01 |
| ES 90 | M00054609D:H06 |
| ES 90 | M00054611C:F02 |
| ES 90 | M00054613A:D09 |
| ES 90 | M00054613A:D09 |
| ES 90 | M00054617B:A09 |
| ES 90 | M00054621B:C06 |
| ES 90 | M00054621D:D11 |
| ES 90 | M00054629C:E09 |
| ES 90 | M00054636B:B03 |
| ES 90 | M00054636C:A02 |
| ES 90 | M00054636C:F02 |
| ES 90 | M00054638A:D09 |
| ES 90 | M00054638B:C08 |
| ES 90 | M00054646C:B01 |
| ES 90 | M00054647D:H02 |
| ES 90 | M00054648C:H10 |
| ES 90 | M00054660D:F05 |
| ES 90 | M00054665B:H08 |
| ES 90 | M00054665D:E11 |
| ES 90 | M00054677C:D02 |
| ES 90 | M00054678A:E07 |
| ES 90 | M00054679B:D12 |
| ES 90 | M00054680B:E06 |
| ES 90 | M00054680D:B11 |
| ES 90 | M00054681C:B02 |
| ES 90 | M00054684C:H12 |
| ES 90 | M00054689D:E12 |
| ES 90 | M00054691A:E05 |
| ES 90 | M00054692B:D01 |
| ES 90 | M00054694D:G04 |
| ES 90 | M00054706B:C09 |
| ES 90 | M00054707B:B08 |
| ES 90 | M00054707B:E05 |
| ES 90 | M00054713A:D12 |
| ES 90 | M00054720D:D12 |
| ES 90 | M00054720D:F11 |
| ES 90 | M00054721C:F11 |
| ES 90 | M00054722C:D01 |
| ES 90 | M00054722D:C08 |
| ES 90 | M00054726A:F08 |
| ES 90 | M00054727D:E10 |
| ES 90 | M00054727D:H06 |
| ES 90 | M00054728B:E08 |
| ES 91 | M00054728D:B10 |
| ES 91 | M00054729A:E01 |
| ES 91 | M00054731C:C12 |
| ES 91 | M00054732D:E03 |
| ES 91 | M00054734D:H10 |
| ES 91 | M00054739A:G03 |
| ES 91 | M00054739C:D03 |
| ES 91 | M00054739C:E06 |
| ES 91 | M00054740A:H08 |
| ES 91 | M00054741A:C10 |
| ES 91 | M00054741C:E10 |
| ES 91 | M00054741D:G10 |
| ES 91 | M00054743C:E02 |
| ES 91 | M00054745D:A03 |
| ES 91 | M00054747A:F01 |
| ES 91 | M00054747D:C06 |
| ES 91 | M00054750C:D12 |
| ES 91 | M00054752B:A07 |
| ES 91 | M00054755B:H06 |
| ES 91 | M00054759A:B08 |
| ES 91 | M00054760A:A12 |
| ES 91 | M00054762B:F07 |
| ES 91 | M00054765B:C05 |
| ES 91 | M00054766C:B04 |
| ES 91 | M00054769A:F07 |
| ES 91 | M00054772C:C06 |
| ES 91 | M00054773A:A12 |
| ES 91 | M00054776B:F01 |
| ES 91 | M00054779A:F07 |
| ES 91 | M00054780C:G08 |
| ES 91 | M00054781B:B04 |
| ES 91 | M00054802A:G02 |
| ES 91 | M00054804D:H12 |
| ES 91 | M00054808A:D07 |
| ES 91 | M00054808B:F08 |
| ES 91 | M00054810B:H02 |
| ES 91 | M00054812B:A05 |
| ES 91 | M00054812D:C07 |
| ES 91 | M00054812D:C07 |
| ES 91 | M00054815C:E01 |
| ES 91 | M00054816C:D11 |
| ES 91 | M00054821A:C11 |
| ES 91 | M00054823D:H07 |
| ES 91 | M00054826C:C10 |
| ES 91 | M00054826B:E05 |
| ES 91 | M00054826D:C10 |
| ES 91 | M00054827B:H01 |
| ES 92 | M00054832D:E09 |
| ES 92 | M00054836A:B05 |
| ES 92 | M00054839B:B02 |
| ES 92 | M00054839C:F06 |
| ES 92 | M00054841D:B07 |
| ES 92 | M00054841D:B07 |
| ES 92 | M00054842D:C11 |
| ES 92 | M00054844D:F06 |
| ES 92 | M00054849D:H11 |
| ES 92 | M00054851B:E03 |
| ES 92 | M00054854D:E08 |
| ES 92 | M00054856D:A02 |
| ES 92 | M00054857D:E12 |
| ES 92 | M00054862B:B07 |
| ES 92 | M00054863B:G03 |
| ES 92 | M00054865B:H04 |
| ES 92 | M00054866C:G07 |
| ES 92 | M00054867A:C07 |
| ES 92 | M00054867B:B02 |
| ES 92 | M00054867C:B07 |
| ES 92 | M00054869C:D01 |
| ES 92 | M00054870B:D09 |
| ES 92 | M00054875B:C04 |
| ES 92 | M00054876B:G03 |
| ES 92 | M00054877A:H12 |
| ES 92 | M00054895B:D09 |

TABLE 113-continued

| ES No. | Clone Name |
|---|---|
| ES 92 | M00054899D:F07 |
| ES 92 | M00054899D:G01 |
| ES 92 | M00054903D:C12 |
| ES 92 | M00054908B:F07 |
| ES 92 | M00054910D:G06 |
| ES 92 | M00054926D:F01 |
| ES 92 | M00054927B:E08 |
| ES 92 | M00054931C:A09 |
| ES 92 | M00054933A:D07 |
| ES 92 | M00054934C:D03 |
| ES 92 | M00054935A:E01 |
| ES 92 | M00054935A:G04 |
| ES 92 | M00054937A:B03 |
| ES 92 | M00054937B:A12 |
| ES 92 | M00054937B:F03 |
| ES 92 | M00054937C:B10 |
| ES 92 | M00054941C:G04 |
| ES 92 | M00054943C:C04 |
| ES 92 | M00054943D:C03 |
| ES 92 | M00054945C:G07 |
| ES 92 | M00054947B:G12 |
| ES 92 | M00054949A:E03 |
| ES 93 | M00054949C:A07 |
| ES 93 | M00054950D:G06 |
| ES 93 | M00054952A:F01 |
| ES 93 | M00054952C:H06 |
| ES 93 | M00054953D:G10 |
| ES 93 | M00054954B:C03 |
| ES 93 | M00054954D:F01 |
| ES 93 | M00054957A:B02 |
| ES 93 | M00054959C:C11 |
| ES 93 | M00054963C:H11 |
| ES 93 | M00054963D:H04 |
| ES 93 | M00054964A:H11 |
| ES 93 | M00054965B:H02 |
| ES 93 | M00054970D:G03 |
| ES 93 | M00054973B:A10 |
| ES 93 | M00054975C:C04 |
| ES 93 | M00054980D:C02 |
| ES 93 | M00054981C:E11 |
| ES 93 | M00054981D:C06 |
| ES 93 | M00054984D:B12 |
| ES 93 | M00054984D:C07 |
| ES 93 | M00054985C:F07 |
| ES 93 | M00054987D:C02 |
| ES 93 | M00054988C:G02 |
| ES 93 | M00054995A:C10 |
| ES 93 | M00054996C:B11 |
| ES 93 | M00054996C:C09 |
| ES 93 | M00054997C:B12 |
| ES 93 | M00054997C:H03 |
| ES 93 | M00055000C:F04 |
| ES 93 | M00055002D:E04 |
| ES 93 | M00055005B:H11 |
| ES 93 | M00055005D:B08 |
| ES 93 | M00055008A:B08 |
| ES 93 | M00055008D:B09 |
| ES 93 | M00055011C:E04 |
| ES 93 | M00055017A:A11 |
| ES 93 | M00055021D:D11 |
| ES 93 | M00055022A:H04 |
| ES 93 | M00055027B:D07 |
| ES 93 | M00055027D:F08 |
| ES 93 | M00055032D:A06 |
| ES 93 | M00055034C:G01 |
| ES 93 | M00055034D:H01 |
| ES 93 | M00055037A:E10 |
| ES 93 | M00055039A:G01 |
| ES 93 | M00055039C:E02 |
| ES 93 | M00055041A:E02 |
| ES 94 | M00055042A:B01 |
| ES 94 | M00055046B:C07 |
| ES 94 | M00055046C:E11 |
| ES 94 | M00055050C:G04 |
| ES 94 | M00055053C:B03 |
| ES 94 | M00055054A:C02 |
| ES 94 | M00055056D:B06 |
| ES 94 | M00055057A:F03 |
| ES 94 | M00055063D:G01 |
| ES 94 | M00055064A:E12 |
| ES 94 | M00055071B:A02 |
| ES 94 | M00055073C:H12 |
| ES 94 | M00055075B:H05 |
| ES 94 | M00055077C:F11 |
| ES 94 | M00055085A:A10 |
| ES 94 | M00055087A:A10 |
| ES 94 | M00055088A:A12 |
| ES 94 | M00055088C:E09 |
| ES 94 | M00055093B:H05 |
| ES 94 | M00055094B:H09 |
| ES 94 | M00055097A:G06 |
| ES 94 | M00055100B:D08 |
| ES 94 | M00055104C:B12 |
| ES 94 | M00055106A:D07 |
| ES 94 | M00055111B:D03 |
| ES 94 | M00055112A:C03 |
| ES 94 | M00055113B:A11 |
| ES 94 | M00055114A:D11 |
| ES 94 | M00055115A:E05 |
| ES 94 | M00055116B:B02 |
| ES 94 | M00055117C:C03 |
| ES 94 | M00055121D:C07 |
| ES 94 | M00055125B:E06 |
| ES 94 | M00055125B:F01 |
| ES 94 | M00055128D:B10 |
| ES 94 | M00055130D:G01 |
| ES 94 | M00055131C:B10 |
| ES 94 | M00055134B:E03 |
| ES 94 | M00055134B:H02 |
| ES 94 | M00055134D:B03 |
| ES 94 | M00055137C:C04 |
| ES 94 | M00055145A:F07 |
| ES 94 | M00055148D:D11 |
| ES 94 | M00055154C:F04 |
| ES 94 | M00055157A:C11 |
| ES 94 | M00055161D:A11 |
| ES 94 | M00055162A:F06 |
| ES 94 | M00055163A:C02 |
| ES 95 | M00055170A:F01 |
| ES 95 | M00055170D:E02 |
| ES 95 | M00055172D:D04 |
| ES 95 | M00055179C:D02 |
| ES 95 | M00055181A:E01 |
| ES 95 | M00055182B:C07 |
| ES 95 | M00055185C:B01 |
| ES 95 | M00055194D:C05 |
| ES 95 | M00055196B:A09 |
| ES 95 | M00055198D:F07 |
| ES 95 | M00055198D:G07 |
| ES 95 | M00055201D:A03 |
| ES 95 | M00055201D:B07 |
| ES 95 | M00055203B:H02 |
| ES 95 | M00055206A:H04 |
| ES 95 | M00055207D:A04 |
| ES 95 | M00055209D:A08 |
| ES 95 | M00055209D:D10 |
| ES 95 | M00055216A:A03 |
| ES 95 | M00055216A:A03 |
| ES 95 | M00055222D:H05 |
| ES 95 | M00055227A:H09 |
| ES 95 | M00055227D:E02 |
| ES 95 | M00055227D:E07 |
| ES 95 | M00055231A:D10 |
| ES 95 | M00055242A:E06 |
| ES 95 | M00055242A:A01 |
| ES 95 | M00055242D:D04 |
| ES 95 | M00055243A:F04 |
| ES 95 | M00055243A:G01 |
| ES 95 | M00055245B:A09 |
| ES 95 | M00055247B:A11 |
| ES 95 | M00055252A:C02 |
| ES 95 | M00055259D:F04 |
| ES 95 | M00055260B:A05 |
| ES 95 | M00055260C:F12 |
| ES 95 | M00055262C:B11 |
| ES 95 | M00055263A:G09 |

TABLE 113-continued

| ES No. | Clone Name |
|---|---|
| ES 95 | M00055271D:C05 |
| ES 95 | M00055273B:C05 |
| ES 95 | M00055274C:F02 |
| ES 95 | M00055279B:G08 |
| ES 95 | M00055279C:E12 |
| ES 95 | M00055283B:F05 |
| ES 95 | M00055283C:H02 |
| ES 95 | M00055289B:D02 |
| ES 95 | M00055294B:D04 |
| ES 96 | M00055302D:F02 |
| ES 96 | M00055306A:G09 |
| ES 96 | M00055319B:A01 |
| ES 96 | M00055322B:E01 |
| ES 96 | M00055324C:H10 |
| ES 96 | M00055325C:B12 |
| ES 96 | M00055327D:H08 |
| ES 96 | M00055332C:G11 |
| ES 96 | M00055334C:H09 |
| ES 96 | M00055335A:H03 |
| ES 96 | M00055338B:H07 |
| ES 96 | M00055344C:H09 |
| ES 96 | M00055345C:H11 |
| ES 96 | M00055346B:D02 |
| ES 96 | M00055350A:F01 |
| ES 96 | M00055356C:C06 |
| ES 96 | M00055358B:C01 |
| ES 96 | M00055361D:H01 |
| ES 96 | M00055363D:G12 |
| ES 96 | M00055364D:E01 |
| ES 96 | M00055368B:C10 |
| ES 96 | M00055368C:B06 |
| ES 96 | M00055371B:F01 |
| ES 96 | M00055373D:D10 |
| ES 96 | M00055374A:A08 |
| ES 96 | M00055376B:B01 |
| ES 96 | M00055379D:C08 |
| ES 96 | M00055381B:E09 |
| ES 96 | M00055383B:B04 |
| ES 96 | M00055383B:B04 |
| ES 96 | M00055384D:A03 |
| ES 96 | M00055385C:G06 |
| ES 96 | M00055388A:G08 |
| ES 96 | M00055388A:H08 |
| ES 96 | M00055390B:D08 |
| ES 96 | M00055391A:G08 |
| ES 96 | M00055391C:G06 |
| ES 96 | M00055395A:C02 |
| ES 96 | M00055396A:G07 |
| ES 96 | M00055404D:C07 |
| ES 96 | M00055405A:D09 |
| ES 96 | M00055405B:H05 |
| ES 96 | M00055405D:G07 |
| ES 96 | M00055406B:D05 |
| ES 96 | M00055408B:E09 |
| ES 96 | M00055408D:F03 |
| ES 96 | M00055413A:B07 |
| ES 96 | M00055414C:A11 |
| ES 97 | M00055415B:H11 |
| ES 97 | M00055417A:G08 |
| ES 97 | M00055419D:G01 |
| ES 97 | M00055420A:E06 |
| ES 97 | M00055420B:F10 |
| ES 97 | M00055420D:G04 |
| ES 97 | M00055421B:D04 |
| ES 97 | M00055421C:C11 |
| ES 97 | M00055423A:A10 |
| ES 97 | M00055423A:G08 |
| ES 97 | M00055423C:H10 |
| ES 97 | M00055425D:C05 |
| ES 97 | M00055472A:F02 |
| ES 97 | M00055472B:H03 |
| ES 97 | M00055475D:G08 |
| ES 97 | M00055479A:G02 |
| ES 97 | M00055479C:C12 |
| ES 97 | M00055480C:H10 |
| ES 97 | M00055482D:A01 |
| ES 97 | M00055484A:G07 |
| ES 97 | M00055485A:C09 |

TABLE 113-continued

| ES No. | Clone Name |
|---|---|
| ES 97 | M00055487B:F06 |
| ES 97 | M00001340A:E01 |
| ES 97 | M00001470C:G01 |
| ES 97 | M00001470C:G01 |
| ES 97 | M00001491B:C08 |
| ES 97 | M00001537D:F10 |
| ES 97 | M00001537D:F10 |
| ES 97 | M00001561B:G01 |
| ES 97 | M00001625A:B08 |
| ES 97 | M00001637A:D09 |
| ES 97 | M00003792B:A11 |
| ES 97 | M00003794C:D07 |
| ES 97 | M00003804C:A09 |
| ES 97 | M00003922B:H03 |
| ES 97 | M00003948A:B12 |
| ES 97 | M00003986D:G12 |
| ES 97 | M00003986D:G12 |
| ES 97 | M00004054C:G05 |
| ES 97 | M00004066C:D02 |
| ES 97 | M00004080A:A05 |
| ES 97 | M00004087D:B11 |
| ES 97 | M00004093D:C10 |
| ES 97 | M00004167C:D11 |
| ES 97 | M00004167C:D11 |
| ES 97 | M00004198B:A11 |
| ES 97 | M00004296D:G11 |
| ES 98 | M00004304A:D07 |
| ES 98 | M00004842C:B07 |
| ES 98 | M00004850C:G05 |
| ES 98 | M00004852D:A04 |
| ES 98 | M00004868B:D12 |
| ES 98 | M00004869D:D06 |
| ES 98 | M00004971B:G04 |
| ES 98 | M00004972C:E01 |
| ES 98 | M00005000B:H08 |
| ES 98 | M00005019D:D02 |
| ES 98 | M00005293B:D06 |
| ES 98 | M00005309D:E05 |
| ES 98 | M00005312A:D10 |
| ES 98 | M00005313C:B02 |
| ES 98 | M00005359A:A06 |
| ES 98 | M00005373D:H06 |
| ES 98 | M00005385C:A10 |
| ES 98 | M00005389C:C11 |
| ES 98 | M00005395A:D09 |
| ES 98 | M00005406C:A11 |
| ES 98 | M00005407B:E12 |
| ES 98 | M00005411C:C07 |
| ES 98 | M00005413C:F03 |
| ES 98 | M00005415C:F12 |
| ES 98 | M00005420B:C01 |
| ES 98 | M00005438B:A06 |
| ES 98 | M00005445C:A02 |
| ES 98 | M00005447C:D01 |
| ES 98 | M00005449C:E10 |
| ES 98 | M00005454B:C03 |
| ES 98 | M00005459B:B01 |
| ES 98 | M00005469B:A07 |
| ES 98 | M00005481D:C06 |
| ES 98 | M00005485B:B05 |
| ES 98 | M00005485D:A09 |
| ES 98 | M00005491B:H12 |
| ES 98 | M00005491D:B03 |
| ES 98 | M00005500B:E03 |
| ES 98 | M00005501B:E05 |
| ES 98 | M00005501D:G09 |
| ES 98 | M00005513B:F09 |
| ES 98 | M00005514C:A06 |
| ES 98 | M00005515B:H04 |
| ES 98 | M00005516D:H06 |
| ES 98 | M00005517B:F04 |
| ES 98 | M00005520C:E12 |
| ES 98 | M00005530C:A07 |
| ES 98 | M00005545B:A08 |
| ES 99 | M00005546A:G02 |
| ES 99 | M00005548A:A02 |
| ES 99 | M00005563C:B12 |
| ES 99 | M00005565A:F05 |

TABLE 113-continued

| ES No. | Clone Name |
|---|---|
| ES 99 | M00005568C:B09 |
| ES 99 | M00007926A:A07 |
| ES 99 | M00007926D:A05 |
| ES 99 | M00007927C:C01 |
| ES 99 | M00007931A:A10 |
| ES 99 | M00007935D:A05 |
| ES 99 | M00007936B:B09 |
| ES 99 | M00007936D:B09 |
| ES 99 | M00007939B:A03 |
| ES 99 | M00007943A:C02 |
| ES 99 | M00007951C:A05 |
| ES 99 | M00007953B:A01 |
| ES 99 | M00007953D:H09 |
| ES 99 | M00007954C:B04 |
| ES 99 | M00007961B:F05 |
| ES 99 | M00007964B:G01 |
| ES 99 | M00007965A:G10 |
| ES 99 | M00007965B:C03 |
| ES 99 | M00007965B:C03 |
| ES 99 | M00007981D:B04 |
| ES 99 | M00007982A:F11 |
| ES 99 | M00007983B:D03 |
| ES 99 | M00007983D:H06 |
| ES 99 | M00007990D:D03 |
| ES 99 | M00007991D:G01 |
| ES 99 | M00007992D:G08 |
| ES 99 | M00007994A:C11 |
| ES 99 | M00007994D:A05 |
| ES 99 | M00007998C:F07 |
| ES 99 | M00005589C:F07 |
| ES 99 | M00005610D:B11 |
| ES 99 | M00005619B:A09 |
| ES 99 | M00005621A:H08 |
| ES 99 | M00005627B:B10 |
| ES 99 | M00005628B:C10 |
| ES 99 | M00005632A:H02 |
| ES 99 | M00005650C:A06 |
| ES 99 | M00005650C:D04 |
| ES 99 | M00005655B:F08 |
| ES 99 | M00005675A:G02 |
| ES 99 | M00005685D:D12 |
| ES 99 | M00005704C:D10 |
| ES 99 | M00005708B:B07 |
| ES 100 | M00042455C:D11 |
| ES 100 | M00054826A:B05 |
| ES 100 | M00055281A:E08 |
| ES 100 | M00005657D:A12 |
| ES 100 | M00005710A:D01 |
| ES 100 | M00005765D:F07 |
| ES 100 | M00005766C:F10 |
| ES 100 | M00005769B:A03 |
| ES 100 | M00005782A:B10 |
| ES 100 | M00005800D:D11 |
| ES 100 | M00005802B:H10 |
| ES 100 | M00005810B:F07 |
| ES 100 | M00005810B:G10 |
| ES 100 | M00005813B:E10 |
| ES 100 | M00005818D:B09 |
| ES 100 | M00005819C:B11 |
| ES 100 | M00005826D:G10 |
| ES 100 | M00005830C:D10 |
| ES 100 | M00006576A:B04 |
| ES 100 | M00006583B:H03 |
| ES 100 | M00006587B:A08 |
| ES 100 | M00006588A:H06 |
| ES 100 | M00006590A:C10 |
| ES 100 | M00006610C:D08 |
| ES 100 | M00006630D:C11 |
| ES 100 | M00006638A:G02 |
| ES 100 | M00006641C:H03 |
| ES 100 | M00006641C:H03 |
| ES 100 | M00006648B:A05 |
| ES 100 | M00006649D:B11 |
| ES 100 | M00006650A:A03 |
| ES 100 | M00006650D:D05 |
| ES 100 | M00006664A:B09 |
| ES 100 | M00006679D:C04 |
| ES 100 | M00006686B:B07 |
| ES 100 | M00006695D:H08 |
| ES 100 | M00006695D:H08 |
| ES 100 | M00006704C:G06 |
| ES 100 | M00006705B:A09 |
| ES 100 | M00006705C:G09 |
| ES 100 | M00006712C:F02 |
| ES 100 | M00006719A:E12 |
| ES 100 | M00006719A:H07 |
| ES 100 | M00006731B:B02 |
| ES 100 | M00006731B:C08 |
| ES 100 | M00006731B:D03 |
| ES 100 | M00006731C:E01 |
| ES 100 | M00006734C:A08 |
| ES 100 | M00006737D:A11 |
| ES 100 | M00006740B:G01 |
| ES 100 | M00006745C:A02 |
| ES 100 | M00006745D:D02 |
| ES 101 | M00006746C:B06 |
| ES 101 | M00006746C:B06 |
| ES 101 | M00006755D:A04 |
| ES 101 | M00006756B:F08 |
| ES 101 | M00006761C:C05 |
| ES 101 | M00006761C:D09 |
| ES 101 | M00006783B:F07 |
| ES 101 | M00006789D:A11 |
| ES 101 | M00006795D:A03 |
| ES 101 | M00006795D:D07 |
| ES 101 | M00006803A:C07 |
| ES 101 | M00006806B:C09 |
| ES 101 | M00006807A:G12 |
| ES 101 | M00006810A:D11 |
| ES 101 | M00006811D:D12 |
| ES 101 | M00006819B:B05 |
| ES 101 | M00006821D:B01 |
| ES 101 | M00006822C:A09 |
| ES 101 | M00006822D:E09 |
| ES 101 | M00006831B:H05 |
| ES 101 | M00006846A:D03 |
| ES 101 | M00006852A:C07 |
| ES 101 | M00006859B:D04 |
| ES 101 | M00006861B:A08 |
| ES 101 | M00006867C:F12 |
| ES 101 | M00006871D:F01 |
| ES 101 | M00006873C:E12 |
| ES 101 | M00006873D:B01 |
| ES 101 | M00006885C:G11 |
| ES 101 | M00006888A:G05 |
| ES 101 | M00006892B:F09 |
| ES 101 | M00006894D:A03 |
| ES 101 | M00006917B:A05 |
| ES 101 | M00006917C:A04 |
| ES 101 | M00006917D:D08 |
| ES 101 | M00006921A:H08 |
| ES 101 | M00006923B:H05 |
| ES 101 | M00006928A:A04 |
| ES 101 | M00006928B:D01 |
| ES 101 | M00006928B:D01 |
| ES 101 | M00006937D:F03 |
| ES 101 | M00006964A:A11 |
| ES 101 | M00006967B:B05 |
| ES 101 | M00006976B:D05 |
| ES 101 | M00006979D:B10 |
| ES 101 | M00006987A:G11 |
| ES 101 | M00006989C:E04 |
| ES 101 | M00006990D:E02 |
| ES 102 | M00006996C:F10 |
| ES 102 | M00006997A:A03 |
| ES 102 | M00007006B:A01 |
| ES 102 | M00007007B:H05 |
| ES 102 | M00007028C:C04 |
| ES 102 | M00007028C:C04 |
| ES 102 | M00007032C:F09 |
| ES 102 | M00007034B:B06 |
| ES 102 | M00007035C:E06 |
| ES 102 | M00007065C:F11 |
| ES 102 | M00007084B:G04 |
| ES 102 | M00007092D:F03 |
| ES 102 | M00007096A:E02 |

TABLE 113-continued

| ES No. | Clone Name |
|---|---|
| ES 102 | M00007096C:E01 |
| ES 102 | M00007096D:H02 |
| ES 102 | M00007097A:B04 |
| ES 102 | M00007097D:D07 |
| ES 102 | M00007098A:C05 |
| ES 102 | M00007105D:C12 |
| ES 102 | M00007108A:D01 |
| ES 102 | M00007110C:F03 |
| ES 102 | M00007112A:A12 |
| ES 102 | M00007117D:H03 |
| ES 102 | M00007121C:G08 |
| ES 102 | M00007128B:G06 |
| ES 102 | M00007129A:F08 |
| ES 102 | M00007131C:A01 |
| ES 102 | M00007135D:B11 |
| ES 102 | M00007135D:B11 |
| ES 102 | M00007136C:C05 |
| ES 102 | M00007146D:F11 |
| ES 102 | M00007151A:B11 |
| ES 102 | M00007156A:E06 |
| ES 102 | M00007156D:F08 |
| ES 102 | M00007166A:E06 |
| ES 102 | M00007172B:C03 |
| ES 102 | M00007174C:D06 |
| ES 102 | M00007177A:E11 |
| ES 102 | M00007178C:D03 |
| ES 102 | M00007192A:E06 |
| ES 102 | M00007194A:E06 |
| ES 102 | M00007194B:B04 |
| ES 102 | M00007204C:G12 |
| ES 102 | M00007204D:D01 |
| ES 102 | M00008014A:B01 |
| ES 102 | M00008015D:B10 |
| ES 102 | M00008015D:F08 |
| ES 102 | M00008020C:C03 |
| ES 103 | M00008023B:D12 |
| ES 103 | M00008043B:B11 |
| ES 103 | M00008059D:B08 |
| ES 103 | M00008065A:B05 |
| ES 103 | M00008065C:F02 |
| ES 103 | M00008075C:A12 |
| ES 103 | M00008076C:F02 |
| ES 103 | M00008079C:C03 |
| ES 103 | M00008085B:C09 |
| ES 103 | M00008089A:E09 |
| ES 103 | M00008098D:H01 |
| ES 103 | M00008099B:G08 |
| ES 103 | M00021620B:F10 |
| ES 103 | M00021626C:C04 |
| ES 103 | M00021626D:F04 |
| ES 103 | M00021628B:B11 |
| ES 103 | M00021628B:D07 |
| ES 103 | M00021649A:E12 |
| ES 103 | M00021654A:A04 |
| ES 103 | M00021654A:A04 |
| ES 103 | M00021655C:H02 |
| ES 103 | M00021670D:G05 |
| ES 103 | M00021681D:C02 |
| ES 103 | M00021681D:C02 |
| ES 103 | M00022189A:B03 |
| ES 103 | M00022216D:D06 |
| ES 103 | M00022221A:D06 |
| ES 103 | M00022221D:D06 |
| ES 103 | M00022231D:E12 |
| ES 103 | M00022234B:D05 |
| ES 103 | M00022235C:C11 |
| ES 103 | M00022236A:A02 |
| ES 103 | M00022246A:H08 |
| ES 103 | M00022251C:A09 |
| ES 103 | M00022253A:E03 |
| ES 103 | M00022259C:B07 |
| ES 103 | M00022273B:A09 |
| ES 103 | M00022279B:H04 |
| ES 103 | M00022280A:G11 |
| ES 103 | M00022370A:G02 |
| ES 103 | M00022411D:G12 |
| ES 103 | M00022415C:B06 |
| ES 103 | M00022420B:H03 |
| ES 103 | M00022430B:D10 |
| ES 103 | M00022430C:D04 |
| ES 103 | M00022440D:D01 |
| ES 103 | M00022444A:C11 |
| ES 103 | M00022452A:B07 |
| ES 104 | M00022453B:H04 |
| ES 104 | M00022453B:H04 |
| ES 104 | M00022457C:G05 |
| ES 104 | M00022465D:F05 |
| ES 104 | M00022468A:E12 |
| ES 104 | M00022468C:E10 |
| ES 104 | M00022470B:G01 |
| ES 104 | M00022470B:G01 |
| ES 104 | M00022472D:E11 |
| ES 104 | M00022473D:B06 |
| ES 104 | M00022496B:F04 |
| ES 104 | M00022508A:C02 |
| ES 104 | M00022509A:B06 |
| ES 104 | M00022516B:E09 |
| ES 104 | M00022517B:E03 |
| ES 104 | M00022528A:H12 |
| ES 104 | M00022533C:E06 |
| ES 104 | M00022537A:C11 |
| ES 104 | M00022550C:B04 |
| ES 104 | M00022559D:D09 |
| ES 104 | M00022561A:A06 |
| ES 104 | M00022565A:A05 |
| ES 104 | M00022565A:A05 |
| ES 104 | M00022569A:A07 |
| ES 104 | M00022571C:D11 |
| ES 104 | M00021854C:E07 |
| ES 104 | M00021864A:E07 |
| ES 104 | M00021869D:D01 |
| ES 104 | M00021886D:F06 |
| ES 104 | M00021911A:H03 |
| ES 104 | M00021915B:E10 |
| ES 104 | M00021925C:H10 |
| ES 104 | M00021947B:C06 |
| ES 104 | M00022010B:H01 |
| ES 104 | M00022013D:H05 |
| ES 104 | M00022015D:F11 |
| ES 104 | M00022015D:F11 |
| ES 104 | M00022025C:D02 |
| ES 104 | M00022049C:B07 |
| ES 104 | M00022050C:D04 |
| ES 104 | M00022052D:A08 |
| ES 104 | M00022058D:A01 |
| ES 104 | M00022060B:F09 |
| ES 104 | M00022106B:D04 |
| ES 104 | M00022123A:D05 |
| ES 104 | M00022129A:E12 |
| ES 104 | M00022132A:D10 |
| ES 104 | M00022132C:F04 |
| ES 105 | M00022137B:G04 |
| ES 105 | M00022143A:C10 |
| ES 105 | M00022143A:D01 |
| ES 105 | M00022143A:D01 |
| ES 105 | M00022148A:A06 |
| ES 105 | M00022149C:C01 |
| ES 105 | M00022149D:C06 |
| ES 105 | M00022151A:D11 |
| ES 105 | M00022151A:G05 |
| ES 105 | M00022163A:C08 |
| ES 105 | M00022598B:E12 |
| ES 105 | M00022598C:D05 |
| ES 105 | M00022617B:C02 |
| ES 105 | M00022624C:C02 |
| ES 105 | M00022641A:C10 |
| ES 105 | M00022641A:E06 |
| ES 105 | M00022641B:F02 |
| ES 105 | M00022645D:A05 |
| ES 105 | M00022645D:C07 |
| ES 105 | M00022651D:B04 |
| ES 105 | M00022651D:C01 |
| ES 105 | M00022655A:D10 |
| ES 105 | M00022656D:E11 |
| ES 105 | M00022660A:B04 |
| ES 105 | M00022667A:C05 |

TABLE 113-continued

| ES No. | Clone Name |
|---|---|
| ES 105 | M00022667D:E11 |
| ES 105 | M00022681D:E06 |
| ES 105 | M00022697A:D12 |
| ES 105 | M00022702B:B04 |
| ES 105 | M00022716C:C06 |
| ES 105 | M00022716C:C06 |
| ES 105 | M00022719A:F12 |
| ES 105 | M00022720B:A11 |
| ES 105 | M00022720C:C09 |
| ES 105 | M00022724C:D04 |
| ES 105 | M00022738B:D06 |
| ES 105 | M00022741B:B11 |
| ES 105 | M00022745C:C07 |
| ES 105 | M00022750A:A07 |
| ES 105 | M00022750A:A07 |
| ES 105 | M00022791B:F11 |
| ES 105 | M00022813B:A08 |
| ES 105 | M00022820D:C06 |
| ES 105 | M00022823A:D03 |
| ES 105 | M00022828A:C06 |
| ES 105 | M00022829A:H06 |
| ES 105 | M00022829C:H10 |
| ES 105 | M00022831B:H07 |
| ES 106 | M00022831C:A09 |
| ES 106 | M00022831D:C04 |
| ES 106 | M00022834C:G01 |
| ES 106 | M00022836A:G03 |
| ES 106 | M00022853C:C11 |
| ES 106 | M00022861D:B10 |
| ES 106 | M00022872A:B05 |
| ES 106 | M00022876B:B05 |
| ES 106 | M00022876D:D08 |
| ES 106 | M00022880C:G09 |
| ES 106 | M00022892C:G07 |
| ES 106 | M00022895B:B11 |
| ES 106 | M00022897D:H03 |
| ES 106 | M00022898C:F04 |
| ES 106 | M00022899A:C09 |
| ES 106 | M00022901D:E11 |
| ES 106 | M00022901D:E11 |
| ES 106 | M00022902C:H10 |
| ES 106 | M00022908B:H03 |
| ES 106 | M00022911B:G01 |
| ES 106 | M00022928A:F03 |
| ES 106 | M00022934B:B03 |
| ES 106 | M00022956B:B09 |
| ES 106 | M00022961A:B11 |
| ES 106 | M00022973A:G07 |
| ES 106 | M00022973C:G08 |
| ES 106 | M00022974D:D10 |
| ES 106 | M00022995C:E02 |
| ES 106 | M00022997A:C08 |
| ES 106 | M00022998B:C08 |
| ES 106 | M00023002D:G10 |
| ES 106 | M00023015A:D10 |
| ES 106 | M00023015C:D02 |
| ES 106 | M00023020D:G09 |
| ES 106 | M00023023C:F03 |
| ES 106 | M00023029A:E06 |
| ES 106 | M00023331D:A11 |
| ES 106 | M00023347D:C12 |
| ES 106 | M00023377D:C09 |
| ES 106 | M00023393D:C02 |
| ES 106 | M00023393D:E12 |
| ES 106 | M00023399C:C08 |
| ES 106 | M00023409A:G08 |
| ES 106 | M00023414B:F03 |
| ES 106 | M00023428C:D03 |
| ES 106 | M00023428D:F11 |
| ES 106 | M00023430B:D10 |
| ES 106 | M00023518C:A04 |
| ES 107 | M00023520A:G07 |
| ES 107 | M00026804D:D03 |
| ES 107 | M00026805B:B04 |
| ES 107 | M00026848C:G11 |
| ES 107 | M00026854A:E07 |
| ES 107 | M00026856C:C11 |
| ES 107 | M00026860D:E01 |
| ES 107 | M00026861D:A09 |
| ES 107 | M00026865D:G11 |
| ES 107 | M00026866A:H08 |
| ES 107 | M00026873B:E11 |
| ES 107 | M00026873D:B08 |
| ES 107 | M00026879A:B02 |
| ES 107 | M00026879C:D10 |
| ES 107 | M00026890A:D02 |
| ES 107 | M00026893C:A01 |
| ES 107 | M00026896D:E10 |
| ES 107 | M00026899C:G11 |
| ES 107 | M00026899C:G11 |
| ES 107 | M00026900B:C02 |
| ES 107 | M00026902A:G04 |
| ES 107 | M00026906B:C10 |
| ES 107 | M00026909A:G03 |
| ES 107 | M00026917D:H03 |
| ES 107 | M00026926D:C05 |
| ES 107 | M00026934D:E09 |
| ES 107 | M00026936D:C12 |
| ES 107 | M00026937C:B08 |
| ES 107 | M00026938A:F04 |
| ES 107 | M00026938A:F04 |
| ES 107 | M00026949B:H10 |
| ES 107 | M00026950A:F12 |
| ES 107 | M00026950D:H01 |
| ES 107 | M00026951A:G06 |
| ES 107 | M00026951A:G11 |
| ES 107 | M00026951A:G11 |
| ES 107 | M00026951C:D03 |
| ES 107 | M00026975C:B03 |
| ES 107 | M00026977A:E09 |
| ES 107 | M00026984A:D10 |
| ES 107 | M00026985C:B05 |
| ES 107 | M00026986B:H10 |
| ES 107 | M00026993B:H06 |
| ES 107 | M00026994C:A07 |
| ES 107 | M00026996D:A06 |
| ES 107 | M00027000C:F05 |
| ES 107 | M00027006B:H01 |
| ES 107 | M00027013D:E10 |
| ES 108 | M00027014C:G04 |
| ES 108 | M00027014D:G04 |
| ES 108 | M00027016D:G06 |
| ES 108 | M00027021D:H11 |
| ES 108 | M00027028D:C07 |
| ES 108 | M00027030C:C08 |
| ES 108 | M00027034B:D09 |
| ES 108 | M00027034C:D11 |
| ES 108 | M00027035D:H09 |
| ES 108 | M00027039A:F06 |
| ES 108 | M00027039B:E09 |
| ES 108 | M00027042C:G11 |
| ES 108 | M00027046B:E05 |
| ES 108 | M00027051A:A07 |
| ES 108 | M00027054B:B03 |
| ES 108 | M00027076D:F07 |
| ES 108 | M00027084C:H10 |
| ES 108 | M00027088D:H06 |
| ES 108 | M00027090A:E08 |
| ES 108 | M00027093C:B08 |
| ES 108 | M00027096A:G07 |
| ES 108 | M00027097C:G11 |
| ES 108 | M00027111A:H04 |
| ES 108 | M00027134A:G02 |
| ES 108 | M00027139D:C06 |
| ES 108 | M00027140A:C11 |
| ES 108 | M00027163A:D11 |
| ES 108 | M00027165C:F11 |
| ES 108 | M00027168C:H10 |
| ES 108 | M00027171B:B07 |
| ES 108 | M00027172A:C03 |
| ES 108 | M00027173D:D08 |
| ES 108 | M00027183B:B01 |
| ES 108 | M00027193C:C05 |
| ES 108 | M00027194D:A05 |
| ES 108 | M00027197A:G07 |
| ES 108 | M00027197B:F07 |

TABLE 113-continued

| ES No. | Clone Name |
|---|---|
| ES 108 | M00027203B:H08 |
| ES 108 | M00027207B:E09 |
| ES 108 | M00027217A:G03 |
| ES 108 | M00027220A:B12 |
| ES 108 | M00027222A:C09 |
| ES 108 | M00027229D:E06 |
| ES 108 | M00027231D:A03 |
| ES 108 | M00027524B:B11 |
| ES 108 | M00027527A:G04 |
| ES 108 | M00027532C:C02 |
| ES 108 | M00027535D:E08 |
| ES 109 | M00027536D:G12 |
| ES 109 | M00027543C:B09 |
| ES 109 | M00027543D:G07 |
| ES 109 | M00027556D:G10 |
| ES 109 | M00027561C:C04 |
| ES 109 | M00027562B:C02 |
| ES 109 | M00027564A:D03 |
| ES 109 | M00027571C:C11 |
| ES 109 | M00027573A:F09 |
| ES 109 | M00027578B:F05 |
| ES 109 | M00027578C:E04 |
| ES 109 | M00027580C:E10 |
| ES 109 | M00027581B:E01 |
| ES 109 | M00027588A:C01 |
| ES 109 | M00027588C:A06 |
| ES 109 | M00027594B:C03 |
| ES 109 | M00027604A:G10 |
| ES 109 | M00027604A:G10 |
| ES 109 | M00027605C:E05 |
| ES 109 | M00027607A:H05 |
| ES 109 | M00027608C:H07 |
| ES 109 | M00027616C:G12 |
| ES 109 | M00027628C:A01 |
| ES 109 | M00027639B:E11 |
| ES 109 | M00027641B:A01 |
| ES 109 | M00027652B:G03 |
| ES 109 | M00027658B:G03 |
| ES 109 | M00027660C:E03 |
| ES 109 | M00027660C:E03 |
| ES 109 | M00027665B:D01 |
| ES 109 | M00027681D:D02 |
| ES 109 | M00027699D:D02 |
| ES 109 | M00027717C:G05 |
| ES 109 | M00027733D:D05 |
| ES 109 | M00027742C:B01 |
| ES 109 | M00027742C:B01 |
| ES 109 | M00027747D:D01 |
| ES 109 | M00027757A:B06 |
| ES 109 | M00027781D:E04 |
| ES 109 | M00027786D:B01 |
| ES 109 | M00027803A:H10 |
| ES 109 | M00027806C:H05 |
| ES 109 | M00027808D:G10 |
| ES 109 | M00027817B:B11 |
| ES 109 | M00027820C:C02 |
| ES 109 | M00027823C:G07 |
| ES 109 | M00027829C:D02 |
| ES 109 | M00027833C:D01 |
| ES 110 | M00042345A:F12 |
| ES 110 | M00042523A:C05 |
| ES 110 | M00042523C:E08 |
| ES 110 | M00042525D:E01 |
| ES 110 | M00042527B:D07 |
| ES 110 | M00042528C:F11 |
| ES 110 | M00042529C:G07 |
| ES 110 | M00042532A:F08 |
| ES 110 | M00042534A:B07 |
| ES 110 | M00042536D:F01 |
| ES 110 | M00042537A:H05 |
| ES 110 | M00042538B:E06 |
| ES 110 | M00042538D:A08 |
| ES 110 | M00042539C:E05 |
| ES 110 | M00042540A:H06 |
| ES 110 | M00042540D:F03 |
| ES 110 | M00042540D:H05 |
| ES 110 | M00042543C:H02 |
| ES 110 | M00042544B:D02 |
| ES 110 | M00042544C:F10 |
| ES 110 | M00042547A:A02 |
| ES 110 | M00042547B:D11 |
| ES 110 | M00042547C:F02 |
| ES 110 | M00042551A:D09 |
| ES 110 | M00042556A:D04 |
| ES 110 | M00042563C:E02 |
| ES 110 | M00042563C:E02 |
| ES 110 | M00042563D:G09 |
| ES 110 | M00042564B:H11 |
| ES 110 | M00042565A:H03 |
| ES 110 | M00042565C:A08 |
| ES 110 | M00042567D:C01 |
| ES 110 | M00042570D:H02 |
| ES 110 | M00042573C:A07 |
| ES 110 | M00042574B:H08 |
| ES 110 | M00042575C:D01 |
| ES 110 | M00042693D:E04 |
| ES 110 | M00042694C:E02 |
| ES 110 | M00042695B:H05 |
| ES 110 | M00042700B:A01 |
| ES 110 | M00042700B:D03 |
| ES 110 | M00042700B:D03 |
| ES 110 | M00042700B:H05 |
| ES 110 | M00042704A:F04 |
| ES 110 | M00042704A:F09 |
| ES 110 | M00042704D:E02 |
| ES 110 | M00042705A:D02 |
| ES 110 | M00042706C:A04 |
| ES 110 | M00054596B:G11 |
| ES 110 | M00004101C:H01 |
| ES 111 | M00042711C:G11 |
| ES 111 | M00042711D:C04 |
| ES 111 | M00042712B:B10 |
| ES 111 | M00042717D:D04 |
| ES 111 | M00042718C:B03 |
| ES 111 | M00042720C:D06 |
| ES 111 | M00042720D:G10 |
| ES 111 | M00042721A:G07 |
| ES 111 | M00042727C:H12 |
| ES 111 | M00042728B:E07 |
| ES 111 | M00042732A:G09 |
| ES 111 | M00042735C:G02 |
| ES 111 | M00042735D:A07 |
| ES 111 | M00042738B:D10 |
| ES 111 | M00042739D:D01 |
| ES 111 | M00042741D:D10 |
| ES 111 | M00042742B:H03 |
| ES 111 | M00042742C:A06 |
| ES 111 | M00042742D:D05 |
| ES 111 | M00042746B:F02 |
| ES 111 | M00042746C:B09 |
| ES 111 | M00042750B:B09 |
| ES 111 | M00042881D:C08 |
| ES 111 | M00042883A:F12 |
| ES 111 | M00042886C:C03 |
| ES 111 | M00042886C:F01 |
| ES 111 | M00042887C:D07 |
| ES 111 | M00042889B:A09 |
| ES 111 | M00042890D:C08 |
| ES 111 | M00042891B:C04 |
| ES 111 | M00042893B:C08 |
| ES 111 | M00042900C:C07 |
| ES 111 | M00042901B:A03 |
| ES 111 | M00042902A:C04 |
| ES 111 | M00042905A:F11 |
| ES 111 | M00042905C:C10 |
| ES 111 | M00042908D:G01 |
| ES 111 | M00042909B:G04 |
| ES 111 | M00042911A:H03 |
| ES 111 | M00042914D:B10 |
| ES 111 | M00054792D:E09 |
| ES 111 | M00054793D:B07 |
| ES 111 | M00054798D:F01 |
| ES 111 | M00054913C:G03 |
| ES 111 | M00054915D:E07 |
| ES 111 | M00054917B:F09 |
| ES 111 | M00054917D:D12 |

TABLE 113-continued

| ES No. | Clone Name |
|---|---|
| ES 111 | M00054918C:D03 |
| ES 112 | M00054918D:C11 |
| ES 112 | M00055426B:B02 |
| ES 112 | M00055426C:H06 |
| ES 112 | M00055427A:F01 |
| ES 112 | M00055428C:A02 |
| ES 112 | M00055429A:H05 |
| ES 112 | M00055430B:H02 |
| ES 112 | M00055431C:E09 |
| ES 112 | M00055438C:C06 |
| ES 112 | M00055438C:H10 |
| ES 112 | M00055441B:D02 |
| ES 112 | M00055445D:G06 |
| ES 112 | M00055446C:B06 |
| ES 112 | M00055447D:H04 |
| ES 112 | M00055447D:H04 |
| ES 112 | M00055448A:D08 |
| ES 112 | M00055448C:E07 |
| ES 112 | M00055450A:G09 |
| ES 112 | M00055450D:B08 |
| ES 112 | M00055451A:F07 |
| ES 112 | M00055451A:F11 |
| ES 112 | M00055451C:G11 |
| ES 112 | M00055453C:E01 |
| ES 112 | M00055453C:E01 |
| ES 112 | M00055454A:A07 |
| ES 112 | M00055454A:H11 |
| ES 112 | M00055454C:G05 |
| ES 112 | M00055456D:F12 |
| ES 112 | M00055463D:H10 |
| ES 112 | M00055464A:F05 |
| ES 112 | M00055466D:B08 |
| ES 112 | M00055470B:G01 |
| ES 112 | M00055491A:G08 |
| ES 112 | M00055494D:C09 |
| ES 112 | M00055495A:G02 |
| ES 112 | M00055495C:D05 |
| ES 112 | M00055495C:F03 |
| ES 112 | M00055495D:E02 |
| ES 112 | M00055496A:F09 |
| ES 112 | M00055496B:E07 |
| ES 112 | M00055496C:C09 |
| ES 112 | M00055498A:H09 |
| ES 112 | M00055500D:B05 |
| ES 112 | M00055504C:D08 |
| ES 112 | M00055505D:A10 |
| ES 112 | M00055508D:E03 |
| ES 112 | M00055509C:H09 |
| ES 112 | M00055510B:B07 |
| ES 113 | M00055511D:E09 |
| ES 113 | M00055512C:G06 |
| ES 113 | M00055512D:D07 |
| ES 113 | M00055512D:F08 |
| ES 113 | M00055513C:D06 |
| ES 113 | M00055514D:H05 |
| ES 113 | M00055516B:E08 |
| ES 113 | M00055517B:D03 |
| ES 113 | M00055519B:C06 |
| ES 113 | M00055519C:H07 |
| ES 113 | M00055520C:A06 |
| ES 113 | M00055522A:E07 |
| ES 113 | M00055522D:C02 |
| ES 113 | M00055522D:C02 |
| ES 113 | M00055523D:C03 |
| ES 113 | M00055525C:B07 |
| ES 113 | M00055526D:F09 |
| ES 113 | M00055527C:E02 |
| ES 113 | M00055527C:E04 |
| ES 113 | M00055527D:G11 |
| ES 113 | M00055528C:F06 |
| ES 113 | M00055529D:B02 |
| ES 113 | M00055530D:B07 |
| ES 113 | M00055532C:G08 |
| ES 113 | M00055534C:H01 |
| ES 113 | M00055536C:E06 |
| ES 113 | M00055536C:F03 |
| ES 113 | M00055538B:H11 |
| ES 113 | M00055542C:C01 |
| ES 113 | M00055542C:F06 |
| ES 113 | M00055542D:A09 |
| ES 113 | M00055543A:C05 |
| ES 113 | M00055543A:C05 |
| ES 113 | M00055543C:G08 |
| ES 113 | M00055544A:E04 |
| ES 113 | M00055544B:B02 |
| ES 113 | M00055545C:H12 |
| ES 113 | M00055547D:D10 |
| ES 113 | M00055547D:E05 |
| ES 113 | M00055548A:F04 |
| ES 113 | M00055548C:E12 |
| ES 113 | M00055548C:E12 |
| ES 113 | M00055552A:C09 |
| ES 113 | M00055553B:H04 |
| ES 113 | M00055553D:C07 |
| ES 113 | M00055553D:H02 |
| ES 113 | M00055556C:H09 |
| ES 113 | M00055560B:B12 |
| ES 114 | M00055560B:F02 |
| ES 114 | M00055560C:F06 |
| ES 114 | M00055563A:A02 |
| ES 114 | M00055572A:B12 |
| ES 114 | M00055572B:F03 |
| ES 114 | M00055575A:D08 |
| ES 114 | M00055578A:H09 |
| ES 114 | M00055581D:B01 |
| ES 114 | M00055582B:E04 |
| ES 114 | M00055583B:B04 |
| ES 114 | M00055583B:H05 |
| ES 114 | M00055584A:C11 |
| ES 114 | M00055584D:G06 |
| ES 114 | M00055586C:F05 |
| ES 114 | M00055586D:F02 |
| ES 114 | M00055591C:H01 |
| ES 114 | M00055592D:A05 |
| ES 114 | M00055594B:A01 |
| ES 114 | M00055597C:E08 |
| ES 114 | M00055601C:D09 |
| ES 114 | M00055602B:G10 |
| ES 114 | M00055602C:E07 |
| ES 114 | M00055609A:G03 |
| ES 114 | M00055609D:F12 |
| ES 114 | M00055613A:D10 |
| ES 114 | M00055613A:E02 |
| ES 114 | M00055618A:A06 |
| ES 114 | M00055628A:A08 |
| ES 114 | M00055630B:E09 |
| ES 114 | M00055633D:A02 |
| ES 114 | M00055633D:G11 |
| ES 114 | M00055635A:H10 |
| ES 114 | M00055635B:E10 |
| ES 114 | M00055635C:G04 |
| ES 114 | M00055636A:F10 |
| ES 114 | M00055647C:B04 |
| ES 114 | M00055653A:H04 |
| ES 114 | M00055656A:E09 |
| ES 114 | M00055662C:A04 |
| ES 114 | M00055664C:A08 |
| ES 114 | M00055668B:B07 |
| ES 114 | M00055679A:A07 |
| ES 114 | M00055681B:G02 |
| ES 114 | M00055685D:E01 |
| ES 114 | M00055686D:E11 |
| ES 114 | M00055687C:F01 |
| ES 114 | M00055688B:B04 |
| ES 114 | M00055689A:G12 |
| ES 115 | M00055689D:F02 |
| ES 115 | M00055689D:F07 |
| ES 115 | M00055691B:E07 |
| ES 115 | M00055692D:E07 |
| ES 115 | M00055701C:D10 |
| ES 115 | M00055703A:B08 |
| ES 115 | M00055703B:B06 |
| ES 115 | M00055703B:C05 |
| ES 115 | M00055703C:G09 |
| ES 115 | M00055704C:D07 |
| ES 115 | M00055705C:G07 |

TABLE 113-continued

| ES No. | Clone Name |
|---|---|
| ES 115 | M00055706A:A01 |
| ES 115 | M00055706B:G01 |
| ES 115 | M00055707D:C08 |
| ES 115 | M00055709B:G09 |
| ES 115 | M00055716C:B04 |
| ES 115 | M00055717B:F04 |
| ES 115 | M00055718A:F05 |
| ES 115 | M00055720B:G09 |
| ES 115 | M00055720C:A06 |
| ES 115 | M00055720D:A01 |
| ES 115 | M00055721B:F06 |
| ES 115 | M00055721B:F06 |
| ES 115 | M00055721C:E05 |
| ES 115 | M00055723A:B08 |
| ES 115 | M00055723D:E05 |
| ES 115 | M00055724D:D09 |
| ES 115 | M00055726B:B08 |
| ES 115 | M00055726C:D12 |
| ES 115 | M00055726C:G10 |
| ES 115 | M00055729D:A06 |
| ES 115 | M00055731A:H12 |
| ES 115 | M00055733A:G11 |
| ES 115 | M00055734C:H05 |
| ES 115 | M00055735C:C07 |
| ES 115 | M00055735C:G05 |
| ES 115 | M00055736A:D06 |
| ES 115 | M00055736B:G03 |
| ES 115 | M00055736C:G07 |
| ES 115 | M00055740B:B12 |
| ES 115 | M00055740B:F09 |
| ES 115 | M00055743B:C12 |
| ES 115 | M00055744B:C08 |
| ES 115 | M00055744C:F08 |
| ES 115 | M00055744C:F09 |
| ES 115 | M00055744D:G08 |
| ES 115 | M00055747C:D09 |
| ES 115 | M00055749D:H11 |
| ES 116 | M00055751C:D01 |
| ES 116 | M00055755C:D02 |
| ES 116 | M00055755D:H03 |
| ES 116 | M00055761D:C03 |
| ES 116 | M00055763B:E06 |
| ES 116 | M00055765A:B05 |
| ES 116 | M00055766A:H03 |
| ES 116 | M00055768A:B05 |
| ES 116 | M00055770C:G01 |
| ES 116 | M00055771A:A11 |
| ES 116 | M00055771A:D01 |
| ES 116 | M00055771C:A11 |
| ES 116 | M00055771C:F05 |
| ES 116 | M00055771D:D04 |
| ES 116 | M00055771D:F07 |
| ES 116 | M00055774C:E01 |
| ES 116 | M00055774D:G03 |
| ES 116 | M00055775C:B10 |
| ES 116 | M00055775D:C06 |
| ES 116 | M00055778A:F09 |
| ES 116 | M00055779B:A02 |
| ES 116 | M00055780B:B07 |
| ES 116 | M00055780D:G08 |
| ES 116 | M00055781C:C05 |
| ES 116 | M00055782A:F02 |
| ES 116 | M00055783A:C11 |
| ES 116 | M00055785B:F03 |
| ES 116 | M00055785C:E08 |
| ES 116 | M00055786A:D05 |
| ES 116 | M00055788D:A03 |
| ES 116 | M00055790C:H02 |
| ES 116 | M00055791A:D05 |
| ES 116 | M00055791D:F03 |
| ES 116 | M00055792B:G09 |
| ES 116 | M00055792D:E07 |
| ES 116 | M00055794A:G11 |
| ES 116 | M00055794C:B06 |
| ES 116 | M00055796D:E10 |
| ES 116 | M00055797A:D08 |
| ES 116 | M00055797B:E07 |
| ES 116 | M00055798B:C06 |
| ES 116 | M00055800A:D08 |
| ES 116 | M00055800B:C08 |
| ES 116 | M00055802A:D08 |
| ES 116 | M00055802A:G02 |
| ES 116 | M00055802B:H04 |
| ES 116 | M00055802C:F12 |
| ES 116 | M00055803B:A11 |
| ES 117 | M00055803C:D08 |
| ES 117 | M00055804A:F03 |
| ES 117 | M00055804B:F01 |
| ES 117 | M00055805B:C07 |
| ES 117 | M00055805C:D10 |
| ES 117 | M00055806A:H12 |
| ES 117 | M00055806B:F07 |
| ES 117 | M00055806C:E09 |
| ES 117 | M00055807B:G10 |
| ES 117 | M00055807B:G10 |
| ES 117 | M00055807D:C04 |
| ES 117 | M00055808C:G11 |
| ES 117 | M00055811A:A08 |
| ES 117 | M00055811D:C12 |
| ES 117 | M00055812A:E01 |
| ES 117 | M00055814C:D11 |
| ES 117 | M00055816B:F01 |
| ES 117 | M00055817B:F01 |
| ES 117 | M00055817C:C08 |
| ES 117 | M00055817C:D08 |
| ES 117 | M00055818A:F12 |
| ES 117 | M00055818D:E10 |
| ES 117 | M00055820A:E08 |
| ES 117 | M00055820B:E05 |
| ES 117 | M00055820C:C08 |
| ES 117 | M00055820D:G10 |
| ES 117 | M00055821A:A06 |
| ES 117 | M00055821A:G12 |
| ES 117 | M00055822B:H04 |
| ES 117 | M00055823B:D03 |
| ES 117 | M00055823C:D11 |
| ES 117 | M00055825B:E03 |
| ES 117 | M00055826A:F04 |
| ES 117 | M00055827B:D02 |
| ES 117 | M00055827D:A02 |
| ES 117 | M00055827D:C06 |
| ES 117 | M00055827D:E05 |
| ES 117 | M00055829C:G09 |
| ES 117 | M00055830A:G10 |
| ES 117 | M00055832D:E12 |
| ES 117 | M00055833D:A11 |
| ES 117 | M00055838B:D12 |
| ES 117 | M00055838B:G12 |
| ES 117 | M00055839A:F09 |
| ES 117 | M00055839B:A10 |
| ES 117 | M00055840C:D06 |
| ES 117 | M00055841A:B09 |
| ES 117 | M00055841C:D05 |
| ES 118 | M00055848C:H06 |
| ES 118 | M00055849C:D08 |
| ES 118 | M00055850B:F03 |
| ES 118 | M00055851A:G11 |
| ES 118 | M00055851C:F12 |
| ES 118 | M00055851C:F12 |
| ES 118 | M00055852A:A07 |
| ES 118 | M00055854A:E04 |
| ES 118 | M00055856A:F04 |
| ES 118 | M00055856C:F07 |
| ES 118 | M00055860D:A08 |
| ES 118 | M00055861A:D03 |
| ES 118 | M00055864A:E11 |
| ES 118 | M00055864A:H02 |
| ES 118 | M00055866D:A02 |
| ES 118 | M00055868A:F06 |
| ES 118 | M00055868D:D03 |
| ES 118 | M00055868D:F09 |
| ES 118 | M00055869B:A06 |
| ES 118 | M00055871A:F05 |
| ES 118 | M00055871D:G06 |
| ES 118 | M00055872D:D12 |
| ES 118 | M00055873A:B11 |

TABLE 113-continued

| ES No. | Clone Name |
|---|---|
| ES 118 | M00055873B:E03 |
| ES 118 | M00055874B:B06 |
| ES 118 | M00055874D:D03 |
| ES 118 | M00055879B:E11 |
| ES 118 | M00055879C:D04 |
| ES 118 | M00055880D:F12 |
| ES 118 | M00055882C:A06 |
| ES 118 | M00055882C:A09 |
| ES 118 | M00055884A:E10 |
| ES 118 | M00055884C:B01 |
| ES 118 | M00055884D:A05 |
| ES 118 | M00055886D:G09 |
| ES 118 | M00055887A:C06 |
| ES 118 | M00055887A:F07 |
| ES 118 | M00055887B:E04 |
| ES 118 | M00055888B:B05 |
| ES 118 | M00055889C:H12 |
| ES 118 | M00055891B:A04 |
| ES 118 | M00055893B:C05 |
| ES 118 | M00055896C:F11 |
| ES 118 | M00055900B:B05 |
| ES 118 | M00055906B:D10 |
| ES 118 | M00055906C:F12 |
| ES 118 | M00055908B:H11 |
| ES 118 | M00055908C:E12 |
| ES 122 | M00056209B:F12 |
| ES 122 | M00056210B:E03 |
| ES 122 | M00056212C:G01 |
| ES 122 | M00056213A:A04 |
| ES 122 | M00056215A:E03 |
| ES 122 | M00056218C:G03 |
| ES 122 | M00056220D:D02 |
| ES 122 | M00056220D:D09 |
| ES 122 | M00056221D:E05 |
| ES 122 | M00056222C:F02 |
| ES 122 | M00056223B:G03 |
| ES 122 | M00056224C:B10 |
| ES 122 | M00056224D:E08 |
| ES 122 | M00056225D:G09 |
| ES 122 | M00056226C:F12 |
| ES 122 | M00056228B:A07 |
| ES 122 | M00056231B:G09 |
| ES 122 | M00056231B:G09 |
| ES 122 | M00056232C:E06 |
| ES 122 | M00056232D:G12 |
| ES 122 | M00056233D:F03 |
| ES 122 | M00056236D:G01 |
| ES 122 | M00056238B:E07 |
| ES 122 | M00056243C:G10 |
| ES 122 | M00056244A:B08 |
| ES 122 | M00056244B:C07 |
| ES 122 | M00056246A:B03 |
| ES 122 | M00056246C:G07 |
| ES 122 | M00056247A:G06 |
| ES 122 | M00056248A:A09 |
| ES 122 | M00056250B:F01 |
| ES 122 | M00056251C:A06 |
| ES 122 | M00056252B:H08 |
| ES 122 | M00056252D:E11 |
| ES 122 | M00056253A:F12 |
| ES 122 | M00056253D:H06 |
| ES 122 | M00056254A:H02 |
| ES 122 | M00056256C:H11 |
| ES 122 | M00056262B:B08 |
| ES 122 | M00056263D:C01 |
| ES 122 | M00056267A:E02 |
| ES 122 | M00056267C:B02 |
| ES 122 | M00056268B:B04 |
| ES 122 | M00056268C:D01 |
| ES 122 | M00056273B:A01 |
| ES 122 | M00056281D:E04 |
| ES 122 | M00056282A:F11 |
| ES 122 | M00056282B:D04 |
| ES 123 | M00056282D:C01 |
| ES 123 | M00056282D:H09 |
| ES 123 | M00056283A:E02 |
| ES 123 | M00056283A:E02 |
| ES 123 | M00056283D:C03 |
| ES 123 | M00056286A:E08 |
| ES 123 | M00056286D:A12 |
| ES 123 | M00056290B:F05 |
| ES 123 | M00056290B:E08 |
| ES 123 | M00056290D:H02 |
| ES 123 | M00056291B:G01 |
| ES 123 | M00056291D:B05 |
| ES 123 | M00056292B:E05 |
| ES 123 | M00056293B:E08 |
| ES 123 | M00056293C:F05 |
| ES 123 | M00056293C:G09 |
| ES 123 | M00056295A:F07 |
| ES 123 | M00056295C:D06 |
| ES 123 | M00056300A:A05 |
| ES 123 | M00056302B:F12 |
| ES 123 | M00056303A:C03 |
| ES 123 | M00056303C:B04 |
| ES 123 | M00056304D:G11 |
| ES 123 | M00056307A:H12 |
| ES 123 | M00056310B:G06 |
| ES 123 | M00056312B:A04 |
| ES 123 | M00056312D:C03 |
| ES 123 | M00056313C:F07 |
| ES 123 | M00056319C:G01 |
| ES 123 | M00056320L:H02 |
| ES 123 | M00056323A:H10 |
| ES 123 | M00056323A:H10 |
| ES 123 | M00056323C:C12 |
| ES 123 | M00056323D:A07 |
| ES 123 | M00056324B:D02 |
| ES 123 | M00056330C:D03 |
| ES 123 | M00056331B:D01 |
| ES 123 | M00056338B:B06 |
| ES 123 | M00056338C:B10 |
| ES 123 | M00056342A:G05 |
| ES 123 | M00056342B:G03 |
| ES 123 | M00056342C:F11 |
| ES 123 | M00056344B:G03 |
| ES 123 | M00056345D:E03 |
| ES 123 | M00056437C:H07 |
| ES 123 | M00056438C:A06 |
| ES 123 | M00056447B:A04 |
| ES 123 | M00056448B:C09 |
| ES 124 | M00056456C:A09 |
| ES 124 | M00056456C:F02 |
| ES 124 | M00056456C:F01 |
| ES 124 | M00056459A:C07 |
| ES 124 | M00056459A:C07 |
| ES 124 | M00056459A:D07 |
| ES 124 | M00056460A:G11 |
| ES 124 | M00056466A:A03 |
| ES 124 | M00056466A:E02 |
| ES 124 | M00056467C:E07 |
| ES 124 | M00056475B:C12 |
| ES 124 | M00056475C:F01 |
| ES 124 | M00056475C:F02 |
| ES 124 | M00042432C:H10 |
| ES 124 | M00042440A:E05 |
| ES 124 | M00042461A:A10 |
| ES 124 | M00042463A:F09 |
| ES 124 | M00042466D:H06 |
| ES 124 | M00042469D:H04 |
| ES 124 | M00042511A:A04 |
| ES 124 | M00042513D:A12 |
| ES 124 | M00042515C:A10 |
| ES 124 | M00042756B:B01 |
| ES 124 | M00042758D:H12 |
| ES 124 | M00042760B:C07 |
| ES 124 | M00042764B:B04 |
| ES 124 | M00042767D:D02 |
| ES 124 | M00042770B:B12 |
| ES 124 | M00042771B:A03 |
| ES 124 | M00042777A:D06 |
| ES 124 | M00042781C:A06 |
| ES 124 | M00042783C:A03 |
| ES 124 | M00042787C:E09 |
| ES 124 | M00042792C:G10 |
| ES 124 | M00042792D:F04 |

TABLE 113-continued

| ES No. | Clone Name |
|---|---|
| ES 124 | M00042793B:G06 |
| ES 124 | M00042800A:A03 |
| ES 124 | M00042801B:B06 |
| ES 124 | M00042802C:G11 |
| ES 124 | M00042805A:E06 |
| ES 124 | M00042805D:H08 |
| ES 124 | M00042814D:B11 |
| ES 124 | M00042816B:F04 |
| ES 124 | M00042818A:E12 |
| ES 124 | M00042823B:G04 |
| ES 124 | M00042826B:C05 |
| ES 124 | M00042826D:C03 |
| ES 124 | M00042833D:G01 |
| ES 125 | M00042834C:B06 |
| ES 125 | M00042835C:C01 |
| ES 125 | M00042835D:D02 |
| ES 125 | M00042838D:E11 |
| ES 125 | M00042842A:C01 |
| ES 125 | M00042842D:E08 |
| ES 125 | M00042844C:C12 |
| ES 125 | M00042846C:D09 |
| ES 125 | M00042848D:G12 |
| ES 125 | M00042849D:F11 |
| ES 125 | M00042850B:C04 |
| ES 125 | M00042850C:C10 |
| ES 125 | M00042853A:G03 |
| ES 125 | M00042853D:A04 |
| ES 125 | M00042855A:B09 |
| ES 125 | M00042856C:F07 |
| ES 125 | M00042864A:E05 |
| ES 125 | M00042867D:H01 |
| ES 125 | M00042869C:E06 |
| ES 125 | M00042875C:E04 |
| ES 125 | M00042879B:F09 |
| ES 125 | M00056346C:C12 |
| ES 125 | M00056351B:D06 |
| ES 125 | M00056356B:F04 |
| ES 125 | M00056359C:A11 |
| ES 125 | M00056362D:G05 |
| ES 125 | M00056363A:B06 |
| ES 125 | M00056368C:F04 |
| ES 125 | M00056369B:D12 |
| ES 125 | M00056370B:G02 |
| ES 125 | M00056371B:F12 |
| ES 125 | M00056372B:C10 |
| ES 125 | M00056374B:H02 |
| ES 125 | M00056382C:H02 |
| ES 125 | M00056383A:C10 |
| ES 125 | M00056410B:E04 |
| ES 125 | M00056411C:E04 |
| ES 125 | M00056414B:A05 |
| ES 125 | M00056416C:B12 |
| ES 125 | M00056420C:D07 |
| ES 125 | M00056421A:F12 |
| ES 125 | M00056424A:F12 |
| ES 125 | M00056424B:H06 |
| ES 125 | M00056424D:A10 |
| ES 125 | M00056425A:H08 |
| ES 125 | M00056425D:B03 |
| ES 125 | M00056434A:C08 |
| ES 125 | M00056434D:E07 |
| ES 126 | M00056480B:C12 |
| ES 126 | M00056480D:A10 |
| ES 126 | M00056481A:F02 |
| ES 126 | M00056483D:F06 |
| ES 126 | M00056484B:G02 |
| ES 126 | M00056485B:B12 |
| ES 126 | M00056490D:E02 |
| ES 126 | M00056491D:G08 |
| ES 126 | M00056496B:A01 |
| ES 126 | M00056496C:H09 |
| ES 126 | M00056499C:F05 |
| ES 126 | M00056501C:H07 |
| ES 126 | M00056503B:G11 |
| ES 126 | M00056503B:G11 |
| ES 126 | M00056505B:H02 |
| ES 126 | M00056505D:D07 |
| ES 126 | M00056506C:G12 |
| ES 126 | M00056507D:B10 |
| ES 126 | M00056508B:B10 |
| ES 126 | M00056511A:H12 |
| ES 126 | M00056512B:C06 |
| ES 126 | M00056512C:E09 |
| ES 126 | M00056512D:C12 |
| ES 126 | M00056514B:E08 |
| ES 126 | M00056514C:G01 |
| ES 126 | M00056515C:C05 |
| ES 126 | M00056517B:G03 |
| ES 126 | M00056519C:H01 |
| ES 126 | M00056526C:E11 |
| ES 126 | M00056529D:F12 |
| ES 126 | M00056529D:H09 |
| ES 126 | M00056530A:D01 |
| ES 126 | M00056532G:G06 |
| ES 126 | M00056534A:D11 |
| ES 126 | M00056537B:H05 |
| ES 126 | M00056537C:A09 |
| ES 126 | M00056541A:B08 |
| ES 126 | M00056547A:C04 |
| ES 126 | M00056548A:C11 |
| ES 126 | M00056551A:F02 |
| ES 126 | M00056552A:A10 |
| ES 126 | M00056552D:B10 |
| ES 126 | M00056555A:F09 |
| ES 126 | M00056556C:G01 |
| ES 126 | M00056557C:D02 |
| ES 126 | M00056561C:D08 |
| ES 126 | M00056564C:E09 |
| ES 126 | M00056566C:H01 |
| ES 127 | M00056574B:A07 |
| ES 127 | M00056580B:F10 |
| ES 127 | M00056591C:E03 |
| ES 127 | M00056592A:F04 |
| ES 127 | M00056592C:C03 |
| ES 127 | M00056592D:D07 |
| ES 127 | M00056592D:D07 |
| ES 127 | M00056593B:E05 |
| ES 127 | M00056594C:C06 |
| ES 127 | M00056594C:C10 |
| ES 127 | M00056595A:A02 |
| ES 127 | M00056595A:C07 |
| ES 127 | M00056595B:F02 |
| ES 127 | M00056596A:E02 |
| ES 127 | M00056596C:E06 |
| ES 127 | M00056596C:H08 |
| ES 127 | M00056597A:F07 |
| ES 127 | M00056597D:C02 |
| ES 127 | M00056599D:D11 |
| ES 127 | M00056600D:H07 |
| ES 127 | M00056603C:D01 |
| ES 127 | M00056608C:E04 |
| ES 127 | M00056610B:H12 |
| ES 127 | M00056613A:A05 |
| ES 127 | M00056616B:C08 |
| ES 127 | M00056616B:A10 |
| ES 127 | M00056617B:H06 |
| ES 127 | M00056618A:B02 |
| ES 127 | M00056618B:F06 |
| ES 127 | M00056618D:F11 |
| ES 127 | M00056620D:E12 |
| ES 127 | M00056622D:C03 |
| ES 127 | M00056624D:H05 |
| ES 127 | M00056628C:F01 |
| ES 127 | M00056631B:G05 |
| ES 127 | M00056631D:C08 |
| ES 127 | M00056631D:D03 |
| ES 127 | M00056633B:B07 |
| ES 127 | M00056635A:A11 |
| ES 127 | M00056635A:E09 |
| ES 127 | M00056638A:D08 |
| ES 127 | M00056638B:B01 |
| ES 127 | M00056639A:E02 |
| ES 127 | M00056643D:G06 |
| ES 127 | M00056645C:B11 |
| ES 127 | M00056645D:F06 |
| ES 127 | M00056646C:C02 |

TABLE 113-continued

| ES No. | Clone Name |
|---|---|
| ES 127 | M00056646D:G05 |
| ES 128 | M00056652D:F04 |
| ES 128 | M00056656C:H03 |
| ES 128 | M00056659C:G08 |
| ES 128 | M00056661B:A09 |
| ES 128 | M00056661D:E05 |
| ES 128 | M00056662B:F03 |
| ES 128 | M00056664B:G06 |
| ES 128 | M00056664C:B07 |
| ES 128 | M00056665B:A11 |
| ES 128 | M00056665C:E05 |
| ES 128 | M00056666A:C08 |
| ES 128 | M00056669B:G07 |
| ES 128 | M00056670A:A11 |
| ES 128 | M00056673D:E06 |
| ES 128 | M00056674B:E05 |
| ES 128 | M00056674D:H04 |
| ES 128 | M00056682D:F10 |
| ES 128 | M00056683C:B09 |
| ES 128 | M00056684D:A05 |
| ES 128 | M00056684D:F11 |
| ES 128 | M00056688B:F05 |
| ES 128 | M00056690C:F09 |
| ES 128 | M00056693C:C08 |
| ES 128 | M00056695A:H09 |
| ES 128 | M00056697C:E03 |
| ES 128 | M00056698C:E12 |
| ES 128 | M00056701B:E08 |
| ES 128 | M00056703A:D06 |
| ES 128 | M00056705D:E07 |
| ES 128 | M00056707B:E02 |
| ES 128 | M00056707D:D05 |
| ES 128 | M00056708C:C06 |
| ES 128 | M00056708D:D11 |
| ES 128 | M00056709A:A05 |
| ES 128 | M00056710A:C01 |
| ES 128 | M00056710B:F05 |
| ES 128 | M00056710B:H09 |
| ES 128 | M00056710D:F07 |
| ES 128 | M00056711A:C01 |
| ES 128 | M00056711A:F05 |
| ES 128 | M00056711A:F05 |
| ES 128 | M00056711D:A05 |
| ES 128 | M00056712C:A07 |
| ES 128 | M00056712C:B06 |
| ES 128 | M00056713D:G08 |
| ES 128 | M00056714C:H06 |
| ES 128 | M00056715A:D10 |
| ES 128 | M00056715A:E04 |
| ES 129 | M00056715A:G01 |
| ES 129 | M00056715B:C01 |
| ES 129 | M00056715D:C04 |
| ES 129 | M00056715D:E08 |
| ES 129 | M00056717B:C04 |
| ES 129 | M00056718C:B01 |
| ES 129 | M00056718C:G02 |
| ES 129 | M00056719A:D06 |
| ES 129 | M00056719A:F12 |
| ES 129 | M00056719B:A09 |
| ES 129 | M00056721A:F07 |
| ES 129 | M00056722A:G01 |
| ES 129 | M00056723B:D10 |
| ES 129 | M00056723C:C11 |
| ES 129 | M00056724D:E11 |
| ES 129 | M00056726C:G05 |
| ES 129 | M00056728A:H05 |
| ES 129 | M00056728B:D05 |
| ES 129 | M00056729B:D04 |
| ES 129 | M00056729C:H12 |
| ES 129 | M00056733C:D09 |
| ES 129 | M00056735D:B08 |
| ES 129 | M00056737B:G07 |
| ES 129 | M00056739A:D11 |
| ES 129 | M00056739B:D08 |
| ES 129 | M00056740C:B05 |
| ES 129 | M00056741B:C06 |
| ES 129 | M00056746D:A02 |
| ES 129 | M00056746D:D06 |
| ES 129 | M00056747A:D05 |
| ES 129 | M00056752A:E01 |
| ES 129 | M00056753D:A10 |
| ES 129 | M00056754A:A04 |
| ES 129 | M00056754B:D09 |
| ES 129 | M00056754B:H04 |
| ES 129 | M00056754D:A05 |
| ES 129 | M00056756A:A05 |
| ES 129 | M00056756D:B08 |
| ES 129 | M00056757B:F03 |
| ES 129 | M00056758B:C05 |
| ES 129 | M00056759A:F11 |
| ES 129 | M00056759B:G03 |
| ES 129 | M00056760D:A04 |
| ES 129 | M00056761A:F05 |
| ES 129 | M00056762C:E05 |
| ES 129 | M00056763D:D05 |
| ES 129 | M00056764A:E08 |
| ES 129 | M00056765A:A10 |
| ES 130 | M00056765C:E12 |
| ES 130 | M00056765D:D10 |
| ES 130 | M00056766B:A10 |
| ES 130 | M00056771C:F12 |
| ES 130 | M00056771D:C12 |
| ES 130 | M00056772A:A04 |
| ES 130 | M00056772D:A04 |
| ES 130 | M00056772D:E08 |
| ES 130 | M00056773A:H11 |
| ES 130 | M00056774B:A02 |
| ES 130 | M00056775D:A07 |
| ES 130 | M00056775D:C01 |
| ES 130 | M00056775D:C08 |
| ES 130 | M00056776A:A06 |
| ES 130 | M00056776D:D09 |
| ES 130 | M00056777B:C03 |
| ES 130 | M00056777D:B02 |
| ES 130 | M00056777D:F07 |
| ES 130 | M00056779A:E12 |
| ES 130 | M00056779D:H10 |
| ES 130 | M00056779D:H10 |
| ES 130 | M00056780D:C02 |
| ES 130 | M00056780D:F09 |
| ES 130 | M00056781C:E12 |
| ES 130 | M00056782D:B06 |
| ES 130 | M00056783B:G11 |
| ES 130 | M00056784A:B05 |
| ES 130 | M00056785B:F08 |
| ES 130 | M00056789A:C04 |
| ES 130 | M00056789D:E10 |
| ES 130 | M00056791D:F12 |
| ES 130 | M00056793C:H07 |
| ES 130 | M00056796A:H05 |
| ES 130 | M00056799B:E11 |
| ES 130 | M00056802B:H01 |
| ES 130 | M00056802B:H01 |
| ES 130 | M00056804B:E06 |
| ES 130 | M00056805D:B09 |
| ES 130 | M00056808B:B12 |
| ES 130 | M00056811A:C04 |
| ES 130 | M00056812C:E08 |
| ES 130 | M00056815A:B01 |
| ES 130 | M00056816B:A10 |
| ES 130 | M00056817C:C03 |
| ES 130 | M00056821D:C09 |
| ES 130 | M00056822C:G11 |
| ES 130 | M00056823C:B05 |
| ES 130 | M00056823A:A07 |
| ES 131 | M00056824B:C10 |
| ES 131 | M00056824D:E01 |
| ES 131 | M00056826A:B12 |
| ES 131 | M00056830C:G02 |
| ES 131 | M00056833C:C01 |
| ES 131 | M00056839A:G01 |
| ES 131 | M00056839A:G02 |
| ES 131 | M00056839C:F01 |
| ES 131 | M00056840D:H09 |
| ES 131 | M00056841D:G09 |
| ES 131 | M00056842B:F12 |

TABLE 113-continued

| ES No. | Clone Name |
|---|---|
| ES 131 | M00056842B:F12 |
| ES 131 | M00056843B:H09 |
| ES 131 | M00056844A:E07 |
| ES 131 | M00056844C:A10 |
| ES 131 | M00056848B:C07 |
| ES 131 | M00056850B:E11 |
| ES 131 | M00056850B:E11 |
| ES 131 | M00056857B:C09 |
| ES 131 | M00056858A:B03 |
| ES 131 | M00056858B:A12 |
| ES 131 | M00056859A:D12 |
| ES 131 | M00056860A:F12 |
| ES 131 | M00056863C:E03 |
| ES 131 | M00056864B:H09 |
| ES 131 | M00056866B:E05 |
| ES 131 | M00056868D:E09 |
| ES 131 | M00056870A:E10 |
| ES 131 | M00056872A:A06 |
| ES 131 | M00056873C:E06 |
| ES 131 | M00056874B:H06 |
| ES 131 | M00056874C:D05 |
| ES 131 | M00056874D:G01 |
| ES 131 | M00056879A:E05 |
| ES 131 | M00056879B:H11 |
| ES 131 | M00056879D:A02 |
| ES 131 | M00056880D:B04 |
| ES 131 | M00056883D:A07 |
| ES 131 | M00056884B:C06 |
| ES 131 | M00056885C:C06 |
| ES 131 | M00056886A:C11 |
| ES 131 | M00056887B:F08 |
| ES 131 | M00056892C:A01 |
| ES 131 | M00056893B:H06 |
| ES 131 | M00056894D:G06 |
| ES 131 | M00056895B:A07 |
| ES 131 | M00056896A:F05 |
| ES 131 | M00056896A:F10 |
| ES 132 | M00056898D:D04 |
| ES 132 | M00056901A:A06 |
| ES 132 | M00056902A:H12 |
| ES 132 | M00056909B:E11 |
| ES 132 | M00056909C:D09 |
| ES 132 | M00056911B:F02 |
| ES 132 | M00056913B:G10 |
| ES 132 | M00056914D:B09 |
| ES 132 | M00056916C:B02 |
| ES 132 | M00056916C:F04 |
| ES 132 | M00056921A:C07 |
| ES 132 | M00056923C:E09 |
| ES 132 | M00056924D:B06 |
| ES 132 | M00056925D:C07 |
| ES 132 | M00056939A:F08 |
| ES 132 | M00056939D:B02 |
| ES 132 | M00056941D:E02 |
| ES 132 | M00056945A:B11 |
| ES 132 | M00056947D:F09 |
| ES 132 | M00056949C:F06 |
| ES 132 | M00056951B:F09 |
| ES 132 | M00056952C:A06 |
| ES 132 | M00056952D:H04 |
| ES 132 | M00056953B:A06 |
| ES 132 | M00056955B:G09 |
| ES 132 | M00056956B:F01 |
| ES 132 | M00056960A:C05 |
| ES 132 | M00056961A:B08 |
| ES 132 | M00056961C:G12 |
| ES 132 | M00056964B:A02 |
| ES 132 | M00056966D:A11 |
| ES 132 | M00056967A:D02 |
| ES 132 | M00056967A:E07 |
| ES 132 | M00056969B:C08 |
| ES 132 | M00056969D:B01 |
| ES 132 | M00056972A:F05 |
| ES 132 | M00056973D:B08 |
| ES 132 | M00056974C:F04 |
| ES 132 | M00056976C:F10 |
| ES 132 | M00056977A:G03 |
| ES 132 | M00056985B:C05 |
| ES 132 | M00056986A:F11 |
| ES 132 | M00056986D:G01 |
| ES 132 | M00056990C:B09 |
| ES 132 | M00056990D:C11 |
| ES 132 | M00056993A:B06 |
| ES 132 | M00056993D:D03 |
| ES 132 | M00056994B:F07 |
| ES 133 | M00056994C:C03 |
| ES 133 | M00056996D:A12 |
| ES 133 | M00056997C:H09 |
| ES 133 | M00056998A:E08 |
| ES 133 | M00057002D:B05 |
| ES 133 | M00057002D:B06 |
| ES 133 | M00057003B:B09 |
| ES 133 | M00057005B:C01 |
| ES 133 | M00057005C:D03 |
| ES 133 | M00057007C:B12 |
| ES 133 | M00057008C:E09 |
| ES 133 | M00057011A:D03 |
| ES 133 | M00057013B:D01 |
| ES 133 | M00057015A:C12 |
| ES 133 | M00057019C:H02 |
| ES 133 | M00057023A:H09 |
| ES 133 | M00057024A:E02 |
| ES 133 | M00057024A:G05 |
| ES 133 | M00057024D:H08 |
| ES 133 | M00057025C:A08 |
| ES 133 | M00057027C:G06 |
| ES 133 | M00057028D:D09 |
| ES 133 | M00057029A:C12 |
| ES 133 | M00057029D:A06 |
| ES 133 | M00057033A:F09 |
| ES 133 | M00057035B:C09 |
| ES 133 | M00057041D:B11 |
| ES 133 | M00057044C:F06 |
| ES 133 | M00057047B:C02 |
| ES 133 | M00057049A:G06 |
| ES 133 | M00057049C:H05 |
| ES 133 | M00057052D:B11 |
| ES 133 | M00057052D:G09 |
| ES 133 | M00057055B:G08 |
| ES 133 | M00057055B:G08 |
| ES 133 | M00057058C:F09 |
| ES 133 | M00057059D:F06 |
| ES 133 | M00057059D:H09 |
| ES 133 | M00057060B:A12 |
| ES 133 | M00057061C:D04 |
| ES 133 | M00057063A:C08 |
| ES 133 | M00057065C:D04 |
| ES 133 | M00057066A:A04 |
| ES 133 | M00057070D:B08 |
| ES 133 | M00057072B:E02 |
| ES 133 | M00057073D:A05 |
| ES 133 | M00057074D:C09 |
| ES 133 | M00057074D:C09 |
| ES 134 | M00055909B:G01 |
| ES 134 | M00055909C:E08 |
| ES 134 | M00055911B:E06 |
| ES 134 | M00055912C:E10 |
| ES 134 | M00055912D:C05 |
| ES 134 | M00055913B:D05 |
| ES 134 | M00055919A:A06 |
| ES 134 | M00055921A:E03 |
| ES 134 | M00055921B:B11 |
| ES 134 | M00055922A:C02 |
| ES 134 | M00055924A:H11 |
| ES 134 | M00055930A:B08 |
| ES 134 | M00055931A:A03 |
| ES 134 | M00055931A:C01 |
| ES 134 | M00055931B:E01 |
| ES 134 | M00055936B:E07 |
| ES 134 | M00055937B:C02 |
| ES 134 | M00055941B:B12 |
| ES 134 | M00055941B:B12 |
| ES 134 | M00055945A:H11 |
| ES 134 | M00055945B:E10 |
| ES 134 | M00055946D:G07 |
| ES 134 | M00055951C:C02 |

TABLE 113-continued

| ES No. | Clone Name |
|---|---|
| ES 134 | M00055956C:E02 |
| ES 134 | M00055958D:F02 |
| ES 134 | M00055959D:A12 |
| ES 134 | M00055966C:A03 |
| ES 134 | M00055966C:D06 |
| ES 134 | M00055971C:E07 |
| ES 134 | M00055973A:D04 |
| ES 134 | M00055976B:F01 |
| ES 134 | M00055979B:B09 |
| ES 134 | M00055980A:A10 |
| ES 134 | M00055981D:A07 |
| ES 134 | M00055984C:C02 |
| ES 134 | M00055985D:D01 |
| ES 134 | M00055990C:B05 |
| ES 134 | M00055992C:E11 |
| ES 134 | M00056139D:E04 |
| ES 134 | M00056139D:G01 |
| ES 134 | M00056140B:H07 |
| ES 134 | M00056140D:E07 |
| ES 134 | M00056141A:D05 |
| ES 134 | M00056141D:B09 |
| ES 134 | M00056143A:E09 |
| ES 134 | M00056144B:C09 |
| ES 134 | M00056145C:B04 |
| ES 134 | M00056149C:B01 |
| ES 135 | M00056150B:C12 |
| ES 135 | M00056153C:D01 |
| ES 135 | M00056156D:A12 |
| ES 135 | M00056160D:A08 |
| ES 135 | M00056161D:G04 |
| ES 135 | M00056162B:F08 |
| ES 135 | M00056162B:F08 |
| ES 135 | M00056162D:D06 |
| ES 135 | M00056162D:E09 |
| ES 135 | M00056167D:B08 |
| ES 135 | M00056169A:F06 |
| ES 135 | M00056171C:H11 |
| ES 135 | M00056171C:H12 |
| ES 135 | M00056180B:H09 |
| ES 135 | M00056184B:D08 |
| ES 135 | M00056184C:H03 |
| ES 135 | M00056184D:F01 |
| ES 135 | M00056185D:A03 |
| ES 135 | M00056185D:D06 |
| ES 135 | M00056186C:F02 |
| ES 135 | M00056190D:G02 |
| ES 135 | M00056192D:E04 |
| ES 135 | M00056192D:H02 |
| ES 135 | M00056195B:C08 |
| ES 135 | M00056198A:D07 |
| ES 135 | M00056199D:A09 |
| ES 135 | M00056201C:H08 |
| ES 135 | M00056203A:H10 |
| ES 135 | M00056204B:A04 |
| ES 135 | M00056205B:D01 |
| ES 135 | M00056206A:E06 |
| ES 136 | M00055997C:G11 |
| ES 136 | M00055999C:G10 |
| ES 136 | M00055999D:G06 |
| ES 136 | M00056000A:F12 |
| ES 136 | M00056000C:D09 |
| ES 136 | M00056001A:B06 |
| ES 136 | M00056001A:B07 |
| ES 136 | M00056001C:E09 |
| ES 136 | M00056003A:E06 |
| ES 136 | M00056005B:E05 |
| ES 136 | M00056005D:C04 |
| ES 136 | M00056007A:A11 |
| ES 136 | M00056007C:F06 |
| ES 136 | M00056016D:D06 |
| ES 136 | M00056018B:G05 |
| ES 136 | M00056020A:D10 |
| ES 136 | M00056020D:D07 |
| ES 136 | M00056028C:F03 |
| ES 136 | M00056036D:B06 |
| ES 136 | M00056037C:B02 |
| ES 136 | M00056038D:F04 |
| ES 136 | M00056041A:C04 |
| ES 136 | M00056042A:A01 |
| ES 136 | M00056045D:H01 |
| ES 136 | M00056050C:A03 |
| ES 136 | M00056053A:A09 |
| ES 136 | M00056053A:D12 |
| ES 136 | M00056055A:A07 |
| ES 136 | M00056055B:B01 |
| ES 136 | M00056055C:D03 |
| ES 136 | M00056058A:H04 |
| ES 136 | M00056060B:B10 |
| ES 136 | M00056061B:F06 |
| ES 136 | M00056066D:H07 |
| ES 136 | M00056067B:D08 |
| ES 136 | M00056074D:G10 |
| ES 136 | M00056077D:E06 |
| ES 136 | M00056077D:E12 |
| ES 136 | M00056077D:E12 |
| ES 136 | M00056079B:D12 |
| ES 136 | M00056079B:F07 |
| ES 136 | M00056079C:C11 |
| ES 136 | M00056081D:B05 |
| ES 136 | M00056081D:B09 |
| ES 136 | M00056082C:F06 |
| ES 136 | M00056085D:H11 |
| ES 136 | M00056094A:H07 |
| ES 136 | M00056098A:H01 |
| ES 136 | M00056099B:G09 |
| ES 136 | M00056099B:H11 |
| ES 136 | M00056099B:H11 |
| ES 136 | M00056103A:D12 |
| ES 136 | M00056103C:H12 |
| ES 136 | M00056107B:E06 |
| ES 136 | M00056108D:B12 |
| ES 136 | M00056108D:B12 |
| ES 136 | M00056110C:D09 |
| ES 136 | M00056111D:H02 |
| ES 136 | M00056112A:H02 |
| ES 136 | M00056114C:C06 |
| ES 136 | M00056125B:D09 |
| ES 136 | M00056128C:B10 |
| ES 136 | M00056131B:C12 |
| ES 136 | M00056133D:D09 |
| ES 136 | M00056136A:B11 |

The above material has been deposited with the American Type Culture Collection, Rockville, Md., under the accession number indicated. These deposits will be maintained under the terms of the Budapest Treaty on the International Recognition of the Deposit of Microorganisms for the Purposes of Patent Procedure. The deposit will be maintained for a period of at least 30 years following issuance of this patent, or for the enforceable life of the patent, whichever is greater. Upon the granting of a patent, all restrictions on the availability to the public of the deposited material will be irrevocably removed.

The deposits described herein are provided merely as convenience to those of skill in the art, and is not an admission that a deposit is required under 35 U.S.C. §112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby.

Retrieval of Individual Clones from Deposit of Pooled Clones. Where the ATCC deposit is composed of a pool of cDNA clones or a library of cDNA clones, the deposit was prepared by first transfecting each of the clones into separate bacterial cells. The clones in the pool or library were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

Example 77

Source of Biological Materials and Overview of Novel Polynucleotides Expressed by the Biological Materials cDNA libraries were constructed from mRNA isolated from the GRRpz or and WOca cells, which were provided by Dr. Donna M. Peehl, Department of Medicine, Stanford University School of Medicine. GRRpz cells were primary cells derived from normal prostate epithelium. The WOca cells were prostate epithelial cells derived from prostate cancer Gleason Grade 4+4. Polynucleotides expressed by these cells were isolated and analyzed; the sequences of these polynucleotides were about 275-300 nucleotides in length.

The sequences of the isolated polynucleotides were first masked to eliminate low complexity sequences using the XBLAST masking program (Claverie "Effective Large-Scale Sequence Similarity Searches," In: *Computer Methods for Macromolecular Sequence Analysis*, Doolittle, ed., *Meth. Enzymol.* 266:212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. *Comput. Chem.* (1993) 17:191). Generally, masking does not influence the final search results, except to eliminate sequences of relative little interest due to their low complexity, and to eliminate multiple "hits" based on similarity to repetitive regions common to multiple sequences, e.g., Alu repeats. The remaining sequences were then used in a BLASTN vs. GenBank search; sequences that exhibited greater than 70% overlap, 99% identity, and a p value of less than $1\times10^{-40}$ were discarded. Sequences from this search also were discarded if the inclusive parameters were met, but the sequence was ribosomal or vector-derived.

The resulting sequences from the previous search were classified into three groups (1, 2 and 3 below) and searched in a BLASTX vs. NRP (non-redundant proteins) database search: (1) unknown (no hits in the GenBank search), (2) weak similarity (greater than 45% identity and p value of less than $1\times10^{-5}$), and (3) high similarity (greater than 60% overlap, greater than 80% identity, and p value less than $1\times10^{-5}$). Sequences having greater than 70% overlap, greater than 99% identity, and p value of less than $1\times10^{-40}$ were discarded.

The remaining sequences were classified as unknown (no hits), weak similarity, and high similarity (parameters as above). Two searches were performed on these sequences. First, a BLAST vs. EST database search was performed and sequences with greater than 99% overlap, greater than 99% similarity and a p value of less than $1\times10^{-40}$ were discarded. Sequences with a p value of less than $1\times10^{-65}$ when compared to a database sequence of human origin were also excluded. Second, a BLASTN vs. Patent GeneSeq database was performed and sequences having greater than 99% identity, p value less than $1\times10^{-40}$, and greater than 99% overlap were discarded.

The remaining sequences were subjected to screening using other rules and redundancies in the dataset. Sequences with a p value of less than $1\times10^{-111}$ in relation to a database sequence of human origin were specifically excluded. The final result provided the 316 sequences listed as SEQ ID NOS:15667-15982 in the accompanying Sequence Listing and summarized in Table 120 (inserted prior to claims). Each identified polynucleotide represents sequence from at least a partial mRNA transcript. Many of the sequences include the sequence ggcacgag at the 5' end; this sequence is a sequencing artifact and not part of the sequence of the polynucleotides of the invention.

Table 120 provides: 1) the SEQ ID NO ("SEQ ID") assigned to each sequence for use in the present specification; 2) the Cluster Identification No. ("CLUSTER"); 3) the sequence name ("SEQ NAME") used as an internal identifier of the sequence; 4) the orientation of the sequence ("ORIENT"); 5) the name assigned to the clone from which the sequence was isolated ("CLONE ID"); and the name of the library from which the sequence was isolated ("LIBRARY"). CH22PRC indicates the sequence was isolated from Library 22; CH21PRN indicates the sequence was isolated from Library 21. A description of the libraries is provided in Table 122 below. Because the provided polynucleotides represent partial mRNA transcripts, two or more polynucleotides of the invention may represent different regions of the same mRNA transcript and the same gene. Thus, if two or more SEQ ID NOS: are identified as belonging to the same clone, then either sequence can be used to obtain the full-length mRNA or gene.

Example 78

Results of Public Database Search to Identify Function of Gene Products

SEQ ID NOS: 15667-15982 were translated in all three reading frames, and the nucleotide sequences and translated amino acid sequences used as query sequences to search for homologous sequences in either the GenBank (nucleotide sequences) or Non-Redundant Protein (amino acid sequences) databases. Query and individual sequences were aligned using the BLAST 2.0 programs, available over the world wide web at a site sponsored by the National Center for Biotechnology Information, which is supported by the National Library of Medicine and the National Institutes of Health (see also Altschul, et al. *Nucleic Acids Res.* (1997) 25:3389-3402). The sequences were masked to various extents to prevent searching of repetitive sequences or poly-A sequences, using the XBLAST program for masking low complexity as described above in Example 77.

Table 121 (inserted before the claims) provide the alignment summaries having a p value of $1\times10^{-2}$ or less indicating substantial homology between the sequences of the present invention and those of the indicated public databases. Specifically, Table 121 provides the SEQ ID NO of the query sequence, the accession number of the GenBank database entry of the homologous sequence, and the p value of the alignment. Table 121 also provides the SEQ ID NO of the query sequence, the accession number of the Non-Redundant Protein database entry of the homologous sequence, and the p value of the alignment. The alignments provided in Table 121 are the best available alignment to a DNA or amino acid sequence at a time just prior to filing of the present specification. The activity of the polypeptide encoded by the SEQ ID NOS listed in Table 121 can be extrapolated to be substantially the same or substantially similar to the activity of the reported nearest neighbor or closely related sequence. The accession number of the nearest neighbor is reported, providing a publicly available reference to the activities and functions exhibited by the nearest neighbor. The public information regarding the activities and functions of each of the nearest neighbor sequences is incorporated by reference in this application. Also incorporated by reference is all publicly available information regarding the sequence, as well as the putative and actual activities and functions of the nearest neighbor sequences listed in Table 121 and their related sequences. The search program and database used for the alignment, as well as the calculation of the p value are also indicated.

Full length sequences or fragments of the polynucleotide sequences of the nearest neighbors can be used as probes and primers to identify and isolate the full length sequence of the corresponding polynucleotide. The nearest neighbors can indicate a tissue or cell type to be used to construct a library for the full-length sequences of the corresponding polynucleotides.

TABLE 120

| SEQ ID | CLUSTER | SEQ NAME | ORIENT | CLONE ID | LIBRARY |
|---|---|---|---|---|---|
| 15667 | 819545 | RTA22200265F.k.06.1.P.Seq | F | M00064554D:A03 | CH22PRC |
| 15668 | 377944 | RTA22200251F.j.02.1.P.Seq | F | M00063482A:A08 | CH21PRN |
| 15669 | 818497 | RTA22200252F.a.13.1.P.Seq | F | M00063514C:D03 | CH21PRN |
| 15670 | 819498 | RTA22200252F.n.05.1.P.Seq | F | M00063638C:G12 | CH21PRN |
| 15671 | 455465 | RTA22200264F.e.16.1.P.Seq | F | M00064454A:H10 | CH22PRC |
| 15672 | 819069 | RTA22200255F.f.01.1.P.Seq | F | M00063940D:F09 | CH21PRN |
| 15673 | 672003 | RTA22200265F.b.09.1.P.Seq | F | M00064517C:F11 | CH22PRC |
| 15674 | 728115 | RTA22200253F.o.24.1.P.Seq | F | M00063838B:G08 | CH21PRN |
| 15675 | 372700 | RTA22200260F.b.20.1.P.Seq | F | M00063580C:A06 | CH22PRC |
| 15676 | 818056 | RTA22200266F.c.13.1.P.Seq | F | M00064593D:C01 | CH22PRC |
| 15677 | 818497 | RTA22200255F.a.17.1.P.Seq | F | M00063920D:H02 | CH21PRN |
| 15678 | 729832 | RTA22200267F.l.21.1.P.Seq | F | M00064714A:G03 | CH22PRC |
| 15679 | 505514 | RTA22200251F.b.21.1.P.Seq | F | M00063158A:A01 | CH21PRN |
| 15680 | 376488 | RTA22200254F.c.05.1.P.Seq | F | M00063852B:D08 | CH21PRN |
| 15681 | 376488 | RTA22200260F.b.09.1.P.Seq | F | M00063578B:A06 | CH22PRC |
| 15682 | 748572 | RTA22200254F.c.07.1.P.Seq | F | M00063852D:F07 | CH21PRN |
| 15683 | 549934 | RTA22200253F.k.18.1.P.Seq | F | M00063801B:D04 | CH21PRN |
| 15684 | 819069 | RTA22200255F.e.24.1.P.Seq | F | M00063940D:F09 | CH21PRN |
| 15685 | 817618 | RTA22200253F.n.16.1.P.Seq | F | M00063828D:E05 | CH21PRN |
| 15686 | 124396 | RTA22200263F.a.11.2.P.Seq | F | M00064375B:G07 | CH22PRC |
| 15687 | 404375 | RTA22200260F.m.08.1.P.Seq | F | M00063967D:G02 | CH22PRC |
| 15688 | 391820 | RTA22200261F.f.02.1.P.Seq | F | M00064000B:C03 | CH22PRC |
| 15689 | 672003 | RTA22200267F.i.06.1.P.Seq | F | M00064693D:F08 | CH22PRC |
| 15690 | 830620 | RTA22200263F.n.09.1.P.Seq | F | M00064424B:C12 | CH22PRC |
| 15691 | 450399 | RTA22200251F.f.23.1.P.Seq | F | M00063467D:H07 | CH21PRN |
| 15692 | 450982 | RTA22200261F.n.18.1.P.Seq | F | M00064307B:G02 | CH22PRC |
| 15693 | 819894 | RTA22200264F.h.18.1.P.Seq | F | M00064467B:D06 | CH22PRC |
| 15694 | 379302 | RTA22200257F.j.02.3.P.Seq | F | M00064178C:C04 | CH21PRN |
| 15695 | 379746 | RTA22200256F.e.16.1.P.Seq | F | M00064086C:E01 | CH21PRN |
| 15696 | 124863 | RTA22200265F.m.06.1.P.Seq | F | M00064564A:C02 | CH22PRC |
| 15697 | 379154 | RTA22200257F.c.11.1.P.Seq | F | M00064151B:C07 | CH21PRN |
| 15698 | 830620 | RTA22200262F.l.23.1.P.Seq | F | M00064358C:D09 | CH22PRC |
| 15699 | 389409 | RTA22200266F.l.24.1.P.Seq | F | M00064631A:C07 | CH22PRC |
| 15700 | 397284 | RTA22200262F.i.22.1.P.Seq | F | M00064346C:B09 | CH22PRC |
| 15701 | 819440 | RTA22200264F.e.19.1.P.Seq | F | M00064454C:B06 | CH22PRC |
| 15702 | 389409 | RTA22200266F.m.01.1.P.Seq | F | M00064631A:C07 | CH22PRC |
| 15703 | 518848 | RTA22200265F.n.15.1.P.Seq | F | M00064571C:C04 | CH22PRC |
| 15704 | 830620 | RTA22200263F.a.21.1.P.Seq | F | M00064376A:A05 | CH22PRC |
| 15705 | 379154 | RTA22200256F.f.20.1.P.Seq | F | M00064090D:D09 | CH21PRN |
| 15706 | 818544 | RTA22200256F.h.04.1.P.Seq | F | M00064105B:A03 | CH21PRN |
| 15707 | 817375 | RTA22200251F.a.15.1.P.Seq | F | M00063152C:B07 | CH21PRN |
| 15708 | 455264 | RTA22200259F.e.23.1.P.Seq | F | M00063539C:C11 | CH22PRC |
| 15709 | 817503 | RTA22200266F.k.11.1.P.Seq | F | M00064624D:C09 | CH22PRC |
| 15710 | 377696 | RTA22200256F.d.21.1.P.Seq | F | M00064082D:D10 | CH21PRN |
| 15711 | 375596 | RTA22200261F.h.10.1.P.Seq | F | M00064009A:C01 | CH22PRC |
| 15712 | 817689 | RTA22200263F.h.05.1.P.Seq | F | M00064399A:E01 | CH22PRC |
| 15713 | 831867 | RTA22200262F.i.15.2.P.Seq | F | M00064345A:A03 | CH22PRC |
| 15714 | 830085 | RTA22200261F.k.14.1.P.Seq | F | M00064293D:B12 | CH22PRC |
| 15715 | 389627 | RTA22200264F.c.10.1.P.Seq | F | M00064447B:C06 | CH22PRC |
| 15716 | 397284 | RTA22200259F.k.09.1.P.Seq | F | M00063555B:D01 | CH22PRC |
| 15717 | 380063 | RTA22200261F.j.02.1.P.Seq | F | M00064014D:H05 | CH22PRC |
| 15718 | 830931 | RTA22200266F.m.23.1.P.Seq | F | M00064633C:A03 | CH22PRC |
| 15719 | 819321 | RTA22200257F.l.03.3.P.Seq | F | M00064194C:D02 | CH21PRN |
| 15720 | 475587 | RTA22200261F.c.01.1.P.Seq | F | M00063990A:D05 | CH22PRC |
| 15721 | 819046 | RTA22200255F.a.18.1.P.Seq | F | M00063920D:H05 | CH21PRN |
| 15722 | 817477 | RTA22200253F.g.21.1.P.Seq | F | M00063784A:H12 | CH21PRN |
| 15723 | 475587 | RTA22200261F.b.24.1.P.Seq | F | M00063990A:D05 | CH22PRC |
| 15724 | 728115 | RTA22200253F.p.01.1.P.Seq | F | M00063838B:G08 | CH21PRN |
| 15725 | 389627 | RTA22200260F.i.24.1.P.Seq | F | M00063957A:E02 | CH22PRC |

TABLE 120-continued

| SEQ ID | CLUSTER | SEQ NAME | ORIENT | CLONE ID | LIBRARY |
|---|---|---|---|---|---|
| 15726 | 403453 | RTA22200256F.i.24.1.P.Seq | F | M00064113B:C04 | CH21PRN |
| 15727 | 508525 | RTA22200255F.d.10.1.P.Seq | F | M00063931B:F07 | CH21PRN |
| 15728 | 819525 | RTA22200261F.n.20.1.P.Seq | F | M00064307C:G03 | CH22PRC |
| 15729 | 817618 | RTA22200255F.i.03.1.P.Seq | F | M00064025D:H12 | CH21PRN |
| 15730 | 819403 | RTA22200254F.h.14.1.P.Seq | F | M00063888D:D05 | CH21PRN |
| 15731 | 553242 | RTA22200254F.g.20.1.P.Seq | F | M00063886A:B06 | CH21PRN |
| 15732 | 817417 | RTA22200255F.a.10.1.P.Seq | F | M00063919C:E07 | CH21PRN |
| 15733 | 817618 | RTA22200252F.f.13.1.P.Seq | F | M00063604A:B11 | CH21PRN |
| 15734 | 611440 | RTA22200262F.e.04.2.P.Seq | F | M00064328B:H09 | CH22PRC |
| 15735 | 817375 | RTA22200260F.m.06.1.P.Seq | F | M00063967C:A12 | CH22PRC |
| 15736 | 213577 | RTA22200255F.i.23.1.P.Seq | F | M00064033C:C11 | CH21PRN |
| 15737 | 820061 | RTA22200265F.p.10.1.P.Seq | F | M00064579D:E11 | CH22PRC |
| 15738 | 455264 | RTA22200259F.m.06.1.P.Seq | F | M00063559D:G03 | CH22PRC |
| 15739 | 455264 | RTA22200255F.o.23.1.P.Seq | F | M00064059A:C11 | CH21PRN |
| 15740 | 380331 | RTA22200255F.b.19.1.P.Seq | F | M00063926A:H04 | CH21PRN |
| 15741 | 380331 | RTA22200252F.b.19.1.P.Seq | F | M00063518D:A01 | CH21PRN |
| 15742 | 817455 | RTA22200267F.o.01.1.P.Seq | F | M00064723D:H03 | CH22PRC |
| 15743 | 423967 | RTA22200252F.a.20.1.P.Seq | F | M00063515B:H02 | CH21PRN |
| 15744 | 220584 | RTA22200261F.m.14.1.P.Seq | F | M00064302A:D10 | CH22PRC |
| 15745 | 817688 | RTA22200251F.e.20.1.P.Seq | F | M00063462D:D07 | CH21PRN |
| 15746 | 549934 | RTA22200253F.n.10.1.P.Seq | F | M00063826A:D03 | CH21PRN |
| 15747 | 819149 | RTA22200255F.e.16.1.P.Seq | F | M00063938B:H07 | CH21PRN |
| 15748 | 817455 | RTA22200267F.n.24.1.P.Seq | F | M00064723D:H03 | CH22PRC |
| 15749 | 377696 | RTA22200251F.j.03.1.P.Seq | F | M00063482A:F07 | CH21PRN |
| 15750 | 830146 | RTA22200260F.b.07.1.P.Seq | F | M00063578B:E02 | CH22PRC |
| 15751 | 194490 | RTA22200264F.l.07.1.P.Seq | F | M00064481C:F03 | CH22PRC |
| 15752 | 819460 | RTA22200257F.m.15.3.P.Seq | F | M00064200D:E08 | CH21PRN |
| 15753 | 819018 | RTA22200257F.p.01.3.P.Seq | F | M00064212D:E04 | CH21PRN |
| 15754 | 830620 | RTA22200259F.p.24.1.P.Seq | F | M00063571B:G03 | CH22PRC |
| 15755 | 141079 | RTA22200262F.k.19.1.P.Seq | F | M00064354A:A10 | CH22PRC |
| 15756 | 376588 | RTA22200256F.e.04.1.P.Seq | F | M00064083D:E05 | CH21PRN |
| 15757 | 380604 | RTA22200264F.g.05.1.P.Seq | F | M00064460C:B01 | CH22PRC |
| 15758 | 413138 | RTA22200260F.b.05.1.P.Seq | F | M00063577C:C02 | CH22PRC |
| 15759 | 818544 | RTA22200265F.e.12.1.P.Seq | F | M00064527A:H07 | CH22PRC |
| 15760 | 647435 | RTA22200257F.h.08.1.P.Seq | F | M00064172C:A02 | CH21PRN |
| 15761 | 551785 | RTA22200266F.c.09.1.P.Seq | F | M00064593A:A05 | CH22PRC |
| 15762 | 17092 | RTA22200261F.f.17.1.P.Seq | F | M00064002C:F06 | CH22PRC |
| 15763 | 818326 | RTA22200251F.i.06.1.P.Seq | F | M00063478C:D01 | CH21PRN |
| 15764 | 377944 | RTA22200262F.e.03.2.P.Seq | F | M00064328B:H04 | CH22PRC |
| 15765 | 745559 | RTA22200262F.m.04.1.P.Seq | F | M00064359B:H12 | CH22PRC |
| 15766 | 818326 | RTA22200265F.d.08.1.P.Seq | F | M00064524A:A09 | CH22PRC |
| 15767 | 379879 | RTA22200264F.b.23.1.P.Seq | F | M00064446A:D11 | CH22PRC |
| 15768 | 819640 | RTA22200257F.f.24.1.P.Seq | F | M00064165A:B12 | CH21PRN |
| 15769 | 818326 | RTA22200265F.a.14.1.P.Seq | F | M00064514D:F11 | CH22PRC |
| 15770 | 243524 | RTA22200265F.g.04.1.P.Seq | F | M00064532D:G06 | CH22PRC |
| 15771 | 43995 | RTA22200261F.l.02.1.P.Seq | F | M00064294D:F01 | CH22PRC |
| 15772 | 597854 | RTA22200262F.g.06.2.P.Seq | F | M00064337D:F01 | CH22PRC |
| 15773 | 268290 | RTA22200260F.p.14.1.P.Seq | F | M00063981D:A06 | CH22PRC |
| 15774 | 818043 | RTA22200256F.p.10.2.P.Seq | F | M00064138A:F11 | CH21PRN |
| 15775 | 830930 | RTA22200267F.b.03.1.P.Seq | F | M00064652B:D09 | CH22PRC |
| 15776 | 389627 | RTA22200260F.j.01.1.P.Seq | F | M00063957A:E02 | CH22PRC |
| 15777 | 378730 | RTA22200260F.i.07.1.P.Seq | F | M00063955C:F07 | CH22PRC |
| 15778 | 819037 | RTA22200260F.n.09.1.P.Seq | F | M00063972C:E10 | CH22PRC |
| 15779 | 830397 | RTA22200261F.g.14.1.P.Seq | F | M00064005D:A08 | CH22PRC |
| 15780 | 450247 | RTA22200261F.e.10.1.P.Seq | F | M00063998C:E09 | CH22PRC |
| 15781 | 819273 | RTA22200252F.b.09.1.P.Seq | F | M00063517A:A04 | CH21PRN |
| 15782 | 587779 | RTA22200257F.i.11.3.P.Seq | F | M00064175B:B09 | CH21PRN |
| 15783 | 818639 | RTA22200256F.j.09.1.P.Seq | F | M00064115B:E12 | CH21PRN |
| 15784 | 615617 | RTA22200261F.o.13.1.P.Seq | F | M00064309C:H09 | CH22PRC |
| 15785 | 79309 | RTA22200257F.j.13.3.P.Seq | F | M00064180A:G03 | CH21PRN |
| 15786 | 748994 | RTA22200261F.o.20.1.P.Seq | F | M00064310C:A10 | CH22PRC |
| 15787 | 818682 | RTA22200258F.h.07.1.P.Seq | F | M00064271B:D03 | CH21PRN |
| 15788 | 373061 | RTA22200253F.j.09.1.P.Seq | F | M00063795C:D09 | CH21PRN |
| 15789 | 484413 | RTA22200253F.g.09.1.P.Seq | F | M00063781B:B10 | CH21PRN |
| 15790 | 819273 | RTA22200258F.h.04.1.P.Seq | F | M00064270B:B03 | CR21PRN |
| 15791 | 569532 | RTA22200252F.h.18.1.P.Seq | F | M00063613D:C11 | CH21PRN |
| 15792 | 170313 | RTA22200255F.g.20.1.P.Seq | F | M00063949D:A05 | CH21PRN |
| 15793 | 818682 | RTA22200253F.p.14.1.P.Seq | F | M00063841A:B09 | CH21PRN |
| 15794 | 377188 | RTA22200255F.l.06.1.P.Seq | F | M00064043D:C09 | CH21PRN |
| 15795 | 518848 | RTA22200257F.j.22.3.P.Seq | F | M00064186C:B03 | CH21PRN |
| 15796 | 45592 | RTA22200259F.l.08.1.P.Seq | F | M00063557D:C07 | CH22PRC |
| 15797 | 819273 | RTA22200255F.n.19.1.P.Seq | F | M00064053C:G04 | CH21PRN |
| 15798 | 397284 | RTA22200251F.a.06.1.P.Seq | F | M00063151D:B10 | CH21PRN |
| 15799 | 818326 | RTA22200258F.e.14.1.P.Seq | F | M00064260C:E05 | CR21PRN |
| 15800 | 819037 | RTA22200251F.c.15.1.P.Seq | F | M00063452A:F08 | CH21PRN |
| 15801 | 817417 | RTA22200253F.m.14.1.P.Seq | F | M00063818C:A09 | CH21PRN |
| 15802 | 819640 | RTA22200254F.i.11.1.P.Seq | F | M00063891A:F11 | CH21PRN |

TABLE 120-continued

| SEQ ID | CLUSTER | SEQ NAME | ORIENT | CLONE ID | LIBRARY |
|---|---|---|---|---|---|
| 15803 | 818771 | RTA22200254F.i.19.1.P.Seq | F | M00063892B:G02 | CR21PRN |
| 15804 | 389627 | RTA22200254F.k.10.1.P.Seq | F | M00063898A:A10 | CH21PRN |
| 15805 | 379067 | RTA22200260F.e.20.1.P.Seq | F | M00063593A:D03 | CH22PRC |
| 15806 | 818544 | RTA22200251F.f.02.1.P.Seq | F | M00063463D:B05 | CH21PRN |
| 15807 | 819440 | RTA22200251F.j.22.1.P.Seq | F | M00063485A:E05 | CH21PRN |
| 15808 | 817417 | RTA22200251F.k.10.1.P.Seq | F | M00063487C:C02 | CH21PRN |
| 15809 | 385307 | RTA22200262F.k.11.1.P.Seq | F | M00064352C:H01 | CH22PRC |
| 15810 | 611440 | RTA22200263F.d.24.2.P.Seq | F | M00064386B:C02 | CH22PRC |
| 15811 | 376056 | RTA22200259F.e.16.1.P.Seq | F | M00063538D:B01 | CH22PRC |
| 15812 | 611440 | RTA22200263F.d.24.1.P.Seq | F | M00064386B:C02 | CH22PRC |
| 15813 | 820061 | RTA22200264F.f.09.1.P.Seq | F | M00064457D:C09 | CH22PRC |
| 15814 | 617825 | RTA22200264F.p.06.1.P.Seq | F | M00064508A:B09 | CH22PRC |
| 15815 | 819440 | RTA22200257F.h.17.1.P.Seq | F | M00064173B:E01 | CH21PRN |
| 15816 | 819145 | RTA22200266F.m.08.1.P.Seq | F | M00064631C:H11 | CH22PRC |
| 15817 | 817653 | RTA22200265F.p.07.1.P.Seq | F | M00064579A:C06 | CH22PRC |
| 15818 | 611440 | RTA22200263F.e.01.1.P.Seq | F | M00064386B:C02 | CH22PRC |
| 15819 | 375958 | RTA22200264F.j.22.1.P.Seq | F | M00064476D:C04 | CH22PRC |
| 15820 | 611440 | RTA22200257F.a.20.1.P.Seq | F | M00064144D:A07 | CH21PRN |
| 15821 | 831049 | RTA22200266F.o.13.1.P.Seq | F | M00064637B:F03 | CH22PRC |
| 15822 | 818162 | RTA22200266F.g.18.1.P.Seq | F | M00064610D:H01 | CH22PRC |
| 15823 | 553200 | RTA22200263F.p.02.1.P.Seq | F | M00064429D:B07 | CH22PRC |
| 15824 | 139677 | RTA22200254F.o.07.1.P.Seq | F | M00063910D:A12 | CH21PRN |
| 15825 | 139677 | RTA22200252F.c.11.1.P.Seq | F | M00063520D:E11 | CH21PRN |
| 15826 | 397284 | RTA22200262F.i.22.2.P.Seq | F | M00064346C:B09 | CH22PRC |
| 15827 | 385810 | RTA22200256F.m.04.2.P.Seq | F | M00064126C:F12 | CH21PRN |
| 15828 | 404624 | RTA22200261F.e.07.1.P.Seq | F | M00063997C:B12 | CH22PRC |
| 15829 | 375958 | RTA22200262F.b.14.2.P.Seq | F | M00064322C:A10 | CH22PRC |
| 15830 | 616555 | RTA22200265F.b.24.1.P.Seq | F | M00064520A:E04 | CH22PRC |
| 15831 | 616555 | RTA22200265F.c.01.1.P.Seq | F | M00064520A:E04 | CH22PRC |
| 15832 | 295694 | RTA22200260F.o.20.1.P.Seq | F | M00063978B:B06 | CH22PRC |
| 15833 | 36113 | RTA22200265F.e.06.1.P.Seq | F | M00064526D:F05 | CH22PRC |
| 15834 | 831812 | RTA22200263F.f.05.1.P.Seq | F | M00064390A:C05 | CH22PRC |
| 15835 | 817653 | RTA22200252F.g.23.1.P.Seq | F | M00063610D:C11 | CH21PRN |
| 15836 | 397284 | RTA22200252F.m.15.1.P.Seq | F | M00063636A:E01 | CH21PRN |
| 15837 | 817979 | RTA22200253F.p.15.1.P.Seq | F | M00063841A:E08 | CH21PRN |
| 15838 | 817653 | RTA22200255F.m.18.1.P.Seq | F | M00064048C:G12 | CH21PRN |
| 15839 | 611440 | RTA22200253F.f.03.1.P.Seq | F | M00063774A:D09 | CH21PRN |
| 15840 | 386014 | RTA22200261F.f.06.1.P.Seq | F | M00064001A:B03 | CH22PRC |
| 15841 | 549981 | RTA22200255F.b.10.1.P.Seq | F | M00063925B:F04 | CH21PRN |
| 15842 | 193373 | RTA22200255F.l.21.1.P.Seq | F | M00064046A:G02 | CH21PRN |
| 15843 | 400619 | RTA22200255F.g.14.1.P.Seq | F | M00063947D:D01 | CH21PRN |
| 15844 | 831149 | RTA22200261F.o.21.1.P.Seq | F | M00064310D:F03 | CH22PRC |
| 15845 | 36113 | RTA22200255F.d.16.1.P.Seq | F | M00063932D:G08 | CH21PRN |
| 15846 | 817503 | RTA22200253F.l.16.1.P.Seq | F | M00063805D:E05 | CH21PRN |
| 15847 | 376588 | RTA22200260F.i.11.1.P.Seq | F | M00063955D:F05 | CH22PRC |
| 15848 | 141079 | RTA22200252F.f.23.1.P.Seq | F | M00063606C:B04 | CH21PRN |
| 15849 | 818063 | RTA22200253F.p.04.1.P.Seq | F | M00063839A:F01 | CH21PRN |
| 15850 | 455264 | RTA22200253F.n.14.1.P.Seq | F | M00063828A:H12 | CH21PRN |
| 15851 | 189234 | RTA22200251F.f.17.1.P.Seq | F | M00063466C:C11 | CH21PRN |
| 15852 | 295694 | RTA22200265F.j.05.1.P.Seq | F | M00064550A:A07 | CH22PRC |
| 15853 | 648679 | RTA22200260F.f.06.1.P.Seq | F | M00063594B:H07 | CH22PRC |
| 15854 | 830930 | RTA22200264F.e.10.1.P.Seq | F | M00064452D:E11 | CH22PRC |
| 15855 | 818497 | RTA22200256F.d.07.1.P.Seq | F | M00064079C:A10 | CH21PRN |
| 15856 | 373928 | RTA22200256F.d.19.1.P.Seq | F | M00064082A:A08 | CH21PRN |
| 15857 | 385307 | RTA22200263F.j.12.1.P.Seq | F | M00064406B:H06 | CH22PRC |
| 15858 | 403453 | RTA22200266F.e.10.1.P.Seq | F | M00064601D:B05 | CH22PRC |
| 15859 | 730318 | RTA22200264F.c.09.1.P.Seq | F | M00064447B:A07 | CH22PRC |
| 15860 | 44183 | RTA22200271F.a.01.1.P.Seq | F | M00021929A:D03 | CH03MAH |
| 15861 | 373928 | RTA22200255F.d.22.1.P.Seq | F | M00063934B:E04 | CH21PRN |
| 15862 | 404624 | RTA22200255F.d.23.1.P.Seq | F | M00063934C:C10 | CH21PRN |
| 15863 | 403173 | RTA22200253F.a.21.1.P.Seq | F | M00063685A:C02 | CH21PRN |
| 15864 | 372700 | RTA22200253F.c.06.1.P.Seq | F | M00063689D:E12 | CH21PRN |
| 15865 | 374343 | RTA22200261F.h.04.1.P.Seq | F | M00064008A:B01 | CH22PRC |
| 15866 | 597854 | RTA22200255F.j.03.1.P.Seq | F | M00064033D:B01 | CH21PRN |
| 15867 | 817417 | RTA22200255F.a.23.1.P.Seq | F | M00063922B:A12 | CH21PRN |
| 15868 | 818497 | RTA22200257F.k.05.3.P.Seq | F | M00064188B:G08 | CH21PRN |
| 15869 | 377696 | RTA22200255F.f.15.1.P.Seq | F | M00063943B:G12 | CH21PRN |
| 15870 | 379105 | RTA22200252F.n.19.1.P.Seq | F | M00063642B:A08 | CH21PRN |
| 15871 | 831188 | RTA22200267F.o.02.1.P.Seq | F | M00064723D:H11 | CH22PRC |
| 15872 | 376056 | RTA22200253F.m.09.1.P.Seq | F | M00063810C:E03 | CH21PRN |
| 15873 | 124863 | RTA22200255F.n.15.1.P.Seq | F | M00064053B:D09 | CH21PRN |
| 15874 | 376056 | RTA22200254F.i.03.1.P.Seq | F | M00063890A:F11 | CH21PRN |
| 15875 | 831812 | RTA22200266F.j.10.1.P.Seq | F | M00064620C:D01 | CH22PRC |
| 15876 | 141079 | RTA22200260F.i.14.1.P.Seq | F | M00063956A:F05 | CH22PRC |
| 15877 | 19148 | RTA22200265F.o.18.1.P.Seq | F | M00064577C:B12 | CH22PRC |
| 15878 | 124396 | RTA22200252F.a.14.1.P.Seq | F | M00063514C:E08 | CH21PRN |
| 15879 | 831026 | RTA22200265F.c.03.1.P.Seq | F | M00064520A:F08 | CH22PRC |

TABLE 120-continued

| SEQ ID | CLUSTER | SEQ NAME | ORIENT | CLONE ID | LIBRARY |
|---|---|---|---|---|---|
| 15880 | 819037 | RTA22200263F.i.23.1.P.Seq | F | M00064405B:C04 | CH22PRC |
| 15881 | 380207 | RTA22200263F.i.19.1.P.Seq | F | M00064404C:G05 | CH22PRC |
| 15882 | 819460 | RTA22200255F.c.13.1.P.Seq | F | M00063928A:G09 | CH21PRN |
| 15883 | 379067 | RTA22200253F.g.23.1.P.Seq | F | M00063784C:E10 | CH21PRN |
| 15884 | 403173 | RTA22200252F.p.23.1.P.Seq | F | M00063682A:C04 | CH21PRN |
| 15885 | 3856 | RTA22200269F.a.05.1.P.Seq | F | M00003773D:H02 | CH01COH |
| 15886 | 378551 | RTA22200263F.d.17.1.P.Seq | F | M00064385D:C11 | CH22PRC |
| 15887 | 456089 | RTA22200272F.a.09.1.P.Seq | F | M00043134A:A05 | CH19COP |
| 15888 | 549981 | RTA22200267F.a.22.1.P.Seq | F | M00064650B:B07 | CH22PRC |
| 15889 | 378551 | RTA22200265F.m.21.1.P.Seq | F | M00064568A:H06 | CH22PRC |
| 15890 | 819201 | RTA22200256F.n.23.2.P.Seq | F | M00064132B:B07 | CH21PRN |
| 15891 | 374826 | RTA22200251F.c.20.1.P.Seq | F | M00063453B:F08 | CH21PRN |
| 15892 | 389409 | RTA22200253F.l.23.1.P.Seq | F | M00063807A:D12 | CH21PRN |
| 15893 | 819149 | RTA22200260F.a.17.1.P.Seq | F | M00063575B:G02 | CH22PRC |
| 15894 | 389409 | RTA22200255F.e.18.1.P.Seq | F | M00063939C:D06 | CH21PRN |
| 15895 | 818165 | RTA22200254F.h.15.1.P.Seq | F | M00063888D:F02 | CH21PRN |
| 15896 | 817757 | RTA22200252F.i.15.1.P.Seq | F | M00063617D:F09 | CH21PRN |
| 15897 | 553242 | RTA22200263F.i.20.1.P.Seq | F | M00064404D:A06 | CH22PRC |
| 15898 | 385615 | RTA22200265F.b.08.1.P.Seq | F | M00064517B:F10 | CH22PRC |
| 15899 | 819102 | RTA22200258F.h.19.1.P.Seq | F | M00064272C:G01 | CH21PRN |
| 15900 | 817757 | RTA22200255F.o.16.1.P.Seq | F | M00064057C:H10 | CH21PRN |
| 15901 | 385615 | RTA22200265F.b.07.1.P.Seq | F | M00064517B:F04 | CH22PRC |
| 15902 | 385615 | RTA22200253F.l.06.1.P.Seq | F | M00063804C:A11 | CH21PRN |
| 15903 | 827355 | RTA22200266F.n.23.1.P.Seq | F | M00064636B:A04 | CH22PRC |
| 15904 | 817629 | RTA22200259F.a.13.1.P.Seq | F | M00063165A:C09 | CH22PRC |
| 15905 | 817514 | RTA22200260F.h.02.1.P.Seq | F | M00063600C:C09 | CH22PRC |
| 15906 | 817514 | RTA22200252F.p.21.1.P.Seq | F | M00063681B:C02 | CH21PRN |
| 15907 | 680563 | RTA22200265F.f.13.1.P.Seq | F | M00064530B:H02 | CH22PRC |
| 15908 | 827355 | RTA22200255F.e.20.1.P.Seq | F | M00063939C:H01 | CH21PRN |
| 15909 | 377286 | RTA22200254F.a.04.1.P.Seq | F | M00063843B:D07 | CH21PRN |
| 15910 | 680563 | RTA22200258F.g.18.1.P.Seq | F | M00064268D:G03 | CH21PRN |
| 15911 | 819156 | RTA22200255F.h.06.1.P.Seq | F | M00064021D:H01 | CH21PRN |
| 15912 | 220584 | RTA22200261F.f.22.1.P.Seq | F | M00064003B:C10 | CH22PRC |
| 15913 | 616555 | RTA22200263F.o.12.1.P.Seq | F | M00064428B:A12 | CH22PRC |
| 15914 | 819498 | RTA22200254F.o.14.1.P.Seq | F | M00063912A:D06 | CH21PRN |
| 15915 | 817508 | RTA22200257F.h.01.1.P.Seq | F | M00064171D:E05 | CH21PRN |
| 15916 | 817690 | RTA22200257F.e.05.1.P.Seq | F | M00064159A:H03 | CH21PRN |
| 15917 | 819156 | RTA22200256F.h.13.1.P.Seq | F | M00064106C:G03 | CH21PRN |
| 15918 | 830904 | RTA22200266F.j.12.1.P.Seq | F | M00064620D:G05 | CH22PRC |
| 15919 | 819498 | RTA22200253F.b.04.1.P.Seq | F | M00063686B:E07 | CH21PRN |
| 15920 | 817508 | RTA22200257F.g.24.1.P.Seq | F | M00064171D:E05 | CH21PRN |
| 15921 | 817508 | RTA22200252F.a.19.1.P.Seq | F | M00063515B:F06 | CH21PRN |
| 15922 | 831160 | RTA22200267F.h.01.1.P.Seq | F | M00064690A:C04 | CH22PRC |
| 15923 | 817762 | RTA22200252F.k.13.1.P.Seq | F | M00063627C:F06 | CH21PRN |
| 15924 | 377286 | RTA22200266F.k.07.1.P.Seq | F | M00064624C:B03 | CH22PRC |
| 15925 | 831160 | RTA22200267F.g.24.1.P.Seq | F | M00064690A:C04 | CH22PRC |
| 15926 | 819994 | RTA22200256F.k.11.1.P.Seq | F | M00064119C:D12 | CH21PRN |
| 15927 | 819994 | RTA22200256F.k.09.1.P.Seq | F | M00064119B:H10 | CH21PRN |
| 15928 | 373298 | RTA22200259F.c.19.1.P.Seq | F | M00063533A:C12 | CH22PRC |
| 15929 | 819894 | RTA22200256F.m.03.2.P.Seq | F | M00064126C:C02 | CH21PRN |
| 15930 | 372718 | RTA22200260F.b.22.1.P.Seq | F | M00063580D:B06 | CH22PRC |
| 15931 | 827355 | RTA22200262F.l.20.1.P.Seq | F | M00064358A:G03 | CH22PRC |
| 15932 | 819894 | RTA22200255F.d.09.1.P.Seq | F | M00063931B:E10 | CH21PRN |
| 15933 | 827355 | RTA22200266F.e.07.1.P.Seq | F | M00064601C:G07 | CH22PRC |
| 15934 | 372718 | RTA22200256F.l.03.1.P.Seq | F | M00064122C:B06 | CH21PRN |
| 15935 | 647435 | RTA22200251F.b.10.1.P.Seq | F | M00063156D:H10 | CH21PRN |
| 15936 | 450262 | RTA22200265F.a.10.1.P.Seq | F | M00064514A:G10 | CH22PRC |
| 15937 | 484703 | RTA22200255F.i.20.1.P.Seq | F | M00064032D:G04 | CH21PRN |
| 15938 | 819498 | RTA22200256F.f.12.1.P.Seq | F | M00064089B:F09 | CH21PRN |
| 15939 | 406043 | RTA22200263F.i.12.1.P.Seq | F | M00064404A:B05 | CH22PRC |
| 15940 | 817500 | RTA22200255F.f.24.1.P.Seq | F | M00063945A:C03 | CH21PRN |
| 15941 | 818180 | RTA22200264F.o.18.1.P.Seq | F | M00064506A:C07 | CH22PRC |
| 15942 | 818143 | RTA22200251F.a.03.1.P.Seq | F | M00063151A:G06 | CH21PRN |
| 15943 | 819756 | RTA22200267F.a.18.1.P.Seq | F | M00064649A:E04 | CH22PRC |
| 15944 | 406908 | RTA22200257F.i.18.3.P.Seq | F | M00064176D:H10 | CH21PRN |
| 15945 | 124863 | RTA22200256F.o.21.2.P.Seq | F | M00064136C:D12 | CH21PRN |
| 15946 | 429009 | RTA22200257F.e.24.1.P.Seq | F | M00064161B:G04 | CH21PRN |
| 15947 | 402586 | RTA22200257F.i.24.3.P.Seq | F | M00064178B:A05 | CH21PRN |
| 15948 | 400475 | RTA22200254F.i.04.1.P.Seq | F | M00063890A:H04 | CH21PRN |
| 15949 | 403453 | RTA22200264F.d.12.1.P.Seq | F | M00064450C:E07 | CH22PRC |
| 15950 | 383021 | RTA22200259F.d.06.1.P.Seq | F | M00063534C:A02 | CH22PRC |
| 15951 | 394913 | RTA22200254F.p.10.1.P.Seq | F | M00063915C:E01 | CH21PRN |
| 15952 | 831361 | RTA22200263F.k.19.1.P.Seq | F | M00064414D:D06 | CH22PRC |
| 15953 | 646020 | RTA22200267F.n.21.1.P.Seq | F | M00064723C:H04 | CH22PRC |
| 15954 | 831361 | RTA22200263F.l.03.1.P.Seq | F | M00064415B:G03 | CH22PRC |
| 15955 | 831580 | RTA22200261F.f.18.1.P.Seq | F | M00064002C:H09 | CH22PRC |
| 15956 | 402586 | RTA22200257F.j.01.3.P.Seq | F | M00064178B:A05 | CH21PRN |

TABLE 120-continued

| SEQ ID | CLUSTER | SEQ NAME | ORIENT | CLONE ID | LIBRARY |
|---|---|---|---|---|---|
| 15957 | 400475 | RTA22200262F.j.21.1.P.Seq | F | M00064349D:H01 | CH22PRC |
| 15958 | 818937 | RTA22200262F.h.14.2.P.Seq | F | M00064341A:C02 | CH22PRC |
| 15959 | 557697 | RTA22200261F.j.20.1.P.Seq | F | M00064018C:E07 | CH22PRC |
| 15960 | 831361 | RTA22200265F.m.24.1.P.Seq | F | M00064569B:A09 | CH22PRC |
| 15961 | 194490 | RTA22200252F.c.10.1.P.Seq | F | M00063520D:D08 | CH21PRN |
| 15962 | 818143 | RTA22200254F.b.18.1.P.Seq | F | M00063848C:G11 | CH21PRN |
| 15963 | 377286 | RTA22200259F.a.10.1.P.Seq | F | M00063163A:G04 | CH22PRC |
| 15964 | 831361 | RTA22200265F.n.01.1.P.Seq | F | M00064569B:A09 | CH22PRC |
| 15965 | 385307 | RTA22200255F.p.07.1.P.Seq | F | M00064060B:D03 | CH21PRN |
| 15966 | 378447 | RTA22200251F.c.01.1.P.Seq | F | M00063158A:E11 | CH21PRN |
| 15967 | 378447 | RTA22200251F.b.24.1.P.Seq | F | M00063158A:E11 | CH21PRN |
| 15968 | 817514 | RTA22200260F.m.17.1.P.Seq | F | M00063968D:G08 | CH22PRC |
| 15969 | 818942 | RTA22200255F.f.03.1.P.Seq | F | M00063941B:C12 | CH21PRN |
| 15970 | 818942 | RTA22200267F.e.23.1.P.Seq | F | M00064678D:F05 | CH22PRC |
| 15971 | 817363 | RTA22200266F.f.04.1.P.Seq | F | M00064605C:G05 | CH22PRC |
| 15972 | 818942 | RTA22200255F.i.02.1.P.Seq | F | M00064025D:E07 | CH21PRN |
| 15973 | 818942 | RTA22200265F.g.23.1.P.Seq | F | M00064534D:F06 | CH22PRC |
| 15974 | 817457 | RTA22200267F.e.15.1.P.Seq | F | M00064675C:E09 | CH22PRC |
| 15975 | 831968 | RTA22200263F.f.23.1.P.Seq | F | M00064393B:H04 | CH22PRC |
| 15976 | 530941 | RTA22200253F.h.05.1.P.Seq | F | M00063785C:F03 | CH21PRN |
| 15977 | 763446 | RTA22200257F.j.05.3.P.Seq | F | M00064179A:C04 | CH21PRN |
| 15978 | 763446 | RTA22200255F.n.21.1.P.Seq | F | M00064053D:F02 | CH21PRN |
| 15979 | 819219 | RTA22200256F.f.16.1.P.Seq | F | M00064090C:A02 | CH21PRN |
| 15980 | 763446 | RTA22200258F.b.19.2.P.Seq | F | M00064248A:E02 | CH21PRN |
| 15981 | 10154 | | | | |
| 15982 | 10154 | | | | |

TABLE 121

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15685 | <NONE> | <NONE> | <NONE> | 1077580 | hypothetical protein YDR125c - yeast | 7 |
| 15686 | <NONE> | <NONE> | <NONE> | 4585925 | (AC007211) unknown protein | 6 |
| 15687 | <NONE> | <NONE> | <NONE> | 1085306 | EVI1 protein - human | 4.3 |
| 15688 | <NONE> | <NONE> | <NONE> | 3876587 | (Z81521) predicted using Genefinder; cDNA EST yk233g4.5 comes from this gene; cDNA EST yk233g4.3 comes from this gene [*Caenorhabditis elegans*] | 0.85 |
| 15689 | <NONE> | <NONE> | <NONE> | 1086591 | (U41007) similar to *S. cervisiae* nuclear protein SNF2 | 0.34 |
| 15690 | <NONE> | <NONE> | <NONE> | 157272 | (L11345) DNA-binding protein [*Drosophila melanogaster*] | 0.29 |
| 15691 | <NONE> | <NONE> | <NONE> | 2633160 | (Z99108) similar to surface adhesion YfiQ [*Bacillus subtilis*] | 0.19 |
| 15692 | <NONE> | <NONE> | <NONE> | 755468 | (U19879) transmembrane protein [*Xenopus laevis*] | 0.042 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15693 | <NONE> | <NONE> | <NONE> | 4507339 | T brachyury (mouse) homolog protein [*Homo sapiens*] | 0.029 |
| 15694 | <NONE> | <NONE> | <NONE> | 729711 | PROTEASE DEGS PRECURSOR 3.4.21.—) hhoB - *Escherichia coli* >gi|558913 (U15661) HhoB [*Escherichia coli*] >gi|606174 (U18997) ORF_o355 *coli*] >gi|1789630 (AE000402) protease [*Escherichia coli*] | 0.004 |
| 15695 | <NONE> | <NONE> | <NONE> | 3168911 | (AF068718) No definition line found [*Caenorhabditis elegans*] | 8e−013 |
| 15696 | <NONE> | <NONE> | <NONE> | 2832777 | (AL021086)/ prediction = (method:; comes from the 5' UTR [*Drosophila melanogaster*] | 3e−040 |
| 15697 | X78712 | *H. sapiens* mRNA for glycerol kinase testis specific 2 | 2.1 | 2852449 | (D88207) protein kinase [*Arabidopsis thaliana*] >gi|2947061 (AC002521) putative protein kinase | 9.1 |
| 15698 | X60760 | *L. esculentum* TDR8 mRNA | 2.1 | 157272 | (L11345) DNA-binding protein [*Drosophila melanogaster*] | 5 |
| 15699 | U40853 | *Oryctolagus cuniculus* pulmonary surfactant protein B (SP-B) gene, complete cds | 2 | <NONE> | <NONE> | <NONE> |
| 15700 | AF083655 | *Homo sapiens* procollagen C-proteinase enhancer protein (PCOLCE) gene, 5' flanking region and complete cds | 2 | <NONE> | <NONE> | <NONE> |
| 15701 | AJ223776 | *Staphylococcus warneri* hld gene | 2 | <NONE> | <NONE> | <NONE> |
| 15702 | U40853 | *Oryctolagus cuniculus* pulmonary surfactant protein B (SP-B) gene, complete cds | 2 | <NONE> | <NONE> | <NONE> |
| 15703 | X04436 | *Clostridium tetani* gene for tetanus toxin | 2 | <NONE> | <NONE> | <NONE> |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15704 | Z35787 | S. cerevisiae chromosome II reading frame ORF YBL026w | 2 | 157272 | (L11345) DNA-binding protein [Drosophila melanogaster] | 8.4 |
| 15705 | X78712 | H. sapiens mRNA for glycerol kinase testis specific 2 | 2 | 2852449 | (D88207) protein kinase [Arabidopsis thaliana] >gi|2947061 (AC002521) putative protein kinase | 8.2 |
| 15706 | Z15056 | B. subtilis genes spoVD, murE, mraY, murD | 2 | 477124 | P3A2 DNA binding protein homolog EWG - fruit fly (Drosophila melanogaster) | 2.8 |
| 15707 | S65623 | cAMP-regulated enhancer-binding protein 1 of 3] | 2 | 119266 | PROTEIN GRAINY-HEAD (DNA-BINDING PROTEIN ELF-1) (ELEMENT I-BINDING ACTIVITY) regulatory protein elf-1 - fruit fly (Drosophila melanogaster) >gi|7939|emb|CAA33692| (X15657) Elf-1 protein (AA 1-1063) [Drosophila melanogaster] | 0.55 |
| 15708 | NM_004415.1 | Homo sapiens desmoplakin (DPI, DPII) (DSP) mRNA mRNA, complete cds | 2 | 2649177 | (AE001008) conserved hypothetical protein [Archaeoglobus fulgidus] | 0.2 |
| 15709 | AF031552 | Vibrio cholerae magnesium transporter (mgtE) gene, partial cds; sensor kinase (vieS), response regulator (vieA), and response regulator (vieB) genes, complete cds; and collagenase (vcc) gene, partial cds | 2 | 2088714 | (AF003139) strong similarity to NADPH oxidases; partial CDS, the gene begins in the neighboring clone | 2e−013 |
| 15710 | AF116852.1 | Danio rerio dickkopf-1 (dkk1) mRNA, complete cds | 2 | 3800951 | (AF100657) No definition line found [Caenorhabditis elegans] | 2e−019 |
| 15711 | X82595 | P. sativum fuc gene | 1.9 | <NONE> | <NONE> | <NONE> |
| 15712 | AF008216 | Homo sapiens candidate tumor suppressor pp32r1 | 1.9 | <NONE> | <NONE> | <NONE> |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15713 | AF130672.1 | *Felis catus* clone Fca603 microsatellite sequence | 1.9 | <NONE> | <NONE> | <NONE> |
| 15714 | AJ007044 | *Oryctolagus Cuniculus* sod gene | 1.9 | 388055 | (L22981) merozoite surface protein-1 [*Plasmodium chabaudi*] | 7.8 |
| 15715 | AC004497 | *Homo sapiens* chromosome 21, P1 clone LBNL#6 | 1.9 | 160925 | (M94346) A.1.12/9 antigen [*Schistosoma mansoni*] | 7.7 |
| 15716 | U30290 | *Rattus norvegicus* galanin receptor GALR1 mRNA, complete cds | 1.9 | 3024079 | GALECTIN-4 (LACTOSE-BINDING LECTIN 4) (L-36 LACTOSE BINDING PROTEIN) (L36LBP) >gi|2281707 *sapiens*] >gi|2623387 (U82953) galectin-4 [*Homo sapiens*] | 4.5 |
| 15717 | Y13234 | *Chironomus tentans* mRNA for chitinase, 1695 bp | 1.9 | 4567068 | (AF125568) tumor suppressing STF cDNA 4 [*Homo sapiens*] | 3.4 |
| 15718 | NM_003644.1 | *Homo sapiens* growth arrest-specific 7 (GAS7) mRNA >::emb|AJ224876| HSAJ4876 Homo sapience mRNA for GAS7 protein | 1.9 | 125560 | PROTEIN KINASE C, GAMMA TYPE C (EC 2.7.1.—) gamma - rabbit >gi|165652 (M19338) protein kinase delta [*Oryctolagus cuniculus*] | 0.53 |
| 15719 | AB013448.1 | *Oryza sativa* gene for Pib, complete cds | 1.8 | <NONE> | <NONE> | <NONE> |
| 15720 | D63854 | Human cytomegalovirus DNA, replication origin | 1.8 | <NONE> | <NONE> | <NONE> |
| 15721 | AB002340 | Human mRNA for KIAA0342 gene, complete cds | 1.8 | <NONE> | <NONE> | <NONE> |
| 15722 | AF017779 | *Mus musculus* vitamin D receptor gene, promoter region | 1.8 | <NONE> | <NONE> | <NONE> |
| 15723 | D63854 | Human cytomegalovirus DNA, replication origin | 1.8 | <NONE> | <NONE> | <NONE> |
| 15724 | M24102 | Bovine ADP/ATP translocase T1 mRNA, complete cds. | 1.8 | <NONE> | <NONE> | <NONE> |
| 15725 | AC004497 | *Homo sapiens* chromosome 21, P1 clone LBNL#6 | 1.8 | <NONE> | <NONE> | <NONE> |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15726 | M37394 | Rat epidermal growth factor receptor mRNA. | 1.8 | <NONE> | <NONE> | <NONE> |
| 15727 | AF006304 | Saccharomyces cerevisiae protein tyrosine phosphatase (PTP3) gene, complete cds | 1.8 | <NONE> | <NONE> | <NONE> |
| 15728 | D13454 | Candida albicans CACHS3 gene for chitin synthase III | 1.8 | <NONE> | <NONE> | <NONE> |
| 15729 | Y00354 | Xenopus laevis gene encoding vitellogenin A2 | 1.8 | 1077580 | hypothetical protein YDR125c - yeast | 7.5 |
| 15730 | U90936 | Aspergillus niger px27 gene, promoter region | 1.8 | 4337033 | (AF124138) transcriptional activator protein CdaR [Streptomyces coelicolor] transcriptional regulator [Streptomyces coelicolor] | 7.3 |
| 15731 | D84448 | Cavia cobaya mRNA for Na+, K+-ATPase beta-3 subunit, complete cds | 1.8 | 4704603 | (AF109916) putative dehydrin | 7.1 |
| 15732 | AF039948 | Xenopus laevis clone H-0 transcription elongation factor S-II (TFIIS) precursor RNA, isoform TFIIS.h, partial cds | 1.8 | 1695839 | (U58151) envelope glycoprotein [Human immunodeficiency virus type 1] | 5.6 |
| 15733 | M18061 | Xenopus laevis vitelloginin gene, complete cds. | 1.8 | 780502 | (U18466) AP endonuclease class II [African swine fever virus] >gi|10975251|prf||2113434ET AP endonuclease: ISO TYPE = class II [African swine fever virus] | 3.1 |
| 15734 | U61112 | Mus musculus Eya3 homolog mRNA, complete cds | 1.8 | 3043646 | (AB011133) KIAA0561 protein [Homo sapiens] | 1.9 |
| 15735 | AB018442 | Oryza sativa mRNA for phytochrome C, complete cds | 1.8 | 4455041 | (AF116463) unknown [Streptomyces lincolnensis] | 0.49 |
| 15736 | D63854 | Human cytomegalovirus DNA, replication origin | 1.8 | 1169200 | DNA-DAMAGE-REPAIR/TOLERATION PROTEIN DRT111 PRECURSOR >gi|421829|pir||S33706 DNA-damage resistance | 0.22 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | | | | protein - *Arabidopsis thaliana* and DNA-damage resistance protein (DRT111) mRNA, complete cds.], gene product [*Arabidopsis thaliana*] | |
| 15737 | D26549 | *Bovine* mRNA for adseverin, complete cds | 1.8 | 755468 | (U19879) transmembrane protein [*Xenopus laevis*] | 0.042 |
| 15738 | J05211 | Human desmoplakin mRNA, 3' end. | 1.8 | 728867 | ANTER-SPECIFIC PROLINE-RICH PROTEIN APG PRECURSOR >gi\|99694\|pir \|\|S21961 proline-rich protein APG - *Arabidopsis thaliana* >gi\|22599\|emb \|CAA42925\| | 0.015 |
| 15739 | NM_004415.1 | *Homo sapiens* desmoplakin (DPI, DPII) (DSP) mRNA mRNA, complete cds | 1.8 | 728867 | ANTER-SPECIFIC PROLINE-RICH PROTEIN APG PRECURSOR >gi\|99694\|pir \|\|S21961 proline-rich protein APG - *Arabidopsis thaliana* >gi\|22599\|emb \|CAA42925\| | 0.015 |
| 15740 | AF038604 | *Caenorhabditis elegans* cosmid B0546 | 1.8 | 3877951 | (Z81555) predicted using Genefinder | 3e−008 |
| 15741 | AF038604 | *Caenorhabditis elegans* cosmid B0546 | 1.8 | 3877951 | (Z81555) predicted using Genefinder | 2e−011 |
| 15742 | U23551 | *Prochlorothrix hollandica* phosphomannomutase | 1.8 | 2828280 | (AL021687) putative protein [*Arabidopsis thaliana*] >gi\|2832633\|emb \|CAA16762 \|(AL021711) putative protein [*Arabidopsis thaliana*] | 2e−013 |
| 15743 | S60150 | ORF1... ORF6 {3' terminal reigon} [chrysanthemum virus B CVB, Genomic RNA, 6 genes, 3426 nt] | 1.8 | 1065454 | (U40410) C54G7.2 gene product [*Caenorhabditis elegans*] | 2e−019 |
| 15744 | AB014558 | *Homo sapiens* mRNA for KIAA0658 protein, partial cds | 1.8 | 3850072 | (AL033385) dna-directed rna polymerase iii subunit [*Schizosaccharomyces pombe*] | 6e−027 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15745 | X17191 | *E. gracilis* chloroplast RNA polymerase rpoB-rpoC1-rpoC2 operon | 1.7 | <NONE> | <NONE> | <NONE> |
| 15746 | X07729 | *R. norvegicus* gene encoding neuron-specific enolase, exons 8–12 | 1.7 | 4584544 | (AL049608) extensin-like protein | 8.8 |
| 15747 | D38178 | Human gene for cytosolic phospholipase A2, exon 1 | 1.7 | 73714 | infected cell protein ICP34.5 - human herpesvirus 1 (strain F) >gi|330123 (M12240) infected cell protein [Herpes simplex virus type 1] | 1.1 |
| 15748 | U23551 | *Prochlorothrix hollandica* phosphomannomutase | 1.7 | 2828280 | (AL021687) putative protein [*Arabidopsis thaliana*] >gi|2832633|emb |CAA16762 |(AL021711) putative protein [*Arabidopsis thaliana*] | 2e−010 |
| 15749 | Y00525 | *Klebsiella pneumoniae* nifL gene for regulatory protein | 1.6 | 3800951 | (AF100657) No definition line found [*Caenorhabditis elegans*] | 6e−013 |
| 15750 | AF100170.1 | *Bos taurus* major fibrous sheath protein precursor, mRNA, complete cds | 1.5 | 463552 | (U05877) AF-1 [*Homo sapiens*] | 0.074 |
| 15751 | Y13441 | *Homo sapiens* Rox gene, exon 2 | 0.74 | <NONE> | <NONE> | <NONE> |
| 15752 | L46792 | *Actinidia deliciosa* clone AdXET-5 xyloglucan endotransglycosylase precursor (XET) mRNA, complete cds | 0.73 | 3170252 | (AF043636) circumsporozoite protein [*Plasmodium chabaudi*] | 0.001 |
| 15753 | U73489 | *Drosophila melanogaster* Nem (nem) mRNA, complete cds | 0.7 | 3915994 | HYPOTHETICAL 53.2 KD PROTEIN IN PRC-PRPA INTERGENIC REGION | 3e−005 |
| 15754 | U95097 | *Xenopus laevis* mitotic phosphoprotein 43 mRNA, partial cds | 0.68 | 157272 | (L11345) DNA-binding protein [*Drosophila melanogaster*] | 8.5 |
| 15755 | AF082012 | *Caenorhabditis elegans* UDP-N-acetylglucosamine: a-3-D-mannoside b-1,2-N-acetylglucosaminyltransferase I (gly-14) mRNA, complete cds | 0.67 | 2494313 | PUTATIVE TRANSLATION INITIATION FACTOR EIF-2B SUBUNIT 1 (EIF-2B GDP-GTP EXCHANGE FACTOR) eIF-2B, subunit | 8.4 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | | | | alpha-*Methanococcus jannaschii* aIF-2B, subunit delta (aIF2BD) [*Methanococcus jannaschii*] | |
| 15756 | U04354 | *Mus musculus* ADSEVERIN mRNA, complete cds | 0.67 | 4755188 | (AC007018) unknown protein | 8e-026 |
| 15757 | M68881 | *S. pombe* cigl+ gene, complete cds. | 0.67 | 2078441 | (U56964) weak similarity to *S. cerevisiae* intracellular protein transport protein US)1 (SP: P25386) | 2e-030 |
| 15758 | U95097 | *Xenopus laevis* mitotic phosphoprotein 43 mRNA, partial cds | 0.66 | 2829685 | PROTEIN-TYROSINE PHOSPHATASE X PRECURSOR (R-PTP-X) (PTP IA-2BETA) (PROTEIN TYROSINE PHOSPHATASE-NP) (PTP-NP) >gi|1515425 (U57345) protein tyrosine phosphatase-NP [*Mus musculus*] | 6.2 |
| 15759 | Z15056 | *B. subtilis* genes spoVD, murE, mraY, murD | 0.66 | 477124 | P3A2 DNA binding protein homolog EWG - fruit fly (*Drosophila melanogaster*) | 2.1 |
| 15760 | M86808 | Human pyruvate dehydrogenase complex (PDHA2) gene, complete cds. | 0.65 | <NONE> | <NONE> | <NONE> |
| 15761 | J03754 | Rat plasma membrane Ca2+ ATPase-isoform 2 mRNA, complete cds. | 0.65 | 4507549 | transmembrane protein with EGF-like and two follistatin-like domains 1 >gi|755466 | 8e-006 |
| 15762 | NM_000887.1 | *Homo sapiens* integrin, alpha X (antigen CD11C emb|Y00093|HSP15095 *H. sapiens* mRNA for leukocyte adhesion glycoprotein p150, 95 | 0.64 | <NONE> | <NONE> | <NONE> |
| 15763 | L27080 | Human melanocortin 5 receptor (MC5R) gene, complete cds. | 0.64 | <NONE> | <NONE> | <NONE> |
| 15764 | U07890 | *Mus musculus* C57BL/6J epidermal surface antigen (mesa) mRNA, complete cds. | 0.64 | <NONE> | <NONE> | <NONE> |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15765 | AF079139 | Streptomyces venezuelae pikCD operon, complete sequence | 0.64 | 3041869 | (U96109) proline-rich transcription factor ALX3 [Mus musculus] | 2.8 |
| 15766 | M16140 | Chicken ovoinhibitor gene, exon 15. | 0.64 | 123984 | ACROSIN INHIBITORS IIA AND IIB | 4e−008 |
| 15767 | NM_000887.1 | Homo sapiens integrin, alpha X (antigen CD11C emb\|Y00093\|HSP15095 H. sapiens mRNA for leukocyte adhesion glycoprotein p150, 95 | 0.63 | <NONE> | <NONE> | <NONE> |
| 15768 | Z17316 | Kluyveromyces lactis for gene encoding phosphofructokinase beta subunit | 0.63 | <NONE> | <NONE> | <NONE> |
| 15769 | Z25470 | H. sapiens melanocortin 5 receptor gene, complete CDS | 0.63 | <NONE> | <NONE> | <NONE> |
| 15770 | L19954 | Bacillus subtilis feuA, B, and C genes, 3 ORFs, 2 complete cds's and 5'end. | 0.63 | <NONE> | <NONE> | <NONE> |
| 15771 | U44405 | Spiroplasma citri chromosome pre-inversion border, SPV1-like sequences, transposase gene, partial cds, adhesin-like protein P58 gene, complete cds. | 0.63 | 2499642 | SERINE/THREONINE-PROTEIN KINASE STE20 HOMOLOG >gi\|1737181 (U73457) Cst20p [Candida albicans] | 7.7 |
| 15772 | Z28264 | S. cerevisiae chromosome XI reading frame ORF YKR039w | 0.63 | 3880930 | (AL021481) similar to Phosphoglucomutase and phosphomannomutase phosphoserine; cDNA EST EMBL: D36168 comes from this gene; cDNA EST EMBL: D70697 comes from this gene; cDNA EST yk373h9.5 comes from this gene; cDNA EST EMBL: T00805 . . . | 2e−014 |
| 15773 | AE001107 | Archaeoglobus fulgidus section 172 of 172 of the complete genome | 0.62 | <NONE> | <NONE> | <NONE> |
| 15774 | Z14112 | B. firmus TopA gene encoding DNA | 0.62 | 310115 | (L02530) Drosophila polarity gene | 0.026 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | topoisomerase I | | | (frizzled) homologue | |
| 15775 | AF118101 | *Toxoplasma gondii* protein kinase 6 (tpk6) mRNA, complete cds | 0.62 | 726403 | (U23175) similar to anion exchange protein [*Caenorhabditis elegans*] | 4e−018 |
| 15776 | M59743 | Rabbit cardiac muscle Ca-2+ release channel | 0.61 | <NONE> | <NONE> | <NONE> |
| 15777 | M12036 | Human tyrosine kinase-type receptor (HER2) gene, partial cds. | 0.61 | 61962 | (X58484) gag [Simian foamy virus] | 7.5 |
| 15778 | AF043195 | *Homo sapiens* tight junction protein ZO (ZO-2) gene, alternative splice products, promoter and exon A | 0.61 | 1572629 | (U69699) unknown protein precursor [*Mus musculus*] | 7.5 |
| 15779 | U18178 | Human HLA class I genomic survey sequence. | 0.61 | 1336688 | (S81116) properdin [guinea pigs, spleen, Peptide, 470 aa] [*Cavia*] | 5.7 |
| 15780 | U44405 | Spiroplasma citri chromosome pre-inversion border, SPV1-like sequences, transposase gene, partial cds, adhesin-like protein P58 gene, complete cds. | 0.61 | 2827531 | (AL021633) hypothetical protein | 3.3 |
| 15781 | Z33011 | *M. capricolum* DNA for CONTIG MC008 | 0.61 | 3915729 | HYPERPLASTIC DISCS PROTEIN (HYD PROTEIN) >gi|2673887 (L14644) hyperplastic discs protein | 0.26 |
| 15782 | NM_001429.1 | *Homo sapiens* E1A binding protein p300 mRNA, complete cds. > :: gb|I62297|I62297 Sequence 1 from patent US 5658784 | 0.61 | 4204294 | (AC003027) lcl|prt_seq No definition line found | 5e−005 |
| 15783 | Z25418 | *C. familiaris* MHC class Ib gene (DLA-79) gene, complete CDS | 0.61 | 3877493 | (Z48583) similar to ATPases associated with various cellular activities (AAA); cDNA EST EMBL: Z14623 comes from this gene; cDNA EST EMBL: D75090 comes from this | 1e−007 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | | | | gene; cDNA EST EMBL: D72255 comes from this gene; cDNA EST yk200e4.5 . . . | |
| 15784 | AB002150 | *Bacillus subtilis* DNA for FeuB, FeuA, YbbB, YbbC, YbbD, YbzA, YbbE, YbbF, YbbH, YbbI, YbbJ, YbbK, YbbL, YbbM, YbbP, complete cds | 0.6 | <NONE> | <NONE> | <NONE> |
| 15785 | Y07786 | *V. cholerae* ORF's involved in lipopolysaccharide synthese | 0.6 | <NONE> | <NONE> | <NONE> |
| 15786 | Z17316 | *Kluyveromyces lactis* for gene encoding phosphofructokinase beta subunit | 0.6 | <NONE> | <NONE> | <NONE> |
| 15787 | Z71403 | *S. cerevisiae* chromosome XIV reading frame ORF YNL127w | 0.6 | <NONE> | <NONE> | <NONE> |
| 15788 | L34641 | *Homo sapiens* platelet/endothelial cell adhesion molecule-1 (PECAM-1) gene, exon 10. | 0.6 | 1147634 | (U42213) micronemal TRAP-C1 protein homolog | 9.6 |
| 15789 | AF070572 | *Homo sapiens* clone 24778 unknown mRNA | 0.6 | 399034 | N-ACETYLMURAMOYL-L-ALANINE AMIDASE AMIB PRECURSOR >gi\|628763\|pir\|\|S41741 N-acetylmuramoyl-L-alanine amidase (EC 3.5.1.28) - *Escherichia coli* >gi\|304914 (L19346) N-acetylmuramoyl-L-alanine amidase [*Escherichia coli*] N-acetylmuramoyl-l-alanine amidase II; a | 2.5 |
| 15790 | X75627 | *C. burnetii* trxB, spoIIIE and serS genes | 0.6 | 3036833 | (AJ003163) apsB [*Emericella nidulans*] | 0.28 |
| 15791 | Z99765 | *Flaveria pringlei* gdcsH gene | 0.59 | <NONE> | <NONE> | <NONE> |
| 15792 | U02538 | *Mycoplasma hyopneumoniae* J ATCC 25934 23S rRNA gene, partial sequence | 0.59 | <NONE> | <NONE> | <NONE> |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15793 | Z71403 | *S. cerevisiae* chromosome XIV reading frame ORF YNL127w | 0.59 | <NONE> | <NONE> | <NONE> |
| 15794 | X03942 | Mouse simple repetitive DNA (sqr family) transcript (clone pmlc 2) with conserved GACA/GATA repeats | 0.59 | <NONE> | <NONE> | <NONE> |
| 15795 | U11844 | *Mus musculus* glucose transporter (GLUT3) gene, exon 1 | 0.59 | <NONE> | <NONE> | <NONE> |
| 15796 | D63395 | *Homo sapiens* mRNA for NOTCH4, partial cds | 0.59 | 4433616 | (AF107018) alpha-mannosidase IIx [*Mus musculus*] | 1.8 |
| 15797 | Z33011 | *M. capricolum* DNA for CONTIG MC008 | 0.59 | 3915729 | HYPERPLASTIC DISCS PROTEIN (HYD PROTEIN) >gi|2673887 (L14644) hyperplastic discs protein | 0.27 |
| 15798 | U05670 | *Haemophilus influenzae* DL42 Lex2A and Lex2B genes, complete cds. | 0.58 | <NONE> | <NONE> | <NONE> |
| 15799 | L27080 | Human melanocortin 5 receptor (MC5R) gene, complete cds. | 0.58 | 123984 | ACROSIN INHIBITORS IIA AND IIB | 2e−006 |
| 15800 | AF043195 | *Homo sapiens* tight junction protein ZO (ZO-2) gene, alternative splice products, promoter and exon A | 0.57 | 1572629 | (U69699) unknown protein precursor [*Mus musculus*] | 6.7 |
| 15801 | U57707 | *Bos taurus* activin receptor type IIB precursor | 0.57 | 807646 | (M17294) unknown protein [Human herpesvirus 4] | 0.068 |
| 15802 | Z17316 | *Kluyveromyces lactis* for gene encoding phosphofructokinase beta subunit | 0.56 | <NONE> | <NONE> | <NONE> |
| 15803 | M21535 | Human erg protein (ets-related gene) mRNA, complete cds. | 0.56 | <NONE> | <NONE> | <NONE> |
| 15804 | M64932 | *Candida maltosa* cyclohexamide resistance protein | 0.56 | 3219524 | (AF069428) NADH dehydrogenase subunit IV [*Alligator mississippiensis*] >gi|3367630|e mb|CAA73570| (Y13113) NADH | 1.3 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15805 | AE000342 | *Escherichia coli* K-12 MG1655 section 232 of 400 of the complete genome | 0.56 | 3874685 | dehydrogenase subunit 4 [*Alligator mississippiensis*] (Z78539) Similarity to *S. pombe* hypothetical protein C4G8.04 (SW:YAD4_SC HPO); cDNA EST EMBL: D27846 comes from this gene; cDNA EST EMBL: D27845 comes from this gene; cDNA EST yk202h7.3 comes from this gene; cDNA EST yk202h7.5 come . . . | 0.088 |
| 15806 | Z15056 | *B. subtilis* genes spoVD, murE, mraY, murD | 0.55 | 477124 | P3A2 DNA binding protein homolog EWG - fruit fly (*Drosophila melanogaster*) | 3.7 |
| 15807 | Z58167 | *H. sapiens* CpG island DNA genomic Mse1 fragment, clone 30e10, forward read cpg30e10.ft1b | 0.53 | <NONE> | <NONE> | <NONE> |
| 15808 | M27159 | Rat potassium channel-Kv2 gene, partial cds. | 0.53 | 1850920 | (U21247) Bet [Human spumaretrovirus] | 0.9 |
| 15809 | M15555 | Mouse Ig germline V-kappa-24 chain (VK24C) gene, exons 1 and 2. | 0.24 | <NONE> | <NONE> | <NONE> |
| 15810 | U95097 | *Xenopus laevis* mitotic phosphoprotein 43 mRNA, partial cds | 0.24 | 399109 | TRANSCRIPTION FACTOR BF-1 (BRAIN FACTOR 1) (BF1) >gi|92020|pir||JH0672 brain factor 1 protein - rat >gi|203135 (M87634) BF-1 [*Rattus norvegicus*] | 4 |
| 15811 | AJ002014 | Crythecodinium cohnii mRNA for nuclear protein JUS1 | 0.24 | 416704 | BALBIANI RING PROTEIN 3 PRECURSOR balbiani ring 3 (BR3) [*Chironomus tentans*] | 0.36 |
| 15812 | L35330 | *Rattus norvegicus* glutathione S-transferase Yb3 subunit gene, complete cds. | 0.23 | 1388158 | (U58204) myomesin [*Gallus gallus*] | 8.8 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15813 | NM_001432.1 | Homo sapiens epiregulin (EREG) mRNA > :: dbj\|D30783\|D30783 Homo sapiens mRNA for epiregulin, complete cds | 0.23 | 2851520 | TRANSFORMING GROWTH FACTOR ALPHA PRECURSOR (TGF-ALPHA) (EGF-LIKE TGF) (ETGF) (TGF TYPE 1) precursor - rat >gi\|207282 (M31076) transforming growth factor alpha precursor [Rattus norvegicus] | 2e−008 |
| 15814 | U57043 | Cebus apella gamma globin (gamma 1) gene, complete cds | 0.22 | <NONE> | <NONE> | <NONE> |
| 15815 | AB023188.1 | Homo sapiens mRNA for KIAA0971 protein, complete cds | 0.22 | <NONE> | <NONE> | <NONE> |
| 15816 | M18105 | Yeast (S. cerevisiae) SST2 gene encoding desensitization to alpha- factor pheromone, complete cds. | 0.22 | <NONE> | <NONE> | <NONE> |
| 15817 | AJ001113 | Homo sapiens UBE3A gene, exon 16 | 0.22 | 3122961 | ENHANCER OF SPLIT GROUCHO-LIKE PROTEIN 1 >gi\|2408145 (U18775) enhancer of split groucho | 8.5 |
| 15818 | L35330 | Rattus norvegicus glutathione S-transferase Yb3 subunit gene, complete cds. | 0.22 | 1388158 | (U58204) myomesin [Gallus gallus] | 8.1 |
| 15819 | D42042 | Human mRNA for KIAA0085 gene, partial cds | 0.22 | 4827063 | zinc finger protein 142 (clone pHZ-49) >gi\|3123312\|sp\|P52746\|Z142_HUMAN ZINC FINGER PROTEIN 142 (KIAA0236) (HA4654) >gi\|1510147\|dbj\|BAA13242\| | 6.1 |
| 15820 | L35330 | Rattus norvegicus glutathione S-transferase Yb3 subunit gene, complete cds. | 0.22 | 2853301 | (AF007194) mucin [Homo sapiens] | 1.6 |
| 15821 | Z11653 | H. sapiens DBH gene complex repeat polymorphism DNA. | 0.22 | 3819705 | (AL032824) syntaxin binding protein 1; sec1 family secretory protein [Schizosaccharomyces pombe] | 1.2 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15822 | L29063 | *Candida albicans* fatty acid synthase alpha subunit (FAS2) gene, complete cds. | 0.22 | 3046871 | (AB003753) high sulfur protein B2E [*Rattus norvegicus*] | 0.32 |
| 15823 | M64865 | Horse alcohol dehydrogenase-S-isoenzyme mRNA, complete cds. | 0.22 | 2213909 | (AF004874) latent TGF-beta binding protein-2 [*Mus musculus*] | 0.037 |
| 15824 | Y09472 | *B. taurus* gene encoding preprododecapeptide | 0.21 | 2909874 | (AF047829) melatonin-related receptor [*Ovis aries*] | 7.6 |
| 15825 | Y09472 | *B. taurus* gene encoding preprododecapeptide | 0.21 | 2909874 | (AF047829) melatonin-related receptor [*Ovis aries*] | 7.5 |
| 15826 | X80301 | N. tabacum axi 1 gene | 0.21 | 2832715 | (AJ003066) subunit beta of the mitochondrial fatty acid beta-oxydation multienzyme complex [*Bos taurus*] | 6 |
| 15827 | AF073485 | *Homo sapiens* MHC class I-related protein MR1 precursor (MR1) gene, partial cds | 0.21 | 2224559 | (AB002307) KIAA0309 [*Homo sapiens*] | 3.3 |
| 15828 | S78251 | growth hormone receptor {alternatively spliced, exon 1B} [sheep, Merino, skeletal muscle, mRNA Partial, 438 nt] | 0.21 | 729381 | DYNAMIN-1 (DYNAMIN BREDNM19) | 2 |
| 15829 | U16135 | *Synechococcus* sp. Clp protease proteolytic subunit | 0.21 | 135514 | T-CELL RECEPTOR BETA CHAIN PRECURSOR precursor (ANA 11) - rabbit | 0.02 |
| 15830 | X95601 | *M. hominis* lmp3 and lmp4 genes | 0.21 | 2995445 | (Y10496) CDV-1 protein [*Mus musculus*] | 0.005 |
| 15831 | X95601 | *M. hominis* lmp3 and lmp4 genes | 0.21 | 2995447 | (Y10495) CDV-1R protein [*Mus musculus*] | 0.005 |
| 15832 | AF124249.1 | *Homo sapiens* SH2-containing protein Nsp1 mRNA, complete cds | 0.21 | 423456 | epidermal growth factor-receptor-binding protein GRB-4 - mouse (fragment) | 8e-010 |
| 15833 | AF030282 | *Danio rerio* homeobox protein Six7 (six7) mRNA, complete cds | 0.21 | 3928083 | (AC005770) unknown protein [*Arabidopsis thaliana*] | 2e-014 |
| 15834 | X83427 | *O. anatinus* mitochondrial DNA, complete genome | 0.21 | 132575 | RIBONUCLEASE INHIBITOR | 3e-021 |
| 15835 | AJ001113 | *Homo sapiens* UBE3A gene, exon 16 | 0.2 | <NONE> | <NONE> | <NONE> |
| 15836 | AF081533.1 | *Anopheles gambiae* | 0.2 | <NONE> | <NONE> | <NONE> |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | putative gram negative bacteria binding protein gene, complete cds | | | | |
| 15837 | U70316 | Dictyostelium discoideum IonA (iona) gene, partial cds | 0.2 | <NONE> | <NONE> | <NONE> |
| 15838 | AF009341 | Homo sapiens E6-AP ubiquitin-protein ligase | 0.2 | <NONE> | <NONE> | <NONE> |
| 15839 | L35330 | Rattus norvegicus glutathione S-transferase Yb3 subunit gene, complete cds. | 0.2 | 3702275 | (AC005793) KIAA0561 protein [AA 1–593] [Homo sapiens] | 2.5 |
| 15840 | AE000573.1 | Helicobacter pylori 26695 section 51 of 134 of the complete genome | 0.2 | 3947855 | (AL034381) putative Golgi membrane protein | 2.5 |
| 15841 | X83230 | G. gallus hsp90beta gene | 0.2 | 3258596 | (U95821) putative transmembrane GTPase [Drosophila melanogaster] | 0.81 |
| 15842 | X57157 | Chicken mRNA for Hsp47, heat shock protein 47 | 0.2 | 108325 | insulin-like growth factor-binding protein 6 | 0.17 |
| 15843 | M58748 | Chicken alpha-globin gene domain with structural matrix attachment sites. | 0.2 | 1086863 | (U41272) T03G11.6 gene product [Caenorhabditis elegans] | 4e−005 |
| 15844 | AB016815 | Anthocidaris crassispina mRNA for Src-type protein tyrosine kinase, complete cds | 0.2 | 423456 | epidermal growth factor-receptor-binding protein GRB-4 - mouse (fragment) | 1e−012 |
| 15845 | AF030282 | Danio rerio homeobox protein Six7 (six7) mRNA, complete cds | 0.2 | 3928083 | (AC005770) unknown protein [Arabidopsis thaliana] | 3e−014 |
| 15846 | AL035559 | Streptomyces coelicolor cosmid 9F2 | 0.2 | 2088714 | (AF003139) strong similarity to NADPH oxidases; partial CDS, the gene begins in the neighboring clone | 3e−022 |
| 15847 | S79641 | SDH = succinate dehydrogenase flavoprotein subunit Mutant, 387 nt] | 0.2 | 4755188 | (AC007018) unknown protein | 2e−022 |
| 15848 | X75383 | H. sapiens mRNA for TFIIA-alpha | 0.19 | <NONE> | <NONE> | <NONE> |
| 15849 | U53901 | Hippopotamus amphibius b-casein gene, exon 7, partial cds | 0.19 | <NONE> | <NONE> | <NONE> |
| 15850 | J05265 | Mouse interferon gamma receptor | 0.19 | 77356 | hypothetical 70K protein - eggplant mosaic | 0.0005 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | mRNA, complete cds. | | | virus | |
| 15851 | U72353 | *Rattus norvegicus* lamin B1 mRNA, complete cds | 0.19 | 3880857 | (AL031633) cDNA EST yk404d1.5 comes from this gene; cDNA EST yk404d1.3 comes from this gene | 2e−006 |
| 15852 | AB016815 | *Anthocidaris crassispina* mRNA for Src-type protein tyrosine kinase, complete cds | 0.19 | 3930217 | (AF047487) Nck-2 [*Homo sapiens*] | 2e−007 |
| 15853 | D10911 | *Mus musculus* DNA for MS2 protein, complete cds | 0.19 | 2662366 | (D86332) membrane type-2 matrix metalloproteinase [*Mus musculus*] | 5e−011 |
| 15854 | AB015345 | *Homo sapiens* HRIHFB2216 mRNA, partial cds | 0.075 | 3877417 | (Z66564) similar to anion exchange protein | 6.4 |
| 15855 | AF086410 | *Homo sapiens* full length insert cDNA clone ZD77B03 | 0.075 | 3023371 | PHEROMONE B BETA 1 RECEPTOR | 4.9 |
| 15856 | K02024 | Human T-cell lymphotropic virue type II env gene encoding envelope glycoprotein, complete cds. | 0.075 | 2791527 | (AL021246) PE_PGRS [Mycobacterium tuberculosis] | 0.11 |
| 15857 | M10188 | *X. laevis* mitochondrial DNA containing the D-loop, and the 12S rRNA, apocytochrome b, Glu-tRNA, Thr-tRNA, Pro-tRNA and Phe-tRNA genes. | 0.074 | 4753163 | huntingtin DISEASE PROTEIN) (HD PROTEIN) >gi|454415 (L12392) Huntington's Disease protein [*Homo sapiens*] | 2.8 |
| 15858 | X85525 | *G. gallus* AG repeat region (GgaMU130) | 0.073 | 984339 | (U20966) Rev [Simian immunodeficiency virus] | 3.6 |
| 15859 | AJ238394.1 | *Homo sapiens* AML2 gene (partial) | 0.07 | 4240219 | (AB020672) KIAA0865 protein [*Homo sapiens*] | 2 |
| 15860 | AF039704 | *Homo sapiens* lysosomal pepstatin insensitive protease (CLN2) gene, complete cds | 0.069 | 2894106 | (Z78279) Collagen alpha1 [*Rattus norvegicus*] | 0.39 |
| 15861 | K02024 | Human T-cell lymphotropic virue type II env gene encoding envelope glycoprotein, complete cds. | 0.068 | 4504857 | potassium intermediate/small conductance calcium-activated channel, subfamily N, member 3 >gi|3309531 (AF031815) calcium-activated | 0.5 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15862 | Z60719 | *H. sapiens* CpG island DNA genomic Mse1 fragment, clone 33a11, forward read cpg33a11.ft1m | 0.068 | 4826874 | potassium channel [*Homo sapiens*] nucleoporin 214 kD (CAIN) PROTEIN NUP214 (NUCLEOPORIN NUP214) (214 KD NUCLEOPORIN) transforming protein (can) - human *sapiens*] | 0.044 |
| 15863 | AF053994 | *Lycopersicon esculentum* Hcr2-0A (Hcr2-0A) gene, complete cds | 0.068 | 2842699 | PUTATIVE UBIQUITIN CARBOXYL-TERMINAL HYDROLASE C6G9.08 (UBIQUITIN THIOLESTERASE) (UBIQUITIN-SPECIFIC PROCESSING PROTEASE) | 9e-009 |
| 15864 | AJ233650.1 | *Equus caballus* endogenous retroviral sequence ERV-L pol gene, clone ERV-L Horse1 | 0.067 | <NONE> | <NONE> | <NONE> |
| 15865 | M10188 | *X. laevis* mitochondrial DNA containing the D-loop, and the 12S rRNA, apocytochrome b, Glu-tRNA, Thr-tRNA, Pro-tRNA and Phe-tRNA genes. | 0.067 | 4753163 | huntingtin DISEASE PROTEIN) (HD PROTEIN) >gi|454415 (L12392) Huntington's Disease protein [*Homo sapiens*] | 2.5 |
| 15866 | U14646 | Murine hepatitis virus Y strain S glycoprotein gene, complete cds. | 0.067 | 3880930 | (AL021481) similar to Phosphoglucomutase and phosphomannomutase phosphoserine; cDNA EST EMBL: D36168 comes from this gene; cDNA EST EMBL: D70697 comes from this gene; cDNA EST yk373h9.5 comes from this gene; cDNA EST EMBL: T00805 . . . | 1e-019 |
| 15867 | X15373 | Mouse cerebellum mRNA for P400 protein | 0.066 | 164507 | (M81771) immunoglobulin gamma-chain [Sus scrofa] | 9.4 |
| 15868 | AF086410 | *Homo sapiens* full length insert cDNA clone ZD77B03 | 0.066 | 3023371 | PHEROMONE B BETA 1 RECEPTOR | 4.2 |
| 15869 | AL034492 | *Streptomyces coelicolor* cosmid 6C5 | 0.066 | 3800951 | (AF100657) No definition line found | 3e-015 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | | | | [*Caenorhabditis elegans*] | |
| 15870 | L13377 | *Staphylococcus aureus* enterotoxin gene, 3' end. | 0.065 | <NONE> | <NONE> | <NONE> |
| 15871 | U83478 | *Thelephoraceae* sp. 'Taylor #13' ITS1, 5.8S ribosomal RNA gene, and ITS2, complete sequence | 0.065 | 3877335 | (Z92786) predicted using Genefinder | 9.1 |
| 15872 | AJ002014 | *Crythecodinium cohnii* mRNA for nuclear protein JUS1 | 0.065 | 1213283 | (U40576) SIM2 [*Mus musculus*] | 0.47 |
| 15873 | AB016804 | *Aloe arborescens* mRNA for NADP-malic enzyme, complete cds | 0.065 | 2832777 | (AL021086)/ prediction = (method:; comes from the 5' UTR [*Drosophila melanogaster*] | 5e-036 |
| 15874 | AJ002014 | *Crythecodinium cohnii* mRNA for nuclear protein JUS1 | 0.063 | 1213283 | (U40576) SIM2 [*Mus musculus*] | 0.45 |
| 15875 | AB023143.1 | *Homo sapiens* mRNA for KIAA0926 protein, complete cds | 0.024 | 132575 | RIBONUCLEASE INHIBITOR | 8e-026 |
| 15876 | U72966 | Human hepatocyte nuclear factor 4-alpha gene, exon 7 | 0.022 | <NONE> | <NONE> | <NONE> |
| 15877 | X02801 | Mouse gene for glial fibrillary acidic protein | 0.022 | 2231607 | (U85917) nef protein [Human immunodeficiency virus type 1] | 7 |
| 15878 | AF017636 | *Mesocricetus auratus* 3-keto-steroid reductase | 0.022 | 2723362 | (AF023459) lustrin A [*Haliotis rufescens*] | 0.097 |
| 15879 | Z36879 | *F. pringlei* gdcsPA gene for P-protein of the glycine cleavage system | 0.008 | <NONE> | <NONE> | <NONE> |
| 15880 | X73150 | *P. sativum* GapC1 gene | 0.008 | 1572629 | (U69699) unknown protein precursor [*Mus musculus*] | 8.6 |
| 15881 | AJ239031.1 | *Homo sapiens* LSS gene, partial, exons 22, 23 and joined CDS | 0.008 | 4508019 | zinc finger protein 231 protein [*Homo sapiens*] | 0.01 |
| 15882 | U76602 | Human 180 kDa bullous pemphigoid antigen 2/type XVII collagen (BPAG2/COL17A1) gene, exons 49, 50, 51 and 52 | 0.007 | 3170252 | (AF043636) circumsporozoite protein [*Plasmodium chabaudi*] | 0.0001 |
| 15883 | M11283 | *Aplysia californica* FMRFamide mRNA, partial cds, clone | 0.007 | 3874685 | (Z78539) Similarity to *S. pombe* hypothetical protein | 9e-013 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | FMRF-2. | | | C4G8.04 (SW: YAD4_SCHPO); cDNA EST EMBL: D27846 comes from this gene; cDNA EST EMBL: D27845 comes from this gene; cDNA EST yk202h7.3 comes from this gene; cDNA EST yk202h7.5 come . . . | |
| 15884 | J03998 | *P. falciparum* glutamic acid-rich protein gnen, complete cds. | 0.003 | <NONE> | <NONE> | <NONE> |
| 15885 | Z23143 | *M. musculus* ALK-6 mRNA, complete CDS | 0.002 | 2393890 | (AF006064) protein kinase homolog [Fowlpox virus] | 1e−011 |
| 15886 | AB007914 | *Homo sapiens* mRNA for KIAA0445 protein, complete cds | 0.001 | 2136964 | cysteine-rich hair keratin associated protein - rabbit >gi|510541|emb |CAA56339| (X80035) cysteine rich hair keratin associated protein | 1.9 |
| 15887 | AB012105 | *Brassica rapa* mRNA for SLG45, complete cds | 0.0008 | 3687246 | (AC005169) putative suppressor protein [*Arabidopsis thaliana*] | 5.5 |
| 15888 | L41608 | *Methylobacterium extorquens* (clone pDN9, HINDIIIAB) mxaS gene 3' end, mxaA, mxaC, mxaK, mxaL and mxaD genes, complete cds. | 0.0008 | 3024235 | NERVOUS-SYSTEM SPECIFIC OCTAMER-BINDING TRANSCRIPTION FACTOR N-OCT 3 PROTEIN) | 5.1 |
| 15889 | AB007914 | *Homo sapiens* mRNA for KIAA0445 protein, complete cds | 0.0008 | 2136964 | cysteine-rich hair keratin associated protein - rabbit >gi|510541|emb |CAA56339| (X80035) cysteine rich hair keratin associated protein | 2.5 |
| 15890 | AC002293 | Genomic sequence from Human 9q34, complete sequence [*Homo sapiens*] | 0.0008 | 2789557 | (AF034316) MHC class I antigen [*Triakis scyllium*] | 0.0002 |
| 15891 | L16013 | *Rattus norvegicus* Q-like gene sequence | 9e−005 | <NONE> | <NONE> | <NONE> |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15892 | AF148512.1 | Homo sapiens hexokinase II gene, promoter region | 9e−005 | <NONE> | <NONE> | <NONE> |
| 15893 | U94776 | Human muscle glycogen phosphorylase (PYGM) gene, exons 6 through 17 | 9e−005 | 4759138 | solute carrier family 7 transporter 3 [Homo sapiens] | 5.4 |
| 15894 | X56030 | H. sapiens IAPP gene for amyloid polypeptide, exon 1 | 1e−005 | <NONE> | <NONE> | <NONE> |
| 15895 | U36515 | Human CT microsatellite, clone GM5927-CT-2-3, from the tandemly repeated genes encoding U2 small nuclear RNA (RNU2 locus) | 4e−007 | 2435616 | (AF026215) No definition line found [Caenorhabditis elegans] | 0.85 |
| 15896 | AB011119 | Homo sapiens mRNA for KIAA0547 protein, complete cds | 4e−007 | 4758508 | airway trypsin-like protease protease [Homo sapiens] | 3e−031 |
| 15897 | NM_000521.1 | Homo sapiens hexosaminidase B (beta polypeptide) (HEXB) mRNA | 5e−008 | 2119379 | slow muscle troponin T - chicken T [Gallus gallus] | 2.8 |
| 15898 | X13895 | Human serum amyloid A (GSAA1) gene, complete cds | 4e−008 | 699405 | (U18682) novel antigen receptor [Ginglymostoma cirratum] | 7.7 |
| 15899 | AB009288.1 | Homo sapiens mRNA for N-copine, complete cds | 4e−008 | 4520342 | (AB008893) N-copine [Mus musculus] | 3e−006 |
| 15900 | AB011119 | Homo sapiens mRNA for KIAA0547 protein, complete cds | 4e−008 | 4758508 | airway trypsin-like protease protease [Homo sapiens] | 1e−028 |
| 15901 | X13895 | Human serum amyloid A (GSAA1) gene, complete cds | 5e−009 | 699405 | (U18682) novel antigen receptor [Ginglymostoma cirratum] | 7.8 |
| 15902 | X13895 | Human serum amyloid A (GSAA1) gene, complete cds | 2e−009 | 699405 | (U18682) novel antigen receptor [Ginglymostoma cirratum] | 7.2 |
| 15903 | U64997 | Bos taurus ribonuclease K6 gene, partial cds | 2e−009 | 3914810 | RIBONUCLEASE K6 PRECURSOR (RNASE K6) >gi|2745760 (AF037086) ribonuclease k6 precursor | 3e−018 |
| 15904 | J02635 | Rat liver alpha-2-macroglobulin mRNA, complete cds. | 2e−009 | 112913 | ALPHA-2-MACROGLOBULIN PRECURSOR precursor - rat >gi|202592 (J02635) prealpha-2-macroglobulin [Rattus norvegicus] | 4e−019 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15905 | Z78141 | *M. musculus* partial cochlear mRNA (clone 29C9) | 5e−010 | 3219569 | (AL023893)/ prediction = (method:; | 4e−009 |
| 15906 | AF060917 | *Gambusia affinis* microsatellite Gafu6 | 2e−010 | 3874618 | (Z48241) similar to coiled coil domains; cDNA EST yk302g12.5 comes from this gene; cDNA EST yk365d10.5 comes from this gene; cDNA EST yk461c1.5 comes from this gene [*Caenorhabditis elegans*] coil domains; cDNA EST yk302g12.5 comes from this gene; cDNA EST | 0.096 |
| 15907 | U68138 | Human PSD-95 mRNA, partial cds | 2e−010 | 4521241 | (AB024927) CsENDO-3 [Ciona savignyi] | 2e−022 |
| 15908 | U88827 | *Aotus trivirgatus* ribonuclease precursor gene, complete cds | 6e−011 | 3914810 | RIBONUCLEASE K6 PRECURSOR (RNASE K6) >gi|2745760 (AF037086) ribonuclease k6 precursor | 1e−016 |
| 15909 | AF045573 | *Mus musculus* FLI-LRR associated protein-1 mRNA, complete cds | 2e−012 | 3025718 | (AF045573) FLI-LRR associated protein-1 [*Mus musculus*] | 3e−016 |
| 15910 | NM_001365.1 | *Homo sapiens* discs, large (*Drosophila*) homolog 4 (DLG4) mRNA > :: gb|U83192|HS U83192 *Homo sapiens* post-synaptic density protein 95 (PSD95) mRNA, complete cds | 2e−012 | 4521241 | (AB024927) CsENDO-3 [*Ciona savignyi*] | 5e−020 |
| 15911 | U28049 | Human TBX2 (TXB2) mRNA, complete cds. | 7e−013 | 2501115 | TBX2 PROTEIN (T-BOX PROTEIN 2) | 2e−011 |
| 15912 | M23404 | Chicken erythrocyte anion transport protein (band3) mRNA, complete cds. | 2e−013 | 726403 | (U23175) similar to anion exchange protein [*Caenorhabditis elegans*] | 1e−025 |
| 15913 | AF005963 | *Homo sapiens* XY homologous region, partial sequence | 1e−014 | 104270 | Ig heavy chain - clawed frog | 1.9 |
| 15914 | M29863 | Human farnesyl pyrophosphate synthetase | 9e−015 | 182405 | (M29863) farnesyl pyrophosphate | 0.005 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | mRNA | | | synthetase [*Homo sapiens*] | |
| 15915 | D28126 | Human gene for ATP synthase alpha subunit, complete cds (exon 1 to 12) | 3e-015 | <NONE> | <NONE> | <NONE> |
| 15916 | Z80150 | *H. sapiens* CACNL1A4 gene, exons 41 and 42 > :: emb\|A70716.1\| A70716 Sequence 37 from Patent WO9813490 | 3e-015 | 3387914 | (AF070550) cote1 [*Homo sapiens*] | 3.5 |
| 15917 | U28049 | Human TBX2 (TXB2) mRNA, complete cds. | 4e-016 | 2501116 | TBX2 PROTEIN (T-BOX PROTEIN 2) tbx gene [*Mus musculus*] | 6e-009 |
| 15918 | U31629 | *Mus musculus* C2C12 unknown mRNA, partial cds. | 1e-017 | 3024998 | HYPOTHETICAL HEART PROTEIN | 3e-017 |
| 15919 | J05262 | Human farnesyl pyrophosphate synthetase mRNA, complete cds. | 1e-018 | 182405 | (M29863) farnesyl pyrophosphate synthetase [*Homo sapiens*] | 0.0001 |
| 15920 | D28126 | Human gene for ATP synthase alpha subunit, complete cds (exon 1 to 12) | 5e-019 | <NONE> | <NONE> | <NONE> |
| 15921 | D28126 | Human gene for ATP synthase alpha subunit, complete cds (exon 1 to 12) | 5e-019 | 3219984 | HYPOTHETICAL PROTEIN MJ1597.1 region MJ1597.1 [*Methanococcus jannaschii*] | 5.7 |
| 15922 | NM_004587.1 | *Homo sapiens* ribosome binding protein 1 (dog 180 kD homolog) (RRBP1) mRNA > :: gb\|AF006751\| AF006751 *Homo sapiens* ES/130 mRNA, complete cds | 2e-019 | 4759056 | ribosome binding protein 1 (dog 180 kD homolog) >gi\|3299885 (AF006751) ES/130 [*Homo sapiens*] | 0.004 |
| 15923 | U89915 | *Mus musculus* junctional adhesion molecule (Jam) mRNA, complete cds | 5e-020 | 3462455 | (U89915) junctional adhesion molecule [*Mus musculus*] | 2e-005 |
| 15924 | AF045573 | *Mus musculus* FLI-LRR associated protein-1 mRNA, complete cds | 5e-020 | 3025718 | (AF045573) FLI-LRR associated protein-1 [*Mus musculus*] | 9e-025 |
| 15925 | NM_004587.1 | *Homo sapiens* ribosome binding protein 1 (dog 180 kD homolog) (RRBP1) mRNA > :: gb\|AF006751\| | 2e-020 | 4759056 | ribosome binding protein 1 (dog 180 kD homolog) >gi\|3299885 (AF006751) ES/130 [*Homo sapiens*] | 0.0008 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | AF006751 *Homo sapiens* ES/130 mRNA, complete cds | | | | |
| 15926 | AF051098 | *Mus musculus* seven transmembrane domain orphan receptor mRNA, complete cds | 2e-021 | 3858883 | (U67056) myosin I heavy chain kinase [*Acanthamoeba castellanii*] >gi\|4206769 (AF104910) myosin I heavy chain kinase [*Acanthamoeba castellanii*] | 0.002 |
| 15927 | AF051098 | *Mus musculus* seven transmembrane domain orphan receptor mRNA, complete cds | 2e-021 | 3858883 | (U67056) myosin I heavy chain kinase [*Acanthamoeba castellanii*] >gi\|4206769 (AF104910) myosin I heavy chain kinase [*Acanthamoeba castellanii*] | 0.001 |
| 15928 | M13519 | Human N-acetyl-beta-glucosaminidase (HEXB) mRNA, 3' end. | 2e-021 | 4504373 | hexosaminidase B (beta polypeptide) >gi\|123081\|sp \|P07686\|HEXB_ HUMAN BETA-HEXOSAMINIDASE BETA CHAIN PRECURSOR beta-N-acetylhexosaminidase (EC 3.2.1.52) beta chain - human >gi\|386770 (M23294) beta-hexosaminidase beta-subunit [*Homo sapiens*] | 2e-007 |
| 15929 | Z81014 | Human DNA sequence from cosmid U65A4, between markers DXS366 and DXS87 on chromosome X* | 2e-022 | <NONE> | <NONE> | <NONE> |
| 15930 | AF147311.1 | *Homo sapiens* full length insert cDNA clone YA82F10 | 2e-022 | 3875904 | (Z70207) predicted using Genefinder; similar to collagen; cDNA EST EMBL: D65905 comes from this gene; cDNA EST EMBL: D65858 comes from this gene; cDNA EST EMBL: D69306 comes from this gene; cDNA EST EMBL: D65755 | 0.07 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15931 | AF037088 | *Gorilla gorilla* ribonuclease k6 precursor, gene, complete cds | 9e−024 | 3914791 | comes from this gen... RIBONUCLEASE K6 PRECURSOR (RNASE K6) >gi\|2745752 (AF037082) ribonuclease k6 precursor | 3e−019 |
| 15932 | Z81014 | Human DNA sequence from cosmid U65A4, between markers DXS366 and DXS87 on chromosome X* | 8e−024 | <NONE> | <NONE> | <NONE> |
| 15933 | AF037088 | *Gorilla gorilla* ribonuclease k6 precursor, gene, complete cds | 9e−025 | 3914810 | RIBONUCLEASE K6 PRECURSOR (RNASE K6) >gi\|2745760 (AF037086) ribonuclease k6 precursor | 4e−018 |
| 15934 | AF147311.1 | *Homo sapiens* full length insert cDNA clone YA82F10 | 1e−026 | 131413 | PULMONARY SURFACTANT-ASSOCIATED PROTEIN A PRECURSOR (SP-A) (PSP-A) (PSAP) precursor - rabbit >gi\|165706 (J03542) apoprotein of surfactant [*Oryctolagus cuniculus*] | 0.059 |
| 15935 | Z46786 | *D. melanogaster* mRNA for acetyl-CoA synthetase | 1e−027 | 1079042 | acetyl-CoA synthetase - fruit fly | 4e−025 |
| 15936 | NM_004039.1 | *Homo sapiens* annexin II (lipocortin II) for lipocortin II, complete cds | 4e−028 | 450448 | (M33322) calpactin I heavy chain [*Mus musculus*] | 0.1 |
| 15937 | X53064 | *Homo sapiens* SPRR2A gene encoding small proline rich protein | 1e−028 | 134846 | SMALL PROLINE-RICH PROTEIN II rich protein [*Homo sapiens*] | 0.005 |
| 15938 | M29863 | Human farnesyl pyrophosphate synthetase mRNA | 1e−028 | 4503685 | farnesyl diphosphate synthase dimethylallyltranstransferase, geranyltranstransferase) bp313 to bp1374 is almost identical to human farnesyl pyrophosphate synthetase mRNA. [*Homo sapiens*] | 2e−008 |
| 15939 | Z18950 | *H. sapiens* genes for S100E calcium binding protein, CAPL, | 5e−029 | 2493898 | DOPAMINE-BETA-MONOOXYGENASE | 1.4 |

… continued

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | and S100D calcium binding protein EF-Hand patent US 5789248 | | | PRECURSOR (DOPAMINE BETA-HYDROXYLASE) (DBH) 1.14.17.1) precursor - mouse >gi|260873|bbs |119249 621 aa] [*Mus* sp.] | |
| 15940 | M19481 | Human follistatin gene, exon 6. | 5e−030 | <NONE> | <NONE> | <NONE> |
| 15941 | AF007155 | *Homo sapiens* clone 23763 unknown mRNA, partial cds | 2e−032 | 4502641 | chemokine (C-C) receptor 7 TYPE 7 PRECURSOR (C-C CKR-7) (CC-CKR-7) (CCR-7) (MIP-3 BETA RECEPTOR) (EBV-INDUCED G PROTEIN-COUPLED RECEPTOR 1) (EBI1) (BLR2) >gi|1082381|Pir ||B55735 lymphocyte-specific G-protein-coupled receptor EBI1 - human >gi|468316 (L3158 | 1.6 |
| 15942 | M99624 | Human epidermal growth factor receptor-related gene, 5' end. | 8e−034 | 294845 | (L13655) membrane protein [Saccharum hybrid cultivar H65-7052] | 9e−014 |
| 15943 | U49082 | Human transporter protein (g17) mRNA, complete cds | 8e−035 | 1840045 | (U49082) transporter protein [*Homo sapiens*] | 1e−014 |
| 15944 | D50369 | *Homo sapiens* mRNA for low molecular mass ubiquinone-binding protein, complete cds | 9e−036 | 3024781 | UBIQUINOL-CYTOCHROME C REDUCTASE COMPLEX UBIQUINONE-BINDING PROTEIN QP-C PROTEIN) (COMPLEX III SUBUNIT VII) ubiquinone-binding protein [*Homo sapiens*] | 0.0002 |
| 15945 | AF086313 | *Homo sapiens* full length insert cDNA clone ZD52B10 | 9e−036 | 2832777 | (AL021086)/ prediction = (method:; comes from the 5' UTR [*Drosophila melanogaster*] | 1e−039 |
| 15946 | NM_004074.1 | *Homo sapiens* cytochrome c oxidase subunit VIII (COX8), nuclear gene | 1e−038 | 2499854 | PROBABLE PEPTIDASE Y4SO >gi|2182630 | 2 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| | | encoding mitochondrial protein, mRNA > :: gb\|J04823\|HUMCOX8A Human cytochrome c oxidase subunit VIII (COX8) mRNA, complete cds. | | | | |
| 15947 | AB024436.1 | *Homo sapiens* mRNA for beta-1,4-galactosyltransferase IV, complete cds | 2e−041 | 3132900 | (AF038662) beta-1,4-galactosyltransferase [*Homo sapiens*] beta-1,4-galactosyltransferase IV [*Homo sapiens*] | 4e−016 |
| 15948 | AF057734 | *Homo sapiens* 17-beta-hydroxysteroid dehydrogenase IV (HSD17B4) gene, exon 16 | 2e−043 | 2842416 | (AL008730) dJ487J7.1.1 (putative protein dJ487J7.1 isoform 1) [*Homo sapiens*] | 3e−062 |
| 15949 | Z69650.1 | Human DNA sequence from cosmid L69F7B, Huntington's Disease Region, chromosome 4p16.3 contains Huntington Disease (HD) gene | 2e−044 | 1872200 | (U22376) alternatively spliced product using exon 13A | 1e−008 |
| 15950 | NM_003938.1 | *Homo sapiens* adaptin, delta (ADTD) mRNA > :: gb\|U91930\|HSU91930 *Homo sapiens* AP-3 complex delta subunit mRNA, complete cds | 2e−044 | 3478639 | (AC005545) delta-adaptin, partial CDS [*Homo sapiens*] | 3e−016 |
| 15951 | AF026029 | *Homo sapiens* poly(A) binding protein II (PABP2) gene, complete cds | 8e−045 | 1916930 | (U88570) CREB-binding protein homolog [*Drosophila melanogaster*] | 7.6 |
| 15952 | AB006622 | *Homo sapiens* mRNA for KIAA0284 gene, partial cds | 1e−045 | 73404 | E2 protein - human papillomavirus type 5 | 0.11 |
| 15953 | U90918 | Human clone 23654 mRNA sequence | 1e−048 | 3877568 | (Z70208) similar to collagen | 0.042 |
| 15954 | AB006622 | *Homo sapiens* mRNA for KIAA0284 gene, partial cds | 1e−049 | 73404 | E2 protein - human papillomavirus type 5 | 0.11 |
| 15955 | AL049258.1 | *Homo sapiens* mRNA; cDNA DKFZp564E173 (from clone DKFZp564E173) | 1e−050 | <NONE> | <NONE> | <NONE> |
| 15956 | AF022367 | *Homo sapiens* beta-1,4-galactosyltransferase mRNA, complete cds | 5e−051 | 3132900 | (AF038662) beta-1,4-galactosyltransferase [*Homo sapiens*] beta-1,4- | 6e−019 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15957 | AF057734 | *Homo sapiens* 17-beta-hydroxysteroid dehydrogenase IV (HSD17B4) gene, exon 16 | 7e−053 | 2842416 | galactosyltransferase IV [*Homo sapiens*] (AL008730) dJ487J7.1.1 (putative protein dJ487J7.1 isoform 1) [*Homo sapiens*] | 6e−055 |
| 15958 | AF097709 | *Homo sapiens* serine protease (PRSS11) mRNA, partial cds | 8e−055 | 4506141 | protease, serine, 11 (IGF binding) >gi\|1513059\|dbj \|BAA13322\| (D87258) serin protease with IGF-binding motif [*Homo sapiens*] protease, PRSS11 [*Homo sapiens*] | 2e−017 |
| 15959 | U31629 | *Mus musculus* C2C12 unknown mRNA, partial cds. | 9e−057 | 3025215 | HYPOTHETICAL 81.0 KD PROTEIN C35D10.4 IN CHROMOSOME III >gi\|2146877\|pir \|\|S72572 probable ABC1 protein homolog - *Caenorhabditis elegans* protein (Swiss-Prot Acc: P27697) [*Caenorhabditis elegans*] | 5e−033 |
| 15960 | AB006622 | *Homo sapiens* mRNA for KIAA0284 gene, partial cds | 8e−057 | 73404 | E2 protein - human papillomavirus type 5 | 1.7 |
| 15961 | AF025439 | *Homo sapiens* Opa-interacting protein OIP3 mRNA, partial cds | 4e−059 | <NONE> | <NONE> | <NONE> |
| 15962 | M99624 | Human epidermal growth factor receptor-related gene, 5' end. | 1e−060 | 123364 | SEGMENTATION PROTEIN EVEN-SKIPPED fly (*Drosophila* sp.) >gi\|157387 (M14767) even-skipped gene [*Drosophila melanogaster*] | 5.3 |
| 15963 | AF045573 | *Mus musculus* FLI-LRR associated protein-1 mRNA, complete cds | 5e−061 | 3025718 | (AF045573) FLI-LRR associated protein-1 [*Mus musculus*] | 7e−029 |
| 15964 | AB006622 | *Homo sapiens* mRNA for KIAA0284 gene, partial cds | 2e−062 | 2119133 | ribosomal protein S17 - cat (fragment) *musculus*] | 2e−015 |
| 15965 | M30702 | Human amphiregulin (AR) gene, exon 5, clones lambda-ARH(6,12). | 2e−063 | 4502199 | amphiregulin (schwannoma-derived growth factor) >gi\|113754\|sp\| P15514\|AMP R_HUMAN | 0.0002 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15966 | L38847 | *Mus musculus* hepatoma transmembrane kinase ligand Sequence 1 from patent US 5624899 | 6e−064 | 3861228 | AMPHIREGULIN PRECURSOR (AR) (COLORECTUM CELL-DERIVED GROWTH FACTOR) (CRDGF) >gi|107391|pir|| A34702 amphiregulin precursor - human >gi|178890 (M30703) amphiregulin [*Homo sapien* (AJ235272) unknown [*Rickettsia prowazekii*] | 2.9 |
| 15967 | L38847 | *Mus musculus* hepatoma transmembrane kinase ligand Sequence 1 from patent US 5624899 | 6e−064 | 3861228 | (AJ235272) unknown [*Rickettsia prowazekii*] | 2.9 |
| 15968 | Z78141 | *M. musculus* partial cochlear mRNA (clone 29C9) | 8e−066 | 1490324 | (Z78141) unknown [*Mus musculus*] | 8e−019 |
| 15969 | X12650 | *Mus musculus* gene for beta-tropomyosin | 2e−072 | 833602 | (X54277) cardiac tropomyosin [*Coturnix coturnix*] | 7e−022 |
| 15970 | M87635 | Mouse beta-tropomyosin 2 mRNA, complete cds. | 2e−084 | 1216293 | (L35239) cardiac tropomyosin [*Xenopus laevis*] | 5e−019 |
| 15971 | M13364 | Rabbit calcium-dependent protease, small subunit mRNA, complete cds. | 2e−084 | 115611 | CALCIUM-DEPENDENT PROTEASE, SMALL NEUTRAL PROTEINASE) (CANP) >gi|108563|pir|| A34466 calpain (EC 3.4.22.17) II light chain - bovine 3.4.22.17) [*Bos taurus*] | 1e−058 |
| 15972 | M87635 | Mouse beta-tropomyosin 2 mRNA, complete cds. | 3e−088 | 1216293 | (L35239) cardiac tropomyosin [*Xenopus laevis*] | 9e−028 |
| 15973 | M87635 | Mouse beta-tropomyosin 2 mRNA, complete cds. | 5e−092 | 1216293 | (L35239) cardiac tropomyosin [*Xenopus laevis*] | 2e−035 |
| 15974 | X85992 | *M. musculus* mRNA for semaphorin C | 8e−097 | 2137756 | semaphorin C - mouse (fragment) musculus*] | 2e−048 |

TABLE 121-continued

| SEQ ID | Nearest Neighbor (BlastN vs. Genbank) ACCESSION | DESCRIPTION | P VALUE | Nearest Neighbor (BlastX vs. Non-Redundant Proteins) ACCESSION | DESCRIPTION | P VALUE |
|---|---|---|---|---|---|---|
| 15975 | M24103 | Bovine ADP/ATP translocase T2 mRNA, complete cds. | e−103 | 113463 | ADP, ATP CARRIER PROTEIN, LIVER ISOFORM T2 (ADP/ATP TRANSLOCASE 3) (ADENINE NUCLEOTIDE TRANSLOCATOR 3) (ANT 3) >gi\|86757\|pir\|\| S03894 ADP, ATP carrier protein T2 - human | 2e−035 |
| 15976 | U48852 | Cricetulus griseus HT protein mRNA, complete cds. | e−107 | 1216486 | (U48852) HT protein [Cricetulus griseus] | 3e−057 |
| 15977 | X76168 | R. norvegicus mRNA for connexin 30.3 | e−112 | 544118 | GAP JUNCTION BETA-5 PROTEIN (CONNEXIN 30.3) (CX30.3) >gi\|481577\|pir\|\| S38891 connexin 30.3 - rat >gi\|431204\|emb\| CAA53762\| (X76168) connexin 30.3 | 1e−063 |
| 15978 | X76168 | R. norvegicus mRNA for connexin 30.3 | e−115 | 461864 | GAP JUNCTION BETA-5 PROTEIN junction protein Cx30.3 - mouse >gi\|192647 (M91443) connexin 30.3 [Mus musculus] | 7e−064 |
| 15979 | AJ009634.1 | Mus musculus fjx1 gene | e−137 | 4138203 | (AJ009634) Fjx1 [Mus musculus] | 5e−065 |
| 15980 | X76168 | R. norvegicus mRNA for connexin 30.3 | e−130 | 544118 | GAP JUNCTION BETA-5 PROTEIN (CONNEXIN 30.3) (CX30.3) >gi\|481577\|pir\|\| S38891 connexin 30.3 - rat >gi\|431204\|emb\| CAA53762\| (X76168) connexin 30.3 | 2e−074 |

Example 79

Differential Expression of Polynucleotides of the Invention: Description of Libraries and Detection of Differential Expression The relative expression levels of the polynucleotides of the invention was assessed in several libraries prepared from various sources, including primary cells, cell lines and patient tissue samples. Table 122 provides a summary of these libraries, including the shortened library name (used hereafter), the mRNA source used to prepared the cDNA library, the "nickname" of the library that is used in the tables below (in quotes), and the approximate number of clones in the library.

TABLE 122

Description of cDNA Libraries

| Library (Lib#) | Description | Number of Clones in Library |
|---|---|---|
| 1 | Human Colon Cell Line Km12 L4: High Metastatic Potential (derived from Km12C) | 308731 |
| 2 | Human Colon Cell Line Km12C: Low Metastatic Potential | 284771 |
| 3 | Human Breast Cancer Cell Line MDA-MB-231: High Metastatic Potential; micro-mets in lung | 326937 |
| 4 | Human Breast Cancer Cell Line MCF7: Non Metastatic | 318979 |
| 8 | Human Lung Cancer Cell Line MV-522: High Metastatic Potential | 223620 |
| 9 | Human Lung Cancer Cell Line UCP-3: Low Metastatic Potential | 312503 |
| 12 | Human microvascular endothelial cells (HMVEC) - UNTREATED (PCR (OligodT) cDNA library) | 41938 |
| 13 | Human microvascular endothelial cells (HMVEC) - bFGF TREATED (PCR (OligodT) cDNA library) | 42100 |
| 14 | Human microvascular endothelial cells (HMVEC) - VEGF TREATED (PCR (OligodT) cDNA library) | 42825 |
| 15 | Normal Colon - UC#2 Patient (MICRODISSECTED PCR (OligodT) cDNA library) | 282722 |
| 16 | Colon Tumor - UC#2 Patient (MICRODISSECTED PCR (OligodT) cDNA library) | 298831 |
| 17 | Liver Metastasis from Colon Tumor of UC#2 Patient (MICRODISSECTED PCR (OligodT) cDNA library) | 303467 |
| 18 | Normal Colon - UC#3 Patient (MICRODISSECTED PCR (OligodT) cDNA library) | 36216 |
| 19 | Colon Tumor - UC#3 Patient (MICRODISSECTED PCR (OligodT) cDNA library) | 41388 |
| 20 | Liver Metastasis from Colon Tumor of UC#3 Patient (MICRODISSECTED PCR (OligodT) cDNA library) | 30956 |
| 21 | GRRpz Cells derived from normal prostate epithelium | 164801 |
| 22 | WOca Cells derived from Gleason Grade 4 prostate cancer epithelium | 162088 |
| 23- | Normal Lung Epithelium of Patient #1006 (MICRODISSECTED PCR (OligodT) cDNA library) | 306198 |
| 24 | Primary tumor, Large Cell Carcinoma of Patient #1006 (MICRODISSECTED PCR (OligodT) cDNA library) | 309349 |

The KM12L4 cell line is derived from the KM12C cell line (Morikawa, et al., *Cancer Research* (1988) 48:6863). The KM12C cell line, which is poorly metastatic (low metastatic) was established in culture from a Dukes' stage $B_2$ surgical specimen (Morikawa et al. *Cancer Res.* (1988) 48:6863). The KML4-A is a highly metastatic subline derived from KM12C (Yeatman et al. *Nucl. Acids. Res.* (1995) 23:4007; Bao-Ling et al. *Proc. Annu. Meet. Am. Assoc. Cancer. Res.* (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. *Clin. Cancer Res.* (1995) 1:19; Yeatman et al., (1995) supra; Yeatman et al. *Clin. Exp. Metastasis* (1996) 14:246). The MDA-MB-231 cell line (Brinkley et al. *Cancer Res.* (1980) 40:3118-3129) was originally isolated from pleural effusions (Cailleau, *J. Natl. Cancer. Inst.* (1974) 53:661), is of high metastatic potential, and forms poorly differentiated adenocarcinoma grade II in nude mice consistent with breast carcinoma.

The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., *Cancer Res.* (1979) 39:870 (MDA-MB-231 and MCF-7); Gastpar et al., *J Med Chem* (1998) 41:4965 (MDA-MB-231 and MCF-7); Ranson et al., *Br J Cancer* (1998) 77:1586 (MDA-MB-231 and MCF-7); Kuang et al., *Nucleic Acids Res* (1998) 26:1116 (MDA-MB-231 and MCF-7); Varki et al., *Int J Cancer* (1987) 40:46 (UCP-3); Varki et al., *Tumour Biol.* (1990) 11:327; (MV-522 and UCP-3); Varki et al., *Anticancer Res.* (1990) 10:637; (MV-522); Kelner et al., *Anticancer Res* (1995) 15:867 (MV-522); and Zhang et al., *Anticancer Drugs* (1997) 8:696 (MV522)). The samples of libraries 15-20 are derived from two different patients (UC#2, and UC#3). The bFGF-treated HMVEC were prepared by incubation with bFGF at 10 ng/ml for 2 hrs; the VEGF-treated HMVEC were prepared by incubation with 20 ng/ml VEGF for 2 hrs. Following incubation with the respective growth factor, the cells were washed and lysis buffer added for RNA preparation. The GRRpz and WOca cells were provided by Dr. Donna M.

Peehl, Department of Medicine, Stanford University School of Medicine. GRRpz cells were derived from normal prostate epithelium. The WOca cells are Gleason Grade 4 cell line.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., *Genomics* (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is said to be significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences between Proportions," pp 296-298 (1974).

Using this approach, a number of polynucleotide sequences were identified as being differentially expressed between, for example, cells derived from high metastatic potential cancer tissue and low metastatic cancer cells, and between cells derived from metastatic cancer tissue and normal tissue. Evaluation of the levels of expression of the genes corresponding to these sequences can be valuable in diagnosis, prognosis, and/or treatment (e.g., to facilitate rationale design of therapy, monitoring during and after therapy, etc.). Moreover, the genes corresponding to differentially expressed sequences described herein can be therapeutic targets due to their involvement in regulation (e.g., inhibition or promotion) of development of, for example, the metastatic phenotype. For example, sequences that correspond to genes that are increased in expression in high metastatic potential cells relative to normal or non-metastatic tumor cells may encode genes or regulatory sequences involved in processes such as angiogenesis, differentiation, cell replication, and metastasis.

Detection of the relative expression levels of differentially expressed polynucleotides described herein can provide valuable information to guide the clinician in the choice of therapy. For example, a patient sample exhibiting an expression level of one or more of these polynucleotides that corresponds to a gene that is increased in expression in metastatic or high metastatic potential cells may warrant more aggressive treatment for the patient. In contrast, detection of expression levels of a polynucleotide sequence that corresponds to expression levels associated with that of low metastatic potential cells may warrant a more positive prognosis than the gross pathology would suggest.

The differential expression of the polynucleotides described herein can thus be used as, for example, diagnostic markers, prognostic markers, for risk assessment, patient treatment and the like. These polynucleotide sequences can also be used in combination with other known molecular and/or biochemical markers.

The differential expression data for polynucleotides of the invention that have been identified as being differentially expressed across various combinations of the libraries described above is summarized in Table 123 (inserted prior to the claims). Table 123 provides: 1) the Sequence Identification Number ("SEQ ID") assigned to the polynucleotide; 2) the cluster ("CLUST") to which the polynucleotide has been assigned as described above; 3) the library comparisons that resulted in identification of the polynucleotide as being differentially expressed ("PairAB-text"), with shorthand names of the compared libraries provided in parentheses following the library numbers; 4) the number of clones corresponding to the polynucleotide in the first library listed ("A"); 5) the number of clones corresponding to the polynucleotide in the second library listed ("B"); 6) the "RATIO PLUS" where the comparison resulted in a finding that the number of clones in library A is greater than the number of clones in library B; and 7) the "RATIO MINUS" where the comparison resulted in a finding that the number of clones in library B is greater than the number of clones in library A.

TABLE 123

| SEQ ID | CLUST | PairAB-text | CLONES in A | CLONES in B | RATIO PLUS | RATIO MINUS |
|---|---|---|---|---|---|---|
| 15670 | 819498 | _21, 22 (Normal Prostate vs. Cancerous Prostate) | 6 | 0 | 5.9 | |
| 15674 | 728115 | _15, 16 (Normal Colon vs. Colon Tumor) | 0 | 7 | | 6.62 |
| | | _16, 17 (Colon Tumor vs. Colon Metastasis) | 7 | 0 | 7.11 | |
| 15675 | 372700 | _08, 09 (Lung, High Metastatic Potential vs. Lung, Low Metastatic Potential) | 3 | 50 | | 11.93 |
| | | _19, 20 (Colon Tumor vs. Colon Tumor Metastasis) | 8 | 0 | 5.98 | |
| 15678 | 729832 | _15, 16 (Normal Colon vs. Colon Tumor) | 0 | 11 | | 10.41 |
| | | _16, 17 (Colon Tumor vs. Colon Metastasis) | 11 | 0 | 11.17 | |
| 15679 | 505514 | _23, 24 (Normal Lung vs. Lung Tumor) | 26 | 10 | 2.63 | |
| 15683 | 549934 | _21, 22 (Normal Prostate vs. Cancerous Prostate) | 8 | 0 | 7.87 | |
| | | _16, 17 (Colon Tumor vs. Colon Metastasis) | 3 | 20 | | 6.56 |
| | | _15, 16 (Normal Colon vs. Colon Tumor) | 11 | 3 | 3.88 | |
| 15691 | 450399 | _15, 16 (Normal Colon vs. Colon Tumor) | 28 | 68 | | 2.3 |
| | | _15, 17 (Normal Colon vs. Colon Metastasis) | 28 | 117 | | 3.89 |
| 15692 | 450982 | _16, 17 (Colon Tumor vs. Colon Metastasis) | 14 | 32 | | 2.25 |
| 15694 | 379302 | _21, 22 (Normal Prostate vs. Cancerous Prostate) | 8 | 1 | 7.87 | |
| 15709 | 817503 | _21, 22 (Normal Prostate vs. Cancerous Prostate) | 18 | 4 | 4.43 | |
| 15714 | 830085 | _21, 22 (Normal Prostate vs. Cancerous Prostate) | 0 | 9 | | 9.15 |
| 15718 | 830931 | _21, 22 (Normal Prostate vs. Cancerous Prostate) | 0 | 7 | | 7.12 |
| 15721 | 819046 | _21, 22 (Normal Prostate vs. Cancerous Prostate) | 2 | 13 | | 6.61 |
| 15724 | 728115 | _15, 16 (Normal Colon vs. Colon Tumor) | 0 | 7 | | 6.62 |
| | | _16, 17 (Colon Tumor vs. Colon Metastasis) | 7 | 0 | 7.11 | |
| 15731 | 553242 | _16, 17 (Colon Tumor vs. Colon Metastasis) | 0 | 6 | | 5.91 |
| 15737 | 820061 | _21, 22 (Normal Prostate vs. Cancerous Prostate) | 1 | 20 | | 20.33 |
| 15744 | 220584 | _08, 09 (Lung, High Metastatic Potential vs. Lung, Low Metastatic Potential) | 1 | 12 | | 8.59 |
| 15746 | 549934 | _16, 17 (Colon Tumor vs. Colon Metastasis) | 3 | 20 | | 6.56 |
| | | _15, 16 (Normal Colon vs. Colon Tumor) | 11 | 3 | 3.88 | |
| | | _21, 22 (Normal Prostate vs. Cancerous Prostate) | 8 | 0 | 7.87 | |
| 15752 | 819460 | _21, 22 (Normal Prostate vs. Cancerous Prostate) | 18 | 1 | 17.7 | |
| 15761 | 551785 | _21, 22 (Normal Prostate vs. Cancerous Prostate) | 0 | 6 | | 6.1 |
| 15762 | 17092 | _03, 04 (Breast, High Metastatic Potential vs. Breast, Non-Metastatic) | 0 | 25 | | 25.62 |
| 15765 | 745559 | _21, 22 (Normal Prostate vs. Cancerous Prostate) | 1 | 9 | | 9.15 |
| 15767 | 379879 | _21, 22 (Normal Prostate vs. Cancerous Prostate) | 0 | 9 | | 9.15 |
| | | 08, 09 (Lung, High Metastatic Potential vs. Lung, Low Metastatic Potential) | 0 | 13 | | 9.3 |
| 15773 | 268290 | _21, 22 (Normal Prostate vs. Cancerous Prostate) | 33 | 69 | | 2.13 |
| 15774 | 818043 | _21, 22 (Normal Prostate vs. Cancerous Prostate) | 6 | 0 | 5.9 | |
| 15780 | 450247 | _21, 22 (Normal Prostate vs. Cancerous Prostate) | 23 | 8 | 2.83 | |

TABLE 123-continued

| SEQ ID | CLUST | PairAB-text | CLONES in A | CLONES in B | RATIO PLUS | RATIO MINUS |
|---|---|---|---|---|---|---|
| 15781 | 819273 | _21, 22 (Normal Prostate vs. Cancerous Prostate) | 7 | 0 | 6.88 | |
| 15782 | 587779 | _21, 22 (Normal Prostate vs. Cancerous Prostate) | 6 | 0 | 5.9 | |
| 15784 | 615617 | _21, 22 (Normal Prostate vs. Cancerous Prostate) | 0 | 7 | | 7.12 |
| 15787 | 818682 | _21, 22 (Normal Prostate vs. Cancerous Prostate) | 11 | 2 | 5.41 | |
| 15789 | 484413 | _21, 22 (Normal Prostate vs. Cancerous Prostate) | 7 | 0 | 6.88 | |
| 15790 | 819273 | _21, 22 (Normal Prostate vs. Cancerous Prostate) | 7 | 0 | 6.88 | |
| 15793 | 818682 | _21, 22 (Normal Prostate vs. Cancerous Prostate) | 11 | 2 | 5.41 | |
| 15797 | 819273 | _21, 22 (Normal Prostate vs. Cancerous Prostate) | 7 | 0 | 6.88 | |
| 15813 | 820061 | _21, 22 (Normal Prostate vs. Cancerous Prostate) | 1 | 20 | | 20.33 |
| 15819 | 375958 | _21, 22 (Normal Prostate vs. Cancerous Prostate) | 2 | 11 | | 5.59 |
| | | _08, 09 (Lung, High Metastatic Potential vs. Lung, Low Metastatic Potential) | 0 | 9 | | 6.44 |
| 15821 | 831049 | _21, 22 (Normal Prostate vs. Cancerous Prostate) | 0 | 11 | | 11.18 |
| 15823 | 553200 | _21, 22 (Normal Prostate vs. Cancerous Prostate) | 0 | 6 | | 6.1 |
| 15824 | 139677 | _21, 22 (Normal Prostate vs. Cancerous Prostate) | 6 | 0 | 5.9 | |
| 15825 | 139677 | _21, 22 (Normal Prostate vs. Cancerous Prostate) | 6 | 0 | 5.9 | |
| 15829 | 375958 | _08, 09 (Lung, High Metastatic Potential vs. Lung, Low Metastatic Potential) | 0 | 9 | | 6.44 |
| | | _21, 22 (Normal Prostate vs. Cancerous Prostate) | 2 | 11 | | 5.59 |
| 15834 | 831812 | _21,22 (Normal Prostate vs. Cancerous Prostate) | 0 | 7 | | 7.12 |
| 15842 | 193373 | _21, 22 (Normal Prostate vs. Cancerous Prostate) | 6 | 0 | 5.9 | |
| 15843 | 400619 | _08, 09 (Lung, High Metastatic Potential vs. Lung, Low Metastatic Potential) | 6 | 0 | 8.38 | |
| 15844 | 831149 | _21, 22 (Normal Prostate vs. Cancerous Prostate) | 0 | 7 | | 7.12 |
| 15846 | 817503 | _21, 22 (Normal Prostate vs. Cancerous Prostate) | 18 | 4 | 4.43 | |
| 15853 | 648679 | _23, 24 (Normal Lung vs. Lung Tumor) | 11 | 1 | 11.11 | |
| | | _16, 17 (Colon Tumor vs. Colon Metastasis) | 79 | 0 | 80.23 | |
| | | _15, 17 (Normal Colon vs. Colon Metastasis) | 7 | 0 | 7.51 | |
| | | _15, 16 (Normal Colon vs. Colon Tumor) | 7 | 79 | | 10.68 |
| 15856 | 373928 | _21, 22 (Normal Prostate vs. Cancerous Prostate) | 7 | 0 | 6.88 | |
| 15861 | 373928 | _21, 22 (Normal Prostate vs. Cancerous Prostate) | 7 | 0 | 6.88 | |
| 15864 | 372700 | _19, 20 (Colon Tumor vs. Colon Tumor Metastasis) | 8 | 0 | 5.98 | |
| | | _08, 09 (Lung, High Metastatic Potential vs. Lung, Low Metastatic Potential) | 3 | 50 | | 11.93 |
| 15870 | 379105 | _15, 16 (Normal Colon vs. Colon Tumor) | 0 | 8 | | 7.57 |
| 15871 | 831188 | _21, 22 (Normal Prostate vs. Cancerous Prostate) | 0 | 8 | | 8.13 |
| 15875 | 831812 | _21, 22 (Normal Prostate vs. Cancerous Prostate) | 0 | 7 | | 7.12 |
| 15879 | 831026 | _21, 22 (Normal Prostate vs. Cancerous Prostate) | 0 | 10 | | 10.17 |
| 15881 | 380207 | _21, 22 (Normal Prostate vs. Cancerous Prostate) | 0 | 6 | | 6.1 |
| | | _08, 09 (Lung, High Metastatic Potential vs. Lung, Low Metastatic Potential) | 0 | 8 | | 5.72 |

TABLE 123-continued

| SEQ ID | CLUST | PairAB-text | CLONES in A | CLONES in B | RATIO PLUS | RATIO MINUS |
|---|---|---|---|---|---|---|
| 15882 | 819460 | _21, 22 (Normal Prostate vs. Cancerous Prostate) | 18 | 1 | 17.7 | |
| 15890 | 819201 | _21, 22 (Normal Prostate vs. Cancerous Prostate) | 6 | 0 | 5.9 | |
| 15891 | 374826 | _15, 17 (Normal Colon vs. Colon Metastasis) | 5 | 20 | | 3.73 |
| | | _08, 09 (Lung, High Metastatic Potential vs. Lung, Low Metastatic Potential) | 38 | 132 | | 2.49 |
| | | _15, 16 (Normal Colon vs. Colon Tumor) | 5 | 18 | | 3.41 |
| 15897 | 553242 | _16, 17 (Colon Tumor vs. Colon Metastasis) | 0 | 6 | | 5.91 |
| 15912 | 220584 | _08, 09 (Lung, High Metastatic Potential vs. Lung, Low Metastatic Potential) | 1 | 12 | | 8.59 |
| 15914 | 819498 | _21, 22 (Normal Prostate vs. Cancerous Prostate) | 6 | 0 | 5.9 | |
| 15919 | 819498 | _21, 22 (Normal Prostate vs. Cancerous Prostate) | 6 | 0 | 5.9 | |
| 15922 | 831160 | _21, 22 (Normal Prostate vs. Cancerous Prostate) | 0 | 12 | | 12.2 |
| 15925 | 831160 | _21, 22 (Normal Prostate vs. Cancerous Prostate) | 0 | 12 | | 12.2 |
| 15928 | 373298 | _15, 17 (Normal Colon vs. Colon Metastasis) | 126 | 42 | 3.22 | |
| | | _15, 16 (Normal Colon vs. Colon Tumor) | 126 | 59 | 2.26 | |
| 15936 | 450262 | _21, 22 (Normal Prostate vs. Cancerous Prostate) | 0 | 8 | | 8.13 |
| 15937 | 484703 | _21, 22 (Normal Prostate vs. Cancerous Prostate) | 28 | 0 | 27.54 | |
| 15938 | 819498 | _21, 22 (Normal Prostate vs. Cancerous Prostate) | 6 | 0 | 5.9 | |
| 15939 | 406043 | _21, 22 (Normal Prostate vs. Cancerous Prostate) | 0 | 6 | | 6.1 |
| 15940 | 817500 | _21, 22 (Normal Prostate vs. Cancerous Prostate) | 2 | 18 | | 9.15 |
| 15941 | 818180 | _21, 22 (Normal Prostate vs. Cancerous Prostate) | 2 | 10 | | 5.08 |
| 15946 | 429009 | _21, 22 (Normal Prostate vs. Cancerous Prostate) | 8 | 1 | 7.87 | |
| 15950 | 383021 | _21, 22 (Normal Prostate vs. Cancerous Prostate) | 3 | 12 | | 4.07 |
| 15955 | 831580 | _21, 22 (Normal Prostate vs. Cancerous Prostate) | 0 | 6 | | 6.1 |
| 15977 | 763446 | _21, 22 (Normal Prostate vs. Cancerous Prostate) | 11 | 1 | 10.82 | |
| 15978 | 763446 | _21, 22 (Normal Prostate vs. Cancerous Prostate) | 11 | 1 | 10.82 | |
| 15980 | 763446 | _21, 22 (Normal Prostate vs. Cancerous Prostate) | 11 | 1 | 10.82 | |
| 15981 | 10154 | _3, 4 (Breast, High Metastatic Potential vs. Breast, Low Metastatic) | 3 | 317 | | 108.1 |

Example 80

Differential Expression of a Polynucleotides Associated with Metastatic Potential in Breast Cancer Differential expression was examined in breast cancer cells having either high metastatic potential or low metastatic potential. A single cluster, Cluster Identification No. 10154, was identified as displaying low expression in the high metastatic potential breast cancer cells (Library 3), and significantly increased expression—approximately 100-fold higher—in the low metastatic potential cells (Library 4). Specifically, three clones were identified that were expressed in Library 3, the high metastatic potential breast cancer library, while 317 clones were expressed in Library 4, the low metastatic potential breast cancer library. The two sequences assigned to this particular cluster, SEQ ID NO:15981 and SEQ ID NO:15982, both displayed this differential expression, suggesting that the two sequences are likely associated with a single transcript.

Figure 1B:
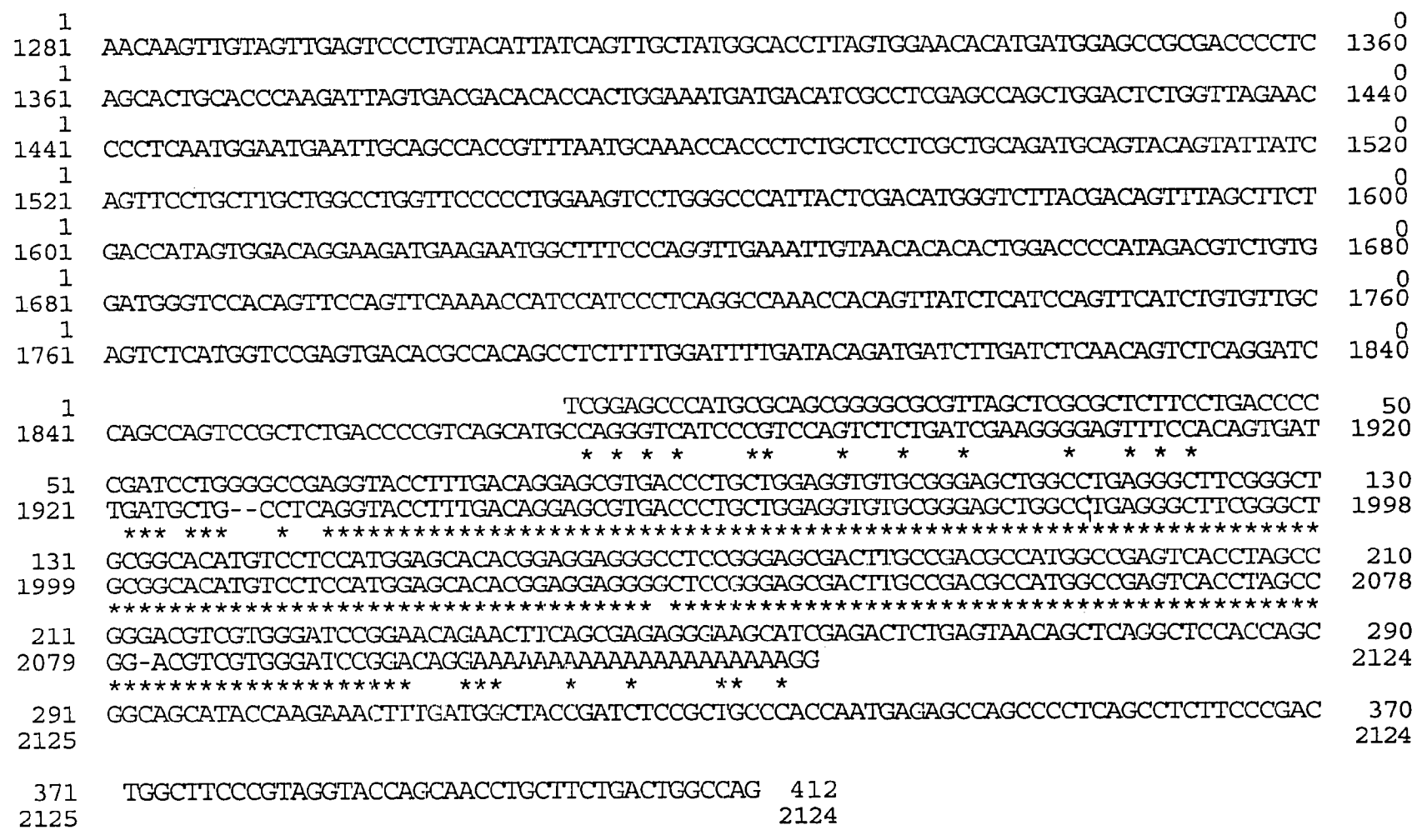

SEQ ID NO: 15981 and SEQ ID NO: 15982 were then used as query sequences to search for homologous sequences in GenBank as described above. SEQ ID NO: 15981 displayed identity to the GenBank entry H72034 (SEQ ID NO: 15983) and SEQ ID NO: 15982 displayed identity to GenBank entry AA707002 (SEQ ID NO: 15984). SEQ ID NO: 15981 displays striking identity to the 3' end of SEQ ID NO: 15983 (See FIGS. 1A and 1B), while SEQ ID NO: 15982 displays striking identity to the 5' end of SEQ ID NO: 15984 (See FIG. 2). Clones of H72034 and AA707002 were ordered from the I.M.A.G.E. Consortium at the Lawrence Livermore National Laboratories (Livermore, Calif.) for further studies.

Restriction Mapping of Clones H72034 and AA707002

The newly identified sequences were digested with a number of different restriction endonucleases to construct a restriction map of each of the clones. An appropriate amount of each clone, SEQ ID NO: 15983 or SEQ ID NO: 15984, was digested with various enzymes, and the restriction fragments identified as follows:

| Enzyme | #Cuts | Positions |
|---|---|---|
| SEQ ID NO: 15983 | | |
| AluI | 5 | 331 1029 1422 1595 1977 |
| BamHI | 2 | 1836 2089 |
| BstEII | 1 | 936 |
| BstXI | 1 | 1033 |
| HaeIII | 12 | 145 300 453 497 582 780 |
|  |  | 1102 1536 1561 1722 1981 2062 |
| HinfI | 12 | 5 154 205 325 397 473 610 820 |
|  |  | 968 1295 1426 2066 |
| KpnI | 1 | 1938 |
| MspI | 6 | 78 739 1098 2038 2077 2093 |
| NcoI | 2 | 2013 2058 |
| PstI | 1 | 1501 |
| PvuII | 2 | 331 1422 |
| Sau3AI | 6 | 1270 1813 1819 1836 1894 2089 |
| SphI | 1 | 1870 |
| XhoI | 1 | 1413 |
| SEQ ID NO: 15984 | | |
| AluI | 9 | 19 245 367 553 586 874 904 996 |
|  |  | 1214 |
| BamHI | 1 | 407 |
| BglI | 1 | 1056 |
| BglII | 1 | 475 |
| BstEI | 1 | 1108 |
| HaeIII | 10 | 153 348 485 867 518 628 780 867 |
|  |  | 915 1016 1312 |
| HindIII | 2 | 243 872 |
| HinfI | 1 | 1353 |
| KpnI | 1 | 132 |
| MspI | 2 | 1196 1261 |
| PstI | 1 | 823 |
| PvuII | 1 | 996 |
| Sau3AI | 7 | 66 407 475 504 750 850 1024 |

The restriction maps based on the identified sites can be used to determine the position of each clone relative to the genomic sequences, and to confirm the 5'-3' orientation of the clones.

Amplification and Purification of Transcript

A transcript in this region upregulated in low metastatic cancers which contain sequences from SEQ ID NOS: 15983-15986-318 is identified using a technique such as polymerase chain reaction (PCR) amplification. Based on the sequences identified and the original sequences of the cluster, primers can be designed to isolate the full length cDNA from a library constructed from the breast cancer cell line with low metastatic potential.

A cDNA template for use in the amplification reaction is generated from total RNA isolated from the high metastatic breast cell line. RNA is reverse transcribed using oligo-dT primer to generate first strand cDNA. cDNA is synthesized by denaturing 3:1 of total RNA, 2:1 oligo-dT primer at 20:M, and 5:1 DEPC water for 8 minutes at 65° C. followed by reverse transcription at 52° C. for 1 hour in a reaction containing the denatured RNA/primer plus 4:1 15×cDNA buffer (GibcoBRL), 1:1 0.1 M dithiothreitol, 1:1 40 U/l RNAseOUT (GibcoBRL), 1:1 DEPC water, 2:1 10 mM dNTP (Gibco-BRL), and 1:1 15 U/l Thermoscript reverse transcriptase (GibcoBRL). The reaction was terminated by a 5-min incubation at 85° C., and the RNA was removed by 1:1 2 U/l RNAse H at 37° C. for thirty minutes.

Based on the determined orientation of the clones, primers are designed to amplify a full-length clone corresponding to the differentially expressed transcript in this region. Forward primers that are used to amplify the full-length clone are taken from the 5' end of SEQ ID NO:15683 as follows:

F1  5'-TGGGATATAGTCTCGTGGTGCG-3'   (SEQ ID NO: 15985)

F2  5'-TGATTCGATGTCATCAGTCCCG-3'   (SEQ ID NO: 15986)

Primer F1 is taken from residues 51-62 of SEQ ID NO: 15983, and primer F2 is taken from residues 212-233 Of SEQ ID NO:15683. Both forward primers are near the 5' end of this sequence.

Reverse Primers are designed using sequences complementary to the 3' end of clone 10154-3 as follows:

R1    5'-TGTGTCACAGCCAGACATGAGC    (SEQ ID NO: 15987)

R2    5'-TGCAAACATACACAGGGACCG    (SEQ ID NO: 15988)

Primer R1 is based on residues 573-552 of SEQ ID NO:15684, and R2 is based on residues 399-379 of SEQ ID NO:15684.

PCR is performed using a 5:1 aliquot of the first strand cDNA synthesis reaction, and a primer pair, e.g., F1 and R1, F1 and R2, F2 and R1, or F2 and R2. An open reading frame is amplified using 2:1 of the reverse transcription product as template in a PCR reaction containing 5:1 of 10×PCR buffer (GibcoBRL), 1:150 mM $Mg_2SO_4$, 1:110 mM dNTP, 1:1 F1 or F2 primer, 1 μl R1 primer, 2.5 U High Fidelity Platinum Taq DNA polymerase (GibcoBRL), and water to 50:1. The molecule is amplified using 30 rounds of amplification in a thermal cycler at the following temperatures: 1 minute at 95° C.; 1 minute at 55° C. and 2 minutes at 72° C. The 30 cycles was followed by a 10 minute extension at 72° C.

Following amplification of the sequences, the PCR products are loaded on a 1% TEA gel and subjected to gel purification. One or more bands can be isolated from the gel and the DNA was purified using a QIAquick® Gel Extraction Kit (Qiagen, Valencia, Calif.). The purified fragment was cloned into a bacterial vector and transformed into the bacterial strain DH5∀. Following cloning of the purified fragment(s), the DNA can be isolated and sequenced to confirm that a band corresponds to a transcript from this genetic region.

The reactions are carried out with two different 5' and 3' primers to increase the likelihood that the reaction will yield an amplification product. Other primers may also be designed from the predicted 5' and/or 3' end of the sequence, as will be apparent to one skilled in the art upon reading this disclosure, and thus other primers may be designed from the general region of SEQ ID NOS:317 and 318 that may yield better results than the disclosed primers.

In order to obtain additional sequences 5' to the end of a partial cDNA, 5' rapid amplification of cDNA ends (RACE) can be performed to ensure that the entire transcript has been identified. See *PCR Protocols: A Guide to Methods and Applications*, (1990) Academic Press, Inc. Following isolation of a cDNA using the F1-R1 or F2-R1 primer pairs, additional primers can be designed to perform RACE. The primers can be designed from the sequence of 10154-1 as follows:

5'-TTTAGCAGCACTAATGACTGTGGC-3' (SEQ ID NO: 15989)

5'-CGCCGTGAATTACTGTGGATGG-3' (SEQ ID NO: 15990)

The two RACE primers are designed based residues 286-263 and 396-375 of SEQ ID NO:15983, respectively.

These sequences can be used to obtain any transcript sequences 5' to the amplification products obtained using the PCR protocol described above.

Northern Analysis

Other techniques can be used for confirming differential expression of the full-length transcript. For example, a Northern Blot can be used to verify differential expression of SEQ ID NOS:15983 and 15984 in a breast cancer cells with low metastatic potential compared to breast cancer cells with high metastatic potential. Northern analysis can be accomplished by methods well-known in the art. Briefly, RNA is individually isolated from breast cancer cells having high metastatic potential and breast cancer cells having low metastatic potential, e.g., a product such as RNeasy Mini Kits (Qiagen, CA) or NucleoSpin® RNA II Kit (Clontech, Palo Alto, Calif.). The isolated RNA samples are For Northern analysis, RNA isolated from the cells was electrophoresed on a denaturing formaldehyde agarose gel and transferred onto a membrane such as a supported nitrocellulose membrane (Schleicher & Schuell).

Rapid-Hyb buffer (Amersham Life Science, Little Chalfont, England) with 5 mg/ml denatured single stranded sperm DNA is pre-warmed to 65° C. and the RNA blots are pre-hybridized in the buffer with shaking at 65° C. for 30 minutes. Gene-specific DNA probes (50 ng per reaction) labeled with [$\alpha$-$^{32}$P]dCTP (3000 Ci/mmol, Amersham Pharmacia Biotech Inc., Piscataway, N.J.) (Prime-It RmT Kit, Stratagene, La Jolla, Calif.) and purified with ProbeQuant™ G-50 Micro Columns (Amersham Pharmacia Biotech Inc.) are added and hybridized to the blots with shaking at 65° C. for overnight. The blots are washed in 2×SSC, 0.1%(w/v) SDS at room temperature for 20 minutes, twice in 1×SSC, 0.1%(w/v) SDS at 65° C. for 15 minutes, then exposed to Hyperfilms (Amersham Life Science).

Example 81

Identification of Differentially Expressed Genes by Array Analysis with Patient Tissue Samples Differentially expressed genes corresponding to the polynucleotides described herein were also identified by microarray hybridization analysis using materials obtained from patient tissue samples. The biological materials used in these experiments are described below.

Source of Patient Tissue Samples

Normal and cancerous tissues were collected from patients using laser capture microdissection (LCM) techniques, which techniques are well known in the art (see, e.g., Ohyama et al. (2000) *Biotechniques* 29:530-6; Curran et al. (2000) *Mol. Pathol.* 53:64-8; Suarez-Quian et al. (1999) *Biotechniques* 26:328-35; Simone et al. (1998) *Trends Genet* 14:272-6; Conia et al. (1997) *J. Clin. Lab. Anal.* 11:28-38; Emmert-Buck et al. (1996) *Science* 274:998-1001). Table 127 (inserted following the last page of the Examples) provides information about each patient from which the samples were isolated, including: the Patient ID and Path ReportID, numbers assigned to the patient and the pathology reports for identification purposes; the anatomical location of the tumor (AnatomicalLoc); The Primary Tumor Size; the Primary Tumor Grade; the Histopathologic Grade; a description of local sites to which the tumor had invaded (Local Invasion); the presence of lymph node metastases (Lymph Node Metastasis); incidence of lymph node metastases (provided as number of lymph nodes positive for metastasis over the number of lymph nodes examined) (Incidence Lymphnode Metastasis); the Regional Lymphnode Grade; the identification or detection of metastases to sites distant to the tumor and their location (Distant Met & Loc); a description of the distant metastases (Description Distant Met); the grade of distant metastasis (Distant Met Grade); and general comments about the patient or the tumor (Comments). Adenoma was not described in any of the patients; adenoma dysplasia (described as hyperplasia by the pathologist) was described in Patient ID No. 695. Extranodal extensions were described in two patients, Patient ID Nos. 784 and 791. Lymphovascular invasion was described in seven patients, Patient ID Nos. 128, 278, 517, 534, 784, 786, and 791. Crohn's-like infiltrates were described in seven patients, Patient ID Nos. 52, 264, 268, 392, 393, 784, and 791.

Source of Polynucleotides on Arrays

Polynucleotides on Arrays

Polynucleotides spotted on the arrays were generated by PCR amplification of clones derived from cDNA libraries. The clones used for amplification were either the clones from which the sequences described herein were derived, or are clones having inserts with significant polynucleotide sequence overlap with the sequences described herein (SEQ ID NO:15667-15982) as determined by BLAST2 homology searching.

Microarray Design

Each array used in the examples below had an identical spatial layout and control spot set. Each microarray was divided into two areas, each area having an array with, on each half, twelve groupings of 32×12 spots for a total of about 9,216 spots on each array. The two areas are spotted identically which provide for at least two duplicates of each clone per array. Spotting was accomplished using PCR amplified products from 0.5 kb to 2.0 kb and spotted using a Molecular Dynamics Gen III spotter according to the manufacturer's recommendations. The first row of each of the 24 regions on the array had about 32 control spots, including 4 negative control spots and 8 test polynucleotides.

The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about 4 duplicate measurements for each clone, two of one color and two of the other, for each sample.

Microarray Analysis cDNA probes were prepared from total RNA isolated from the patient cells described in above (Table 127). Since LCM provides for the isolation of specific cell types to provide a substantially homogenous cell sample, this provided for a similarly pure RNA sample.

Total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) *Nature Med* 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling. Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from normal cell RNA sample. For example, the cDNA probes from the normal cells were labeled with Cy3 fluorescent dye (green) and the cDNA probes prepared from the tumor cells were labeled with Cy5 fluorescent dye (red).

The differential expression assay was performed by mixing equal amounts of probes from tumor cells and normal cells of the same patient. The arrays were prehybridized by incubation for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction). The level fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. For initial analysis of the microarrays, the hypothesis was accepted if $p>10^{-3}$, and the differential ratio was set to 1.000 for those spots. All other spots have a significant difference in expression between the tumor and normal sample. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level ($p>0.05$).

Table 128 below summarize the results of the differential expression analysis. Each table provides: the SEQ ID NO of the polynucleotide corresponding to the polynucleotide on the spot on the array; the Spot ID (an identifier assigned to the spot so as to distinguish it from spots on the same and different arrays), the number of patients for whom there was information obtained from the array (Num Ratios), and the percentage of patients in which expression was detected at greater than or equal to a two-fold increase (>=2x), greater than or equal to a five-fold increase (>=5x), or less than or equal to a ½-fold decrease (<=halfx) relative to matched normal control tissue.

In general, a polynucleotide is said to represent a significantly differentially expressed gene between two samples when there is detectable levels of expression in at least one sample and the ratio value is greater than at least about 1.2 fold, preferably greater than at least about 1.5 fold, more preferably greater than at least about 2 fold, where the ratio value is calculated using the method described above.

A differential expression ratio of 1 indicates that the expression level of the gene in the tumor cell was not statistically different from expression of that gene in normal colon cells of the same patient. A differential expression ratio significantly greater than 1 in cancerous colon cells relative to normal colon cells indicates that the gene is increased in expression in cancerous cells relative to normal cells, indicating that the gene plays a role in the development of the cancerous phenotype, and may be involved in promoting metastasis of the cell. Detection of gene products from such genes can provide an indicator that the cell is cancerous, and may provide a therapeutic and/or diagnostic target.

Likewise, a differential expression ratio significantly less than 1 in cancerous colon cells relative to normal colon cells indicates that, for example, the gene is involved in suppression of the cancerous phenotype. Increasing activity of the gene product encoded by such a gene, or replacing such activity, can provide the basis for chemotherapy. Such gene can also serve as markers of cancerous cells, e.g., the absence or decreased presence of the gene product in a colon cell relative to a normal colon cell indicates that the cell may be cancerous.

TABLE 128

| SEQ ID NO: | SpotID | Num Ratios | >=2x | >=5x | <=halfx |
|---|---|---|---|---|---|
| 15674 | 579 | 33 | 87.88 | 39.39 | 3.03 |
| 15678 | 22300 | 33 | 33.33 | 18.18 | 6.06 |
| 15692 | 21886 | 33 | 33.33 | 0.00 | 3.03 |
| 15730 | 9487 | 33 | 33.33 | 12.12 | 3.03 |
| 15914 | 28179 | 28 | 32.14 | 0.00 | 0.00 |
| 15919 | 28179 | 28 | 32.14 | 0.00 | 0.00 |
| 15938 | 28179 | 28 | 32.14 | 0.00 | 0.00 |
| 15958 | 9111 | 33 | 33.33 | 18.18 | 3.03 |
| 15961 | 19980 | 33 | 33.33 | 6.06 | 0.00 |
| 15975 | 23993 | 33 | 42.42 | 3.03 | 3.03 |

Deposit Information. The following materials were deposited with the American Type Culture Collection (CMCC=Chiron Master Culture Collection).

TABLE 124

Cell Lines Deposited with ATCC

| Cell Line | Deposit Date | ATCC Accession No. | CMCC Accession No. |
|---|---|---|---|
| KM12L4-A | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

In addition, pools of selected clones, as well as libraries containing specific clones, were assigned an "ES" number (internal reference) and deposited with the ATCC. Table 6 below provides the ATCC Accession Nos. of the ES deposits, all of which were deposited on or before May 13, 1999. The names of the clones contained within each of these deposits are provided in the Table 126 (inserted before the claims).

TABLE 125

Pools of Clones and Libraries Deposited with ATCC on or before Mar. 28, 2000

| Cell Line | CMCC | ATCC |
|---|---|---|
| ES75 | 5140 | PTA-1102 |
| ES76 | 5141 | PTA-1103 |
| ES77 | 5142 | PTA-1104 |
| ES78 | 5143 | PTA-1105 |
| ES79 | 5144 | PTA-1106 |
| ES80 | 5145 | PTA-1107 |
| ES81 | 5146 | PTA-1108 |
| ES82 | 5147 | PTA-1109 |
| ES83 | 5148 | PTA-1110 |
| ES84 | 5149 | PTA-1111 |

TABLE 126

| Library No. | Clones | |
|---|---|---|
| es75 | M00063947D:D01 | |
| | M00063158A:A01 | |
| | M00063517A:A04 | |
| | M00063520D:E11 | |
| | M00063638C:G12 | |
| | M00063642B:A08 | |
| | M00063686B:E07 | |
| | M00063689D:E12 | |
| | M00063781B:B10 | |
| | M00063826A:D03 | |
| es76 | M00063838B:G08 | |
| | M00063838B:G08 | |
| | M00063841A:B09 | |
| | M00063886A:B06 | |
| | M00063910D:A12 | |
| | M00063912A:D06 | |
| | M00063920D:H05 | |
| | M00063928A:G09 | |
| | M00063934B:E04 | |
| | M00063945A:C03 | |
| es77 | M00064032D:G04 | |
| | M00064046A:G02 | |
| | M00064053C:G04 | |
| | M00064053D:F02 | |
| | M00064082A:A08 | |
| | M00064089B:F09 | |
| | M00064132B:B07 | |
| | M00064138A:F11 | |
| | M00064161B:G04 | |
| | M00064175B:B09 | |
| es78 | M00064178C:C04 | |
| | M00064179A:C04 | |
| | M00064200D:E08 | |
| | M00064248A:E02 | |

TABLE 126-continued

| Library No. | Clones | |
|---|---|---|
| | M00064270B:B03 | |
| | M00064271B:D03 | |
| | M00063580C:A06 | |
| | M00063594B:H07 | |
| | M00064002C:F06 | |
| | M00064002C:H09 | |
| es79 | M00064003B:C10 | |
| | M00064302A:D10 | |
| | M00064309C:H09 | |
| | M00064310D:F03 | |
| | M00064322C:A10 | |
| | M00064359B:H12 | |
| | M00064390A:C05 | |
| | M00064404A:B05 | |
| | M00064404C:G05 | |
| | M00064404D:A06 | |
| es80 | M00064429D:B07 | |
| | M00064446A:D11 | |
| | M00064457D:C09 | |
| | M00064476D:C04 | |
| | M00064506A:C07 | |
| | M00064514A:G10 | |
| | M00064520A:F08 | |
| | M00064579D:E11 | |
| | M00064620C:D01 | |
| | M00064624D:C09 | |
| es81 | M00064633C:A03 | |
| | M00064637B:F03 | |
| | M00064690A:C04 | |
| | M00064690A:C04 | |
| | M00064714A:G03 | |
| | M00064723D:H11 | |
| | GKC10154-1 | |
| | GKC10154-3 | |
| es82 | M00063151A:G06 | M00063852D:F07 |
| | M00063151D:B10 | M00063888D:D05 |
| | M00063152C:B07 | M00063888D:F02 |
| | M00063156D:H10 | M00063890A:F11 |
| | M00063158A:E11 | M00063890A:H04 |
| | M00063158A:E11 | M00063891A:F11 |
| | M00063452A:F08 | M00063892B:G02 |
| | M00063453B:F08 | M00063898A:A10 |
| | M00063462D:D07 | M00063915C:E01 |
| | M00063463D:B05 | M00063919C:E07 |
| | M00063466C:C11 | M00063920D:H02 |
| | M00063467D:H07 | M00063922B:A12 |
| | M00063478C:D01 | M00063925B:F04 |
| | M00063482A:A08 | M00063926A:H04 |
| | M00063482A:F07 | M00063931B:E10 |
| | M00063485A:E05 | M00063931B:F07 |
| | M00063487C:C02 | M00063932D:G08 |
| | M00063514C:D03 | M00063934C:C10 |
| | M00063514C:E08 | M00063938B:H07 |
| | M00063515B:F06 | M00063939C:D06 |
| | M00063515B:H02 | M00063939C:H01 |
| | M00063518D:A01 | M00063940D:F09 |
| | M00063520D:D08 | M00063940D:F09 |
| | M00063604A:B11 | M00063941B:C12 |
| | M00063606C:B04 | M00063943B:G12 |
| | M00063610D:C11 | M00063949D:A05 |
| | M00063613D:C11 | M00064021D:H01 |
| | M00063617D:F09 | M00064025D:E07 |
| | M00063627C:F06 | M00064025D:H12 |
| | M00063636A:E01 | M00064033C:C11 |
| | M00063681B:C02 | M00064033D:B01 |
| | M00063682A:C04 | M00063843B:D07 |
| | M00063685A:C02 | M00063848C:G11 |
| | M00063774A:D09 | M00063852B:D08 |
| | M00063784A:H12 | M00063818C:A09 |
| | M00063784C:E10 | M00063828A:H12 |
| | M00063785C:F03 | M00063828D:E05 |
| | M00063795C:D09 | M00063839A:F01 |
| | M00063801B:D04 | M00063841A:E08 |
| | M00063804C:A11 | |
| | M00063805D:E05 | |
| | M00063807A:D12 | |
| | M00063810C:E03 | |
| es83 | M00064043D:C09 | M00063577C:C02 |
| | M00064048C:G12 | M00063578B:E02 |
| | M00064053B:D09 | M00063578C:A06 |

TABLE 126-continued

| | | | |
|---|---|---|---|
| | M00064057C:H10 | M00063580D:B06 | |
| | M00064059A:C11 | M00063593A:D03 | |
| | M00064060B:D03 | M00063600C:C09 | |
| | M00064079C:A10 | M00063955C:F07 | |
| | M00064082D:D10 | M00063955D:F05 | |
| | M00064083D:E05 | M00063956A:F05 | |
| | M00064086C:E01 | M00063957A:E02 | |
| | M00064090C:A02 | M00063957A:E02 | |
| | M00064090D:D09 | M00063967C:A12 | |
| | M00064105B:A03 | M00063967D:G02 | |
| | M00064106C:G03 | M00063968D:G08 | |
| | M00064113B:C04 | M00063972C:E10 | |
| | M00064115B:E12 | M00063978B:B06 | |
| | M00064119B:H10 | M00063981D:A06 | |
| | M00064119C:D12 | M00063990A:D05 | |
| | M00064122C:B06 | M00063990A:D05 | |
| | M00064126C:C02 | M00063997C:B12 | |
| | M00064126C:F12 | M00063998C:E09 | |
| | M00064136C:D12 | M00064000B:C03 | |
| | M00064144D:A07 | M00064001A:B03 | |
| | M00064151B:C07 | M00064005D:A08 | |
| | M00064159A:H03 | M00064008A:B01 | |
| | M00064165A:B12 | M00064009A:C01 | |
| | M00064171D:E05 | M00064014D:H05 | |
| | M00064171D:E05 | M00064018C:E07 | |
| | M00064172C:A02 | M00064293D:B12 | |
| | M00064173B:E01 | M00064294D:F01 | |
| | M00064176D:H10 | M00063557D:C07 | |
| | M00064178B:A05 | M00063559D:G03 | |
| | M00064178B:A05 | M00063571B:G03 | |
| | M00064180A:G03 | M00063575B:G02 | |
| | M00064186C:B03 | M00063555B:D01 | |
| | M00064188B:G08 | M00063533A:C12 | |
| | M00064194C:D02 | M00063534C:A02 | |
| | M00064212D:E04 | M00063538D:B01 | |
| | M00064260C:E05 | M00063539C:C11 | |
| | M00064268D:G03 | | |
| | M00064272C:G01 | | |
| | M00063163A:G04 | | |
| | M00063165A:C09 | | |
| es84 | M00064307B:G02 | M00064564A:C02 | |
| | M00064307C:G03 | M00064568A:H06 | |

TABLE 126-continued

| | |
|---|---|
| M00064310C:A10 | M00064569B:A09 |
| M00064328B:H04 | M00064569B:A09 |
| M00064328B:H09 | M00064571C:C04 |
| M00064337D:F01 | M0064577C:B120 |
| M00064341A:C02 | M00064579A:C06 |
| M00064345A:A03 | M00064593A:A05 |
| M00064346C:B09 | M00064593D:C01 |
| M00064349D:H01 | M00064601C:G07 |
| M00064352C:H01 | M00064601D:B05 |
| M00064354A:A10 | M00064605C:G05 |
| M00064358A:G03 | M00064610D:H01 |
| M00064358C:D09 | M00064620D:G05 |
| M00064375B:G07 | M00064624C:B03 |
| M00064376A:A05 | M00064631A:C07 |
| M00064385D:C11 | M00064631A:C07 |
| M00064386B:C02 | M00064631C:H11 |
| M00064386B:C02 | M00064636B:A04 |
| M00064393B:H04 | M00064649A:E04 |
| M00064399A:E01 | M00064650B:B07 |
| M00064405B:C04 | M00064652B:D09 |
| M00064406B:H06 | M00064675C:E09 |
| M00064414D:D06 | M00064678D:F05 |
| M00064415B:G03 | M00064693D:F08 |
| M00064424B:C12 | M00064723C:H04 |
| M00064428B:A12 | M00064723D:H03 |
| M00064447B:A07 | M00064723D:H03 |
| M00064447B:C06 | M00003773D:H02 |
| M00064450C:E07 | M00021929A:D03 |
| M00064452D:E11 | M00043134A:A05 |
| M00064454A:H10 | M00064534D:F06 |
| M00064454C:B06 | M00064550A:A07 |
| M00064460C:B01 | M00064554D:A03 |
| M00064467B:D06 | M00064526D:F05 |
| M00064481C:F03 | M00064527A:H07 |
| M00064508A:B09 | M00064530B:H02 |
| M00064514D:F11 | M00064532D:G06 |
| M00064517B:F04 | M00064520A:E04 |
| M00064517B:F10 | M00064520A:E04 |
| M00064517C:F11 | M00064524A:A09 |

TABLE 127

| Table 8 Patient ID | Path Report ID | Anatomical Loc | Primary Tumor Size | Primary Tumor Grade | Histo Path Grade | Local Invasion | Lymphnode Met | Incidence Lymphnode Met | Regional Lymphnode Grade | Distant Met & Loc | Descrip Distant Met | Dist Met Grade | Comment |
|---|---|---|---|---|---|---|---|---|---|---|---|---|---|
| 15 | 21 | Ascending colon | 4.0 | T3 | G2 | extending into subserosal adipose tissue | positive | 3/8 | N1 | negative | | MX | invasive adenocarcinoma, moderately differentiated; focal perineural invasion is seen |
| 52 | 71 | Ascending colon | 9.0 | T3 | G3 | Invasion through muscularis propria, subserosal involvement; ileocec. valve involvement | negative | 0/12 | N0 | negative | | M0 | Hyper plastic polyp in appendix. |
| 121 | 140 | sigmoid | 6 | T4 | G2 | Invasion of muscularis propria into serosa, involving submucosa of urinary bladder | negative | 0/34 | N0 | negative | | M0 | Perineural invasion; donut anastomosis negative. One tubulo villous and one tubular adenoma with no high grade dysplasia. |
| 125 | 144 | Cecum | 6 | T3 | G2 | Invasion through the muscularis propria into suserosal adipose tissue. Ileocecal junction. | negative | 0/19 | N0 | neagative | | M0 | patient history of metastatic melanoma |

TABLE 127-continued

| Table 8 Patient ID | Path Report ID | Anatomical Loc | Primary Tumor Size | Primary Tumor Grade | Histo Path Grade | Local Invasion | Lymphnode Met | Incidence Lymphnode Met | Regional Lymphnode Grade | Distant Met & Loc | Descrip Distant Met | Dist Met Grade | Comment |
|---|---|---|---|---|---|---|---|---|---|---|---|---|---|
| 128 | 147 | Transverse colon | 5.0 | T3 | G2 | Invasion of muscularis propria into percolonic fat | positive | 1/5 | N1 | negative | | M0 | |
| 130 | 149 | Splenic flexure | 5.5 | T3 | | through wall and into surrounding adipose tissue | positive | 10/24 | N2 | negative | | M1 | |
| 133 | 152 | Rectum | 5.0 | T3 | G2 | Invasion through muscularis propria into non-peritonealized pericolic tissue; gross configuration is annular. | negative | 0/9 | N0 | negative | | M0 | Small separate tubular adenoma (0.4 cm) |
| 141 | 160 | Cecum | 5.5 | T3 | G2 | Invasion of muscularis propria into pericolonic adipose tissue, but not through serosa. Arising from tubular adenoma. | positive | 7/21 | N2 | positive (Liver) | adenocarcinoma consistant with primary | M1 | Perineural invasion identified adjacent to metastatic adenocarcinoma. |
| 156 | 175 | Hepatic flexure | 3.8 | T3 | G2 | Invasion through muscularis propria into subserosa/pericolic adipose, no serosal involvement. | positive | 2/13 | N1 | negative | | M0 | Separate tubolo villous and tubular adenomas |

TABLE 127-continued

| Table 8 Patient ID | Path Report ID | Anatomical Loc | Primary Tumor Size | Primary Tumor Grade | Histo Path Grade | Local Invasion | Lymphnode Met | Incidence Lymphnode Met | Regional Lymphnode Grade | Distant Met & Loc | Descrip Distant Met | Dist Met Grade | Comment |
|---|---|---|---|---|---|---|---|---|---|---|---|---|---|
| | | | | | | Gross configuration annular. | | | | | | | |
| 228 | 247 | Rectum | 5.8 | T3 | G2 to G3 | Invasion through muscularis propria to involve subserosal, perirectoal adipose, and serosa | positive | 1/8 | N1 | negative | | MX | Hyper plastic polyps |
| 264 | 283 | Ascending colon | 5.5 | T3 | G2 | Invasion through muscularis propria into subserosal adipose tissue. | negative | 0/10 | N0 | negative | | M0 | Tubul ovillous adenoma with high grade dysplasia |
| 266 | 285 | Transverse colon | 9 | T3 | G2 | Invades through muscularis propria to involve pericolonic adipose, extends to serosa. | negative | 0/15 | N1 | positive (Mesenteric deposit) | 0.4 cm, may represent lymphnode completely replaced by tumor | MX | |
| 268 | 287 | Cecum | 6.5 | T2 | G2 | Invades full thickness of muscularis propria, but mesenteric adipose free of malignancy | negative | 0/12 | N0 | negative | | M0 | |
| 278 | 297 | Rectum | 4 | T3 | G2 | Invasion into perirectal adipose tissue. | positive | 7/10 | N2 | negative | | M0 | Descending colon polyps, no HGD or carcinoma identified.. |

TABLE 127-continued

| Table 8 Patient ID | Path Report ID | Anatomical Loc | Primary Tumor Size | Primary Tumor Grade | Histo Path Grade | Local Invasion | Lymphnode Met | Incidence Lymphnode Met | Regional Lymphnode Grade | Distant Met & Loc | Descrip Distant Met | Dist Met Grade | Comment |
|---|---|---|---|---|---|---|---|---|---|---|---|---|---|
| 295 | 314 | Ascending colon | 5.0 | T3 | G2 | Invasion through muscularis propria into pericolic adipose tissue. | negative | 0/12 | N0 | negative | | M0 | Melanosis coli and diverticular disease. |
| 339 | 358 | Restosigmoid | 6 | T3 | G2 | Extends into perirectal fat but does not reach serosa | negative | 0/6 | N0 | negative | | M0 | 1 hyperplastic polyp identified |
| 341 | 360 | Ascending colon | 2 cm invasive | T3 | G2 | Invasion through muscularis propria to involve pericolonic fat. Arising from villous adenoma. | negative | 0/4 | N0 | negative | | MX | |
| 356 | 375 | Sigmoid | 6.5 | T3 | G2 | Through colon wall into subserosal adipose tissue. No serosal spread seen. | negative | 0/4 | N0 | negative | | M0 | |
| 360 | 412 | Ascending colon | 4.3 | T3 | G2 | Invasion thru muscularis propria to pericolonic fat | positive | 1/5 | N1 | negative | | M0 | Two mucosal polyps |
| 392 | 444 | Ascending colon | 2 | T3 | G2 | Invasion through muscularis propria into | positive | 1/6 | N1 | positive (Liver) | Macro vesicular and microvesicular | M1 | Tumor arising at prior |

TABLE 127-continued

| Table 8 Patient ID | Path Report ID | Anatomical Loc | Primary Tumor Size | Primary Tumor Grade | Histo Path Grade | Local Invasion | Lymphnode Met | Incidence Lymphnode Met | Regional Lymphnode Grade | Distant Met & Loc | Descrip Distant Met | Dist Met Grade | Comment |
|---|---|---|---|---|---|---|---|---|---|---|---|---|---|
| | | | | | | subserosal adipose tissue, not serosa. | | | | | steatosis | | ileocolic surgical anastomosis. |
| 393 | 445 | Cecum | 6.0 | T3 | G2 | Cecum, invades through muscularis propria to involve subserosal adipose tissue but not serosa. | negative | 0/21 | N0 | Negative | | M0 | |
| 413 | 465 | Ascending colon | 4.8 | T3 | G2 | Invasive through muscularis to involve periserosal fat; abutting ileocecal junction. | negative | 0/7 | N0 | positive (Liver) | adenocarcinoma in multiple slides | M1 | rediagnosis of oophorectomy path to metastatic colon cancer. |
| 505 | 383 | | 7.5cm max dim | T3 | G2 | Invasion through muscularis propria involving pericolic adipose, serosal surface uninvolved | positive | 2/17 | N1 | positive (Liver) | moderately differentiated adenocarcinoma, consistant with primar | M1 | Anatomical location of report. Evidence of chronic colitis. |
| 517 | 395 | Sigmoid | 3 | T3 | G2 | penetrates muscularis propria, involves pericolonic fat. | positive | 6/6 | N2 | negative | | M0 | No mention of distant met in report |
| 534 | 553 | Ascending colon | 12 | T3 | G3 | Invasion through the muscularis propria involving | negative | 0/8 | N0 | negative | | M0 | Omentum with fibrosis and fat |

TABLE 127-continued

| Table 8 Patient ID | Path Report ID | Anatomical Loc | Primary Tumor Size | Primary Tumor Grade | Histo Path Grade | Local Invasion | Lymphnode Met | Incidence Lymphnode Met | Regional Lymphnode Grade | Distant Met & Loc | Descrip Distant Met | Dist Met Grade | Comment |
|---|---|---|---|---|---|---|---|---|---|---|---|---|---|
| | | | | | | pericolic fat. Serosa free of tumor. | | | | | | | necrosis. Small bowel with acute and chronic serositis, focal abscess and adhesion. |
| 546 | 565 | Ascending colon | 5.5 | T3 | G2 | Invasion through muscularis propria extensively through submucosal and extending to serosa. | positive | 6/12 | N2 | positive (Liver) | metastatic adenocarcinoma | M1 | |
| 577 | 596 | Cecum | 11.5 | T3 | G2 | Invasion through the bowel wall, into suberosal adipose. Serosal surface free of tumor. | negative | 0/58 | N0 | negative | | M0 | Appendix dilated and fibrotic, but not involved by tumor |
| 695 | 714 | Cecum | 14 | T3 | G2 | extending through bowel wall into serosalfat | negative | 0/22 | N0 | negative | | MX | tubular adenoma and hyperplstic polypspresent, moderately differentiated adenoma with mucinous diferentiation (% not stated) |
| 784 | 803 | Ascending colon | 3.5 | T3 | G3 | through muscularis propria into pericolic | positive | 5/17 | N2 | positive (Liver) | | M1 | invasive poorly differentiated adenosquamous |

TABLE 127-continued

| Table 8 Patient ID | Path Report ID | Anatomical Loc | Primary Tumor Size | Primary Tumor Grade | Histo Path Grade | Local Invasion | Lymphnode Met | Incidence Lymphnode Met | Regional Lymphnode Grade | Distant Met & Loc | Descrip Distant Met | Dist Met Grade | Comment |
|---|---|---|---|---|---|---|---|---|---|---|---|---|---|
| 786 | 805 | Descending colon | 9.5 | T3 | G2 | soft tissues through muscularis propria into pericolic fat, but not at serosal surface | negative | 0/12 | N0 | positive (Liver) | | M1 | carcinoma moderately differentiated invasive adenocarcinoma |
| 791 | 810 | Ascending colon | 5.8 | T3 | G3 | through the muscularis propria into pericolic fat | positive | 13/25 | N2 | positive (Liver) | | M1 | poorly differentiated invasive colonic adenocarcinoma |
| 888 | 908 | Ascending colon | 2.0 | T2 | G1 | into muscularis propria | positive | 3/21 | N0 | positive (Liver) | | M1 | well- to moderately- differentiated adenocarcinoma; this patient has tumors of the ascending colon and the sigmoid colon |
| 889 | 909 | Cecum | 4.8 | T3 | G2 | through muscularis propria int subserosal tissue | positive | 1/4 | N1 | positive (Liver) | | M1 | moderately differentiated adenocarcinoma |

The deposits described herein are provided merely as convenience to those of skill in the art, and is not an admission that a deposit is required under 35 U.S.C. §112. The sequence of the polynucleotides contained within the deposited material, as well as the amino acid sequence of the polypeptides encoded thereby, are incorporated herein by reference and are controlling in the event of any conflict with the written description of sequences herein. A license may be required to make, use, or sell the deposited material, and no such license is granted hereby.

Retrieval of Individual Clones from Deposit of Pooled Clones. Where the ATCC deposit is composed of a pool of cDNA clones or a library of cDNA clones, the deposit was prepared by first transfecting each of the clones into separate bacterial cells. The clones in the pool or library were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

Those skilled in the art will recognize, or be able to ascertain, using not more than routine experimentation, many equivalents to the specific embodiments of the invention described herein. Such specific embodiments and equivalents are intended to be encompassed by the following claims.

Example 82

Source of Biological Materials and Overview of Novel Polynucleotides Expressed by the Biological Materials Candidate polynucleotides that may represent novel polynucleotides were obtained from cDNA libraries generated from selected cell lines and patient tissues. In order to obtain the candidate polynucleotides, mRNA was isolated from several selected cell lines and patient tissues, and used to construct cDNA libraries. The cells and tissues that served as sources for these cDNA libraries are summarized in Table 129 below.

Human colon cancer cell line Km12L4-A (Morikawa, et al., Cancer Research (1988) 48:6863) is derived from the KM12C cell line. The KM12C cell line (Morikawa et al. Cancer Res. (1988) 48:1943-1948), which is poorly metastatic (low metastatic) was established in culture from a Dukes' stage B2 surgical specimen (Morikawa et al. Cancer Res. (1988) 48:6863). The KM12L4-A is a highly metastatic subline derived from KM12C (Yeatman et al. Nucl. Acids. Res. (1995) 23:4007; Bao-Ling et al. Proc. Annu. Meet. Am. Assoc. Cancer. Res. (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. Clin. Cancer Res. (1995) 1:19; Yeatman et al., (1995) supra; Yeatman et al. Clin. Exp. Metastasis (1996) 14:246).

The MDA-MB-231 cell line (Brinkley et al. Cancer Res. (1980) 40:3118-3129) was originally isolated from pleural effusions (Cailleau, J. Natl. Cancer. Inst. (1974) 53:661), is of high metastatic potential, and forms poorly differentiated adenocarcinoma grade II in nude mice consistent with breast carcinoma. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., Cancer Res. (1979) 39:870 (MDA-MB-231 and MCF-7); Gastpar et al., J Med Chem (1998) 41:4965 (MDA-MB-231 and MCF-7); Ranson et al., Br J Cancer (1998) 77:1586 (MDA-MB-231 and MCF-7); Kuang et al., Nucleic Acids Res (1998) 26:1116 (MDA-MB-231 and MCF-7); Varki et al., Int J Cancer (1987) 40:46 (UCP-3); Varki et al., Tumour Biol. (1990) 11:327; (MV-522 and UCP-3); Varki et al., Anticancer Res. (1990) 10:637; (MV-522); Kelner et al., Anticancer Res (1995) 15:867 (MV-522); and Zhang et al., Anticancer Drugs (1997) 8:696 (MV522)).

The samples of libraries 15-20 are derived from two different patients (UC#2, and UC#3). The bFGF-treated HMVEC were prepared by incubation with bFGF at 10 ng/ml for 2 hrs; the VEGF-treated HMVEC were prepared by incubation with 20 ng/ml VEGF for 2 hrs. Following incubation with the respective growth factor, the cells were washed and lysis buffer added for RNA preparation. The GRRpz and WOca cell lines were provided by Dr. Donna M. Peehl, Department of Medicine, Stanford University School of Medicine. GRRpz was derived from normal prostate epithelium. The WOca cell line is a Gleason Grade 4 cell line.

TABLE 129

Description of cDNA Libraries

| Library (lib #) | Description | Number of Clones in Library |
|---|---|---|
| 0 | Artificial library composed of deselected clones (clones with no associated variant or cluster) | 673 |
| 1 | Human Colon Cell Line Km12 L4: High Metastatic Potential (derived from Km12C) | 308731 |
| 2 | Human Colon Cell Line Km12C: Low Metastatic Potential | 284771 |
| 3 | Human Breast Cancer Cell Line MDA-MB-231: High Metastatic Potential; micro-mets in lung | 326937 |

TABLE 129-continued

Description of cDNA Libraries

| Library (lib #) | Description | Number of Clones in Library |
|---|---|---|
| 4 | Human Breast Cancer Cell Line MCF7: Non Metastatic | 318979 |
| 8 | Human Lung Cancer Cell Line MV-522: High Metastatic Potential | 223620 |
| 9 | Human Lung Cancer Cell Line UCP-3: Low Metastatic Potential | 312503 |
| 12 | Human microvascular endothelial cells (HMEC) - UNTREATED (PCR (OligodT) cDNA library) | 41938 |
| 13 | Human microvascular endothelial cells (HMEC) - bFGF TREATED (PCR (OligodT) cDNA library) | 42100 |
| 14 | Human microvascular endothelial cells (HMEC) - VEGF TREATED (PCR (OligodT) cDNA library) | 42825 |
| 15 | Normal Colon - UC#2 Patient (MICRODISSECTED PCR (OligodT) cDNA library) | 282722 |
| 16 | Colon Tumor - UC#2 Patient (MICRODISSECTED PCR (OligodT) cDNA library) | 298831 |
| 17 | Liver Metastasis from Colon Tumor of UC#2 Patient (MICRODISSECTED PCR (OligodT) cDNA library) | 303467 |
| 18 | Normal Colon - UC#3 Patient (MICRODISSECTED PCR (OligodT) cDNA library) | 36216 |
| 19 | Colon Tumor - UC#3 Patient (MICRODISSECTED PCR (OligodT) cDNA library) | 41388 |
| 20 | Liver Metastasis from Colon Tumor of UC#3 Patient (MICRODISSECTED PCR (OligodT) cDNA library) | 30956 |
| 21 | GRRpz Cells derived from normal prostate epithelium | 164801 |
| 22 | WOca Cells derived from Gleason Grade 4 prostate cancer epithelium | 162088 |
| 23 | Normal Lung Epithelium of Patient #1006 (MICRODISSECTED PCR (OligodT) cDNA library) | 306198 |
| 24 | Primary tumor, Large Cell Carcinoma of Patient #1006 (MICRODISSECTED PCR (OligodT) cDNA library) | 309349 |
| 25 | Normal Prostate Epithelium from Patient IF97-26811 | 279444 |
| 26 | Prostate Cancer Epithelium Gleason 3 + 3 Patient IF97-26811 | 269406 |
| 27 | Normal Breast Epithelium from Patient 515 | 239494 |
| 28 | Primary Breast tumor from Patient 515 | 259960 |
| 29 | Lymph node metastasis from Patient 515 | 326786 |
| 30 | Normal Prostate Epithelium from Chiron Patient ID 884 | 298431 |
| 31 | Prostate Cancer Epithelium (Gleason 4 + 4) from Chiron Patient ID 884 | 331941 |

Characterization of Sequences in the Libraries

After using the software program Phred (ver 0.000925.c, Green and Weing, ©1993-2000) to select those polynucleotides having the best quality sequence, the polynucleotides were compared against the public databases to identify any homolgous sequences. The sequences of the isolated polynucleotides were first masked to eliminate low complexity sequences using the BLASTX masking program (Claverie "Effective Large-Scale Sequence Similarity Searches," In: Computer Methods for Macromolecular Sequence Analysis, Doolittle, ed., Meth. Enzymol. 266:212-227 Academic Press, NY, N.Y. (1996); see particularly Claverie, in "Automated DNA Sequencing and Analysis Techniques" Adams et al., eds., Chap. 36, p. 267 Academic Press, San Diego, 1994 and Claverie et al. Comput. Chem. (1993) 17:191). Generally, masking does not influence the final search results, except to eliminate sequences of relatively little interest due to their low complexity, and to eliminate multiple "hits" based on similarity to repetitive regions common to multiple sequences, e.g., Alu repeats. The remaining sequences were then used in a BLASTN vs. GenBank search; sequences that exhibited greater than 70% overlap, 99% identity, and a p value of less than $1 \times 10e-40$ were discarded. Sequences from this search also were discarded if the inclusive parameters were met, but the sequence was ribosomal or vector-derived.

The resulting sequences from the previous search were classified into three groups (1, 2 and 3 below) and searched in a BLASTX vs. NRP (non-redundant proteins) database search: (1) unknown (no hits in the GenBank search), (2) weak similarity (greater than 45% identity and p value of less than $1 \times 10e-5$), and (3) high similarity (greater than 60% overlap, greater than 80% identity, and p value less than $1 \times 10e-5$). Sequences having greater than 70% overlap, greater than 99% identity, and p value of less than $1 \times 10e-40$ were discarded.

The remaining sequences were classified as unknown (no hits), weak similarity, and high similarity (parameters as above). Two searches were performed on these sequences. First, a BLAST vs. EST database search was performed and sequences with greater than 99% overlap, greater than 99% similarity and a p value of less than $1 \times 10e-40$ were discarded. Sequences with a p value of less than $1 \times 10e-65$ when compared to a database sequence of human origin were also excluded. Second, a BLASTN vs. Patent GeneSeq database was performed and sequences having greater than 99% identity, p value less than $1 \times 10e-40$, and greater than 99% overlap were discarded.

The remaining sequences were subjected to screening using other rules and redundancies in the dataset. Sequences with a p value of less than $1 \times 10e-111$ in relation to a database sequence of human origin were specifically excluded. The final result provided the 8064 sequences listed as SEQ ID NOS 15991-22000 in the accompanying Sequence Listing and summarized in Table 130 (inserted prior to claims). Each identified polynucleotide represents sequence from at least a partial mRNA transcript.

Summary of Polynucleotides of the Invention

Table 130 (inserted prior to claims) provides a summary of polynucleotides isolated as described. Specifically, Table 130 provides: 1) the SEQ ID NO ("SEQ ID") assigned to each sequence for use in the present specification; 2) the Cluster Identification No. ("CLUSTER"); 3) the Sequence Name assigned to each sequence; 3) the sequence name ("SEQ NAME") used as an internal identifier of the sequence; 4) the orientation of the sequence ("ORIENT") (either forward (F) or reverse (R)); 5) the name assigned to the clone from which or reverse (R)); 5) the name assigned to the clone from which the sequence was isolated ("CLONE ID"); and the name of the library from which the sequence was isolated ("LIBRARY"), where the notation indicates that name of the cell line or patient sample (e.g., UC2-NormColon indicates the sequence was isolated from normal colon tissue of the patient assigned the identification UC#2). Because at least some of the provided polynucleotides represent partial mRNA transcripts, two or more polynucleotides may represent different regions of the same mRNA transcript and the same gene and/or may be contained within the same clone. Thus, for example, if two or more SEQ ID NOS: are identified as belonging to the same clone, then either sequence can be used to obtain the full-length mRNA or gene Example 83

Results of Public Database Search to Identify Function of Gene Products

SEQ ID NOS: 15991-22000 were translated in all three reading frames, and the nucleotide sequences and translated amino acid sequences used as query sequences to search for homologous sequences in either the GenBank (nucleotide sequences) or Non-Redundant Protein (amino acid sequences) databases. Query and individual sequences were aligned using the BLAST 2.0 programs, available over the world wide at a site sponsored by the National Center for Biotechnology Information, which is supported by the National Library of Medicine and the National Institutes of Health (see also Altschul, et al. Nucleic Acids Res. (1997) 25:3389-3402). The sequences were masked to various extents to prevent searching of repetitive sequences or poly-A sequences, using the BLASTX program for masking low complexity as described above in Example 82.

Tables 131A and 131B (inserted prior to claims) provides the alignment summaries having a p value of 1×10e-2 or less indicating substantial homology between the sequences of the present invention and those of the indicated public databases. Specifically, Table 131A provides the SEQ ID NO of the query sequence, the accession number of the GenBank database entry of the homologous sequence, and the individual p value of each alignment. Table 131A provides the SEQ ID NO of the query sequence, the accession number of the Non-Redundant Protein database entry of the homologous sequence, and the individual p value of each alignment. The alignments provided in Tables 131A and 131B are the best available alignment to a DNA or amino acid sequence at a time just prior to filing of the present specification. The activity of the polypeptide encoded by the SEQ ID NOS listed in these tables can be extrapolated to be substantially the same or substantially similar to the activity of the reported nearest neighbor or closely related sequence. The accession number of the nearest neighbor is reported, providing a publicly available reference to the activities and functions exhibited by the nearest neighbor. The public information regarding the activities and functions of each of the nearest neighbor sequences is incorporated by reference in this application. Also incorporated by reference is all publicly available information regarding the sequence, as well as the putative and actual activities and functions of the nearest neighbor sequences listed in Tables 131A and 131B and their related sequences. The search program and database used for the alignment, as well as the calculation of the p value are also indicated.

Full length sequences or fragments of the polynucleotide sequences of the nearest neighbors can be used as probes and primers to identify and isolate the full length sequence of the corresponding polynucleotide. The nearest neighbors can indicate a tissue or cell type to be used to construct a library for the full-length sequences of the corresponding polynucleotides.

Example 83.5

Members of Protein Families

SEQ ID NOS:15991-22000 were used to conduct a profile search as described in the specification above. Several of the polynucleotides of the invention were found to encode polypeptides having characteristics of a polypeptide belonging to a known protein family (and thus represent members of these protein families) and/or comprising a known functional domain. Table 132 (inserted before claims) provides the SEQ ID NO: of the query sequence, the Sequence Name, the Cluster to which the sequence is assigned, a brief description of the profile hit, the orientation (Direction, "Dir") of the query sequence with respect to the individual sequence) where forward (for) indicates that the alignment is in the same direction (left to right) as the sequence provided in the Sequence Listing and reverse (rev) indicates that the alignment is with a sequence complementary to the sequence provided in the Sequence Listing), and the score of the profile hit.

Some polynucleotides exhibited multiple profile hits where the query sequence contains overlapping profile regions, and/or where the sequence contains two different functional domains. Each of the profile hits of Table 132 is described in more detail below. The acronyms for the profiles (provided in parentheses) are those used to identify the profile in the Pfam, Prosite, and InterPro databases. The Pfam database can be accessed through web sites supported by Genome Sequencing Center at the Washington University School of Medicine or by the European Molecular Biology Laboratories in Heidelberg, Germany. The Prosite database can be accessed at the ExPASy Molecular Biology Server on the internet. The InterPro database can be accessed at a web site supported by the EMBL European Bioinformatics Institute. The public information available on the Pfam, Prosite, and InterPro databases regarding the various profiles, including but not limited to the activities, function, and consensus sequences of various proteins families and protein domains, is incorporated herein by reference. Table 132

| SEQ ID NO | SEQ NAME | CLUSTER | PROFILE NAME | DIR | SCORE |
|---|---|---|---|---|---|
| 15996 | 2102.B18.gz43_275316 | 558147 | Ets_Cterm | for | 19.58 |
| 15999 | 2103.M06.gz43_275519 | 377696 | protkinase | for | 20.71 |
| 16028 | 2153.K14.gz43_278937 | 372952 | Dead_box_helic | for | 172.21 |
| 16029 | 2154.M04.gz43_279163 | 377696 | protkinase | for | 20.71 |

-continued

| SEQ ID NO | SEQ NAME | CLUSTER | PROFILE NAME | DIR | SCORE |
|---|---|---|---|---|---|
| 16051 | 2165.H06.gz43_280342 | 393635 | zf-c2h2 | for | 33.96 |
| 16059 | 2166.J11.gz43_281368 | 377696 | protkinase | for | 20.71 |
| 16098 | 2118.A09.gz43_307025 | 446397 | bzip | for | 19.15 |
| 16107 | 2131.I13.gz43_308085 | 34071 | wd40 | for | 37.45 |
| 16108 | 2131.B14.gz43_308094 | 221686 | protkinase | for | 33.14 |
| 16218 | 1573.F18.gz43_208848 | 639849 | PH | for | 42.77 |
| 16219 | 1573.K19.gz43_208869 | 486238 | protkinase | rev | 45.41 |
| 16405 | 1585.G22.gz43_210545 | 412416 | Dead_box_helic | for | 49.67 |
| 16435 | 1587.B06.gz43_211440 | 446984 | ANK | rev | 23.12 |
| 16476 | 1597.G06.gz43_212233 | 639593 | defensins | rev | 18.27 |
| 16477 | 1597.J06.gz43_212236 | 557975 | ANK | for | 35.63 |
| 16492 | 1597.F18.gz43_212424 | 596882 | zf-c2h2 | rev | 18.13 |
| 16690 | 1694.M19.gz43_214375 | 425923 | zf-c2h2 | for | 32.76 |
| 16837 | 1706.P07.gz43_216138 | 639901 | zf-c2h2 | for | 19.43 |
| 16867 | 1707.J02.gz43_216453 | 550237 | zf-ccch | for | 26.74 |
| 17501 | 1755.P24.gz43_223395 | 606129 | rvt | for | 37.6 |
| 17704 | 1790.C14.gz43_226997 | 727150 | bzip | for | 24.2 |
| 18024 | 1828.J19.gz43_232472 | 728303 | zf-c2h2 | rev | 18.19 |
| 18028 | 1828.P21.gz43_232510 | 509678 | Retvir_asp_protease | for | 28.5 |
| 18044 | 1838.N05.gz43_233020 | 481614 | zf-c2h2 | for | 18.52 |
| 18504 | 1888.O06.gz43_240269 | 451764 | rvt | for | 49.99 |
| 18963 | 1924.H18.gz43_245579 | 499700 | 7tm_1 | rev | 73.7 |
| 19003 | 1935.E18.gz43_246500 | 490805 | ANK | rev | 28.74 |
| 19130 | 1981.O19.gz43_248062 | 558949 | zf-c3hc4 | rev | 19.16 |
| 19393 | 1958.N12.gz43_250647 | 556308 | zf-c2h2 | for | 40.77 |
| 19514 | 1923.M22.gz43_252963 | 562603 | zf-c2h2 | rev | 42.42 |
| 19643 | 1995.C03.gz43_256117 | 562152 | zf-c2h2 | rev | 18.97 |
| 19679 | 1995.P13.gz43_256290 | 562989 | EGF | rev | 19.4 |
| 19713 | 1995.B24.gz43_256452 | 556632 | zf-c2h2 | rev | 20.64 |
| 19804 | 2007.F09.gz43_257778 | 560652 | zf-c2hc | rev | 21.49 |
| 19921 | 2008.F18.gz43_258308 | 550497 | bzip | for | 20.27 |
| 20141 | 1669.G11.gz43_260853 | 503275 | protkinase | rev | 43.25 |
| 20346 | 1682.O17.gz43_262495 | 450211 | bzip | rev | 26.06 |
| 20363 | 1682.F21.gz43_262550 | 546740 | EFhand | rev | 18.72 |
| 20678 | 2018.K14.gz43_264760 | 432970 | zf-c2h2 | for | 48.43 |
| 20969 | 2041.C09.gz43_266976 | 556632 | zf-c2h2 | rev | 20.88 |
| 21457 | 2067.I20.gz43_271090 | 551617 | 7tm_1 | rev | 19.77 |
| 21498 | 2068.F14.gz43_271375 | 561707 | 7tm_1 | rev | 24.27 |
| 21512 | 2068.D17.gz43_271421 | 554774 | tgf-beta | for | 18.24 |
| 21746 | 2176.J17.gz43_281945 | 412416 | Dead_box_helic | for | 37.64 |
| 21991 | 1561.C22.gz43_314731 | 447072 | PH | for | 31.95 |

Example 84

Description of Libraries and Detection of Differential Expression

The relative expression levels of the polynucleotides of the invention were assessed in several libraries prepared from various sources, including cell lines and patient tissue samples. Table 129 above provides a summary of these libraries, including the shortened library name, the mRNA source used to prepared the cDNA library, the "nickname" of the library that is used in the tables below (in quotes), and the approximate number of clones in the library.

Each of the libraries is composed of a collection of cDNA clones that in turn are representative of the mRNAs expressed in the indicated mRNA source. In order to facilitate the analysis of the millions of sequences in each library, the sequences were assigned to clusters. The concept of "cluster of clones" is derived from a sorting/grouping of cDNA clones based on their hybridization pattern to a panel of roughly 300 7 bp oligonucleotide probes (see Drmanac et al., *Genomics* (1996) 37(1):29). Random cDNA clones from a tissue library are hybridized at moderate stringency to 300 7 bp oligonucleotides. Each oligonucleotide has some measure of specific hybridization to that specific clone. The combination of 300 of these measures of hybridization for 300 probes equals the "hybridization signature" for a specific clone. Clones with similar sequence will have similar hybridization signatures. By developing a sorting/grouping algorithm to analyze these signatures, groups of clones in a library can be identified and brought together computationally. These groups of clones are termed "clusters". Depending on the stringency of the selection in the algorithm (similar to the stringency of hybridization in a classic library cDNA screening protocol), the "purity" of each cluster can be controlled. For example, artifacts of clustering may occur in computational clustering just as artifacts can occur in "wet-lab" screening of a cDNA library with 400 bp cDNA fragments, at even the highest stringency. The stringency used in the implementation of cluster herein provides groups of clones that are in general from the same cDNA or closely related cDNAs. Closely related clones can be a result of different length clones of the same cDNA, closely related clones from highly related gene families, or splice variants of the same cDNA.

Differential expression for a selected cluster was assessed by first determining the number of cDNA clones corresponding to the selected cluster in the first library (Clones in $1^{st}$), and the determining the number of cDNA clones corresponding to the selected cluster in the second library (Clones in $2^{nd}$). Differential expression of the selected cluster in the first library relative to the second library is expressed as a "ratio" of percent expression between the two libraries. In general, the "ratio" is calculated by: 1) calculating the percent expression of the selected cluster in the first library by dividing the number of clones corresponding to a selected cluster in the first library by the total number of clones analyzed from the first library; 2) calculating the percent expression of the selected cluster in, the second library by dividing the number of clones corresponding to a selected cluster in a second library by the total number of clones analyzed from the second library; 3) dividing the calculated percent expression from the first library by the calculated percent expression from the second library. If the "number of clones" corresponding to a selected cluster in a library is zero, the value is set at 1 to aid in calculation. The formula used in calculating the ratio takes into account the "depth" of each of the libraries being compared, i.e., the total number of clones analyzed in each library.

In general, a polynucleotide is significantly differentially expressed between two samples when the ratio value is greater than at least about 2, preferably greater than at least about 3, more preferably greater than at least about 5, where the ratio value is calculated using the method described above. The significance of differential expression is determined using a z score test (Zar, *Biostatistical Analysis*, Prentice Hall, Inc., USA, "Differences Between Proportions," pp 296-298 (1974).

Using this approach, a number of polynucleotide sequences were identified as being differentially expressed between, for example, cells derived from high metastatic potential cancer tissue and low metastatic cancer cells, and between cells derived from metastatic cancer tissue and normal tissue. Evaluation of the levels of expression of the genes corresponding to these sequences can be valuable in diagnosis, prognosis, and/or treatment (e.g., to facilitate rationale design of therapy, monitoring during and after therapy, etc.). Moreover, the genes corresponding to differentially expressed sequences described herein can be therapeutic targets due to their involvement in regulation (e.g., inhibition or promotion) of development of, for example, the metastatic phenotype. For example, sequences that correspond to genes that are increased in expression in high metastatic potential cells relative to normal or non-metastatic tumor cells may encode genes or regulatory sequences involved in processes such as angiogenesis, differentiation, cell replication, and metastasis.

Detection of the relative expression levels of differentially expressed polynucleotides described herein can provide valuable information to guide the clinician in the choice of therapy. For example, a patient sample exhibiting an expression level of one or more of these polynucleotides that corresponds to a gene that is increased in expression in metastatic or high metastatic potential cells may warrant more aggressive treatment for the patient. In contrast, detection of expression levels of a polynucleotide sequence that corresponds to expression levels associated with that of low metastatic potential cells may warrant a more positive prognosis than the gross pathology would suggest.

A number of polynucleotide sequences of the present invention are differentially expressed between human microvascular endothelial cells (HMVEC) that have been treated with growth factors relative to untreated HMVEC. Sequences that are differentially expressed between growth factor-treated HMVEC and untreated HMVEC can represent sequences encoding gene products involved in angiogenesis, metastasis (cell migration), and other development and oncogenic processes. For example, sequences that are more highly expressed in HMVEC treated with growth factors (such as bFGF or VEGF) relative to untreated HMVEC can serve as drug targets for chemotherapeutics, e.g., decreasing expression of such up-regulated genes or inhibiting the activity of the encoded gene product would serve to inhibit tumor cell angiogenesis. Detection of expression of these sequences in colon cancer tissue can be valuable in determining diagnostic, prognostic and/or treatment information associated with the prevention of achieving the malignant state in these tissues, and can be important in risk assessment for a patient. A patient sample displaying an increased level of one or more of these polynucleotides may thus warrant closer attention or more frequent screening procedures to catch the malignant state as early as possible.

The differential expression of the polynucleotides can thus be used as, for example, diagnostic and/or prognostic markers, for risk assessment, patient treatment and the like. These polynucleotides can also be used in combination with other molecular and/or biochemical markers.

The differential expression data for polynucleotides of the invention that have been identified as being differentially expressed across various combinations of the libraries described above is summarized in Table 133 (inserted prior to the claims). Table 133 provides: 1) the Sequence Identification Number ("SEQ ID NO") assigned to the polynucleotide; 2) the cluster ("CLUSTER") to which the polynucleotide has been assigned as described above; 3) the library comparisons that resulted in identification of the polynucleotide as being differentially expressed ("PAIR AB"), where the cDNA libraries used are referenced by their library numbers; 4) the number of clones corresponding to the polynucleotide in the first library listed ("CLONES A"); 5) the number of clones corresponding to the polynucleotide in the second library listed ("CLONES B"); 6) the "RATIO PLUS" where the comparison resulted in a finding that the number of clones in library A is greater than the number of clones in library B; and 7) the "RATIO MINUS" where the comparison resulted in a finding that the number of clones in library B is greater than the number of clones in library A.

Detection of expression of genes that correspond to the above polynucleotides may be of particular interest in diagnosis, prognosis, risk assessment, and monitoring of treatment. Furthermore, differential expression of a specific gene across multiple libraries can also be indicative of a gene whose expression is associated with, for example, suppression of the metastatic phenotype or with development of the cell toward a metastatic phenotype. For example, SEQ ID NO:19734 corresponds to a gene that is expressed at relatively higher levels in metastasized colon tumor than in normal colon tissue. Thus a relatively increased level of expression of the gene corresponding to SEQ ID NO: 19734 may be used as marker of a metastatic or pre-metastatic colon cells either alone or in combination with other markers.

Some polynucleotides exhibited similar differential expression trends in libraries of different tissue origin (see, e.g., SEQ ID NO:17327). These data suggest that the differential expression patterns of some genes associated with development of tumors indicate a role for those genes that is non-specific to the tissue of origin.

Example 85

Detection of Differential Expression Using Arrays mRNA isolated from samples of cancerous and normal colon tissue obtained from patients were analyzed to identify genes differentially expressed in cancerous and normal cells. Normal and cancerous cells collected from cryopreserved patient tissues were isolated using laser capture microdissection (LCM) techniques, which techniques are well known in the art (see, e.g., Ohyama et al. (2000) *Biotechniques* 29:530-

6; Curran et al. (2000) *Mol. Pathol.* 53:64-8; Suarez-Quian et al. (1999) *Biotechniques* 26:328-35; Simone et al. (1998) *Trends Genet* 14:272-6; Conia et al. (1997) *J. Clin. Lab. Anal.* 11:28-38; Emmert-Buck et al. (1996) *Science* 274:998-1001).

Table 134 (inserted before the claims) provides information about each patient from which colon tissue samples were isolated, including: the Patient ID ("PT ID") and Path ReportID (}Path ID"), which are numbers assigned to the patient and the pathology reports for identification purposes; the group ("Grp") to which the patients have been assigned; the anatomical location of the tumor ("Anatom Loc"); the primary tumor size ("Size"); the primary tumor grade ("Grade"); the identification of the histopathological grade ("Histo Grade"); a description of local sites to which the tumor had invaded ("Local Invasion"); the presence of lymph node metastases ("LN Met"); the incidence of lymph node metastases (provided as a number of lymph nodes positive for metastasis over the number of lymph nodes examined) ("Incidence Lymphnode Met"); the "Regional Lymphnode Grade"; the identification or detection of metastases to sites distant to the tumor and their location ("Dist Met & Loc"); the grade of distant metastasis ("Dist Met Grade"); and general comments about the patient or the tumor ("Comments"). Histophatology of all primary tumors indicated the tumor was adenocarcinmoa except for Patient ID Nos. 130 (for which no information was provided), 392 (in which greater than 50% of the cells were mucinous carcinoma), and 784 (adenosquamous carcinoma). Extranodal extensions were described in three patients, Patient ID Nos. 784, 789, and 791. Lymphovascular invasion was described in Patient ID Nos. 128, 278, 517, 534, 784, 786, 789, 791, 890, and 892. Crohn's-like infiltrates were described in seven patients, Patient ID Nos. 52, 264, 268, 392, 393, 784, and 791. Table 135 (below) provides information about the patients from whom the prostate tissue was isolated.

TABLE 135

Prostate paitent data.

| Prostate Patient ID | Tumor Gleason Grade | Normal Prostate Description |
|---|---|---|
| 96 | 3 + 3 Adenocarcinoma | Normal prostate; Benign hyperplasia |
| 282 | 4 + 3 Adenocarcinoma | Normal prostate; Benign hyperplasia |
| 286 | 3 + 3 Adenocarcinoma | Normal prostate; Benign hyperplasia |
| 294 | 3 + 4 Adenocarcinoma | Normal prostate; Benign hyperplasia |
| 362 | 3 + 3 Adenocarcinoma | Normal prostate; Benign hyperplasia |
| 428 | 4 + 3 Adenocarcinoma | Normal prostate; Benign hyperplasia |
| 492 | 3 + 3 Adenocarcinoma | Normal prostate; Benign hyperplasia |
| 492 | 3 + 3 Adenocarcinoma | Normal prostate; Benign hyperplasia |
| 493 | 3 + 4 Adenocarcinoma | Normal prostate; Benign hyperplasia |
| 510 | 3 + 3 Adenocarcinoma | Normal Prostate; Benign hyperplasia |

Identification of Differentially Expressed Genes cDNA probes were prepared from total RNA isolated from the patient cells described above. Since LCM provides for the isolation of specific cell types to provide a substantially homogenous cell sample, this provided for a similarly pure RNA sample.

Total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) *Nature Med* 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling.

Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from normal cell RNA sample. For example, the cDNA probes from the normal cells were labeled with Cy3 fluorescent dye (green) and the cDNA probes prepared from the tumor cells were labeled with Cy5 fluorescent dye (red), and vice versa.

Each array used had an identical spatial layout and control spot set. Each microarray was divided into two areas, each area having an array with, on each half, twelve groupings of 32×12 spots, for a total of about 9,216 spots on each array. The two areas are spotted identically which provide for at least two duplicates of each clone per array.

Polynucleotides for use on the arrays were obtained from both publicly available sources and from cDNA libraries generated from selected cell lines and patient tissues. PCR products of from about 0.5 kb to 2.0 kb amplified from these sources were spotted onto the array using a Molecular Dynamics Gen III spotter according to the manufacturer's recommendations. For polynucleotides described herein, the microarray spot contained a clone having a cDNA from which the sequence was derived. The first row of each of the 24 regions on the array had about 32 control spots, including 4 negative control spots and 8 test polynucleotides. The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about four duplicate measurements for each clone, two of one color and two of the other, for each sample.

Table 136 (inserted before the claims) describes sequences present on the arrays. Table 136 includes: 1) athe SEQ ID NO of the sequence of the polynucleotide; and 2) the Spot ID, which is a unique identifier for each spot obtaining target sequence of interest on all arrays used.

The differential expression assay was performed by mixing equal amounts of probes from tumor cells and normal cells of the same patient. The arrays were prehybridized by incubation for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction). The level fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. During initial analysis of the microarrays, the hypothesis was accepted if $p>10^{-3}$, and the differential ratio was set to 1.000 for those spots. All other spots have a significant difference in expression between the tumor and normal sample. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level (p>0.05).

Table 136 (inserted before the claims) provides the results for gene products differentially expressed in the colon tumor samples relative to normal tissue samples. Table 136 includes: 1) the SEQ ID NO; 2) the spot identification number ("SpotID"); 3) the percentage of patients tested in which expression levels of the gene (as detected using the corresponding clone) was at least 2-fold greater in cancerous colon tissue (primary colon tumor) than in matched normal tissue ("Colon>2xT/N"); 4) the percentage of patients tested in which expression levels of the gene was less than or equal to one-half of the expression level in matched normal cells ("Colon<=halfxT/N"); and 5) the colon number ratios, indicating the number of patients upon which the provided ratios was based.

TABLE 136

| SEQ ID NO | SpotID | T/N Colon >2x | T/N Colon <halfx | T/N Colon Num Ratios |
|---|---|---|---|---|
| 15996 | 43971 | 0.0 | 75.0 | 8.0 |
| 16021 | 40453 | 0.0 | 42.9 | 7.0 |
| 16030 | 40457 | 0.0 | 71.4 | 7.0 |
| 16034 | 46308 | 0.0 | 50.0 | 8.0 |
| 16040 | 45610 | 0.0 | 62.5 | 8.0 |
| 16060 | 42816 | 0.0 | 50.0 | 8.0 |
| 16062 | 44673 | 0.0 | 50.0 | 8.0 |
| 16064 | 42422 | 0.0 | 37.5 | 8.0 |
| 16067 | 43983 | 0.0 | 37.5 | 8.0 |
| 16071 | 44679 | 0.0 | 50.0 | 8.0 |
| 16074 | 42418 | 0.0 | 37.5 | 8.0 |
| 16123 | 39755 | 0.0 | 42.9 | 7.0 |
| 16129 | 44916 | 0.0 | 50.0 | 8.0 |
| 16137 | 45618 | 0.0 | 37.5 | 8.0 |
| 16139 | 44926 | 0.0 | 50.0 | 8.0 |
| 16142 | 44216 | 0.0 | 37.5 | 8.0 |
| 16143 | 38367 | 0.0 | 42.9 | 7.0 |
| 16148 | 38357 | 0.0 | 57.1 | 7.0 |
| 16151 | 41869 | 0.0 | 42.9 | 7.0 |
| 16152 | 43508 | 0.0 | 37.5 | 8.0 |
| 16154 | 38365 | 0.0 | 57.1 | 7.0 |
| 16156 | 39069 | 0.0 | 42.9 | 7.0 |
| 16161 | 39061 | 0.0 | 57.1 | 7.0 |
| 16170 | 39767 | 0.0 | 42.9 | 7.0 |
| 16174 | 43881 | 0.0 | 37.5 | 8.0 |
| 16176 | 43873 | 0.0 | 37.5 | 8.0 |
| 16185 | 39769 | 0.0 | 57.1 | 7.0 |
| 16186 | 39775 | 0.0 | 57.1 | 7.0 |
| 16187 | 46330 | 0.0 | 37.5 | 8.0 |
| 16188 | 42471 | 0.0 | 37.5 | 8.0 |
| 16190 | 41173 | 0.0 | 42.9 | 7.0 |
| 16192 | 42479 | 0.0 | 50.0 | 8.0 |
| 16206 | 39621 | 0.0 | 42.9 | 7.0 |
| 16207 | 46007 | 0.0 | 50.0 | 8.0 |
| 16208 | 46015 | 0.0 | 62.5 | 8.0 |
| 16215 | 45301 | 0.0 | 37.5 | 8.0 |
| 16218 | 45303 | 0.0 | 37.5 | 8.0 |
| 16240 | 41033 | 0.0 | 57.1 | 7.0 |
| 16250 | 41035 | 0.0 | 57.1 | 7.0 |
| 16258 | 41027 | 0.0 | 42.9 | 7.0 |
| 16264 | 41737 | 0.0 | 42.9 | 7.0 |
| 16291 | 39647 | 0.0 | 42.9 | 7.0 |
| 16297 | 38943 | 0.0 | 42.9 | 7.0 |
| 16299 | 38939 | 0.0 | 42.9 | 7.0 |
| 16305 | 44939 | 0.0 | 37.5 | 8.0 |
| 16314 | 42827 | 0.0 | 37.5 | 8.0 |
| 16316 | 38231 | 0.0 | 42.9 | 7.0 |
| 16324 | 42819 | 0.0 | 37.5 | 8.0 |
| 16342 | 43521 | 0.0 | 62.5 | 8.0 |
| 16348 | 45633 | 0.0 | 50.0 | 8.0 |
| 16354 | 44931 | 0.0 | 50.0 | 8.0 |
| 16355 | 45635 | 0.0 | 50.0 | 8.0 |
| 16356 | 46345 | 0.0 | 37.5 | 8.0 |
| 16380 | 44947 | 0.0 | 50.0 | 8.0 |
| 16381 | 44247 | 0.0 | 50.0 | 8.0 |
| 16393 | 43501 | 0.0 | 37.5 | 8.0 |
| 16396 | 43489 | 0.0 | 50.0 | 8.0 |
| 16397 | 44951 | 0.0 | 37.5 | 8.0 |
| 16403 | 41755 | 0.0 | 42.9 | 7.0 |
| 16410 | 43541 | 0.0 | 37.5 | 8.0 |
| 16414 | 44953 | 0.0 | 50.0 | 8.0 |
| 16416 | 46365 | 0.0 | 62.5 | 8.0 |
| 16422 | 44909 | 0.0 | 50.0 | 8.0 |
| 16425 | 38210 | 0.0 | 42.9 | 7.0 |
| 16433 | 38928 | 0.0 | 42.9 | 7.0 |
| 16434 | 44911 | 0.0 | 50.0 | 8.0 |
| 16436 | 46361 | 0.0 | 50.0 | 8.0 |
| 16440 | 39632 | 0.0 | 42.9 | 7.0 |
| 16442 | 39620 | 0.0 | 42.9 | 7.0 |
| 16445 | 46363 | 0.0 | 62.5 | 8.0 |
| 16448 | 41736 | 0.0 | 57.1 | 7.0 |
| 16454 | 38944 | 0.0 | 42.9 | 7.0 |
| 16457 | 45605 | 0.0 | 62.5 | 8.0 |
| 16458 | 45609 | 0.0 | 100.0 | 8.0 |
| 16461 | 38228 | 0.0 | 57.1 | 7.0 |
| 16462 | 41740 | 0.0 | 42.9 | 7.0 |
| 16466 | 41032 | 0.0 | 42.9 | 7.0 |
| 16470 | 39638 | 0.0 | 57.1 | 7.0 |
| 16472 | 41760 | 0.0 | 42.9 | 7.0 |
| 16480 | 41754 | 0.0 | 71.4 | 7.0 |
| 16486 | 39980 | 0.0 | 57.1 | 7.0 |
| 16487 | 46315 | 0.0 | 37.5 | 8.0 |
| 16497 | 40674 | 0.0 | 42.9 | 7.0 |
| 16499 | 38566 | 0.0 | 57.1 | 7.0 |
| 16509 | 38590 | 0.0 | 42.9 | 7.0 |
| 16529 | 42813 | 0.0 | 37.5 | 8.0 |
| 16544 | 43515 | 0.0 | 50.0 | 8.0 |
| 16548 | 41400 | 0.0 | 42.9 | 7.0 |
| 16550 | 40702 | 0.0 | 42.9 | 7.0 |

TABLE 136-continued

| SEQ ID NO | SpotID | T/N Colon >2x | T/N Colon <halfx | T/N Colon Num Ratios |
|---|---|---|---|---|
| 16553 | 40000 | 0.0 | 42.9 | 7.0 |
| 16563 | 38185 | 0.0 | 42.9 | 7.0 |
| 16572 | 39587 | 0.0 | 42.9 | 7.0 |
| 16577 | 44925 | 0.0 | 50.0 | 8.0 |
| 16582 | 39597 | 0.0 | 57.1 | 7.0 |
| 16583 | 39593 | 0.0 | 42.9 | 7.0 |
| 16593 | 38893 | 0.0 | 42.9 | 7.0 |
| 16596 | 42842 | 0.0 | 62.5 | 8.0 |
| 16597 | 43540 | 0.0 | 50.0 | 8.0 |
| 16601 | 42840 | 0.0 | 50.0 | 8.0 |
| 16604 | 43548 | 0.0 | 37.5 | 8.0 |
| 16607 | 43538 | 0.0 | 50.0 | 8.0 |
| 16608 | 46340 | 0.0 | 37.5 | 8.0 |
| 16634 | 39586 | 0.0 | 42.9 | 7.0 |
| 16641 | 45656 | 0.0 | 37.5 | 8.0 |
| 16644 | 44254 | 0.0 | 50.0 | 8.0 |
| 16645 | 45652 | 0.0 | 37.5 | 8.0 |
| 16656 | 46285 | 0.0 | 37.5 | 8.0 |
| 16657 | 40290 | 0.0 | 42.9 | 7.0 |
| 16658 | 40304 | 0.0 | 42.9 | 7.0 |
| 16670 | 39592 | 0.0 | 42.9 | 7.0 |
| 16672 | 44950 | 0.0 | 37.5 | 8.0 |
| 16681 | 45571 | 0.0 | 37.5 | 8.0 |
| 16692 | 45654 | 0.0 | 37.5 | 8.0 |
| 16693 | 45660 | 0.0 | 37.5 | 8.0 |
| 16695 | 40292 | 0.0 | 42.9 | 7.0 |
| 16701 | 40294 | 0.0 | 42.9 | 7.0 |
| 16712 | 46364 | 0.0 | 37.5 | 8.0 |
| 16714 | 38892 | 0.0 | 42.9 | 7.0 |
| 16723 | 40998 | 0.0 | 57.1 | 7.0 |
| 16726 | 40996 | 0.0 | 57.1 | 7.0 |
| 16728 | 41712 | 0.0 | 42.9 | 7.0 |
| 16747 | 38196 | 0.0 | 42.9 | 7.0 |
| 16763 | 44881 | 0.0 | 37.5 | 8.0 |
| 16766 | 39610 | 0.0 | 42.9 | 7.0 |
| 16780 | 41016 | 0.0 | 42.9 | 7.0 |
| 16783 | 39942 | 0.0 | 42.9 | 7.0 |
| 16785 | 41718 | 0.0 | 42.9 | 7.0 |
| 16788 | 39938 | 0.0 | 42.9 | 7.0 |
| 16791 | 46289 | 0.0 | 37.5 | 8.0 |
| 16794 | 41024 | 0.0 | 42.9 | 7.0 |
| 16797 | 38536 | 0.0 | 71.4 | 7.0 |
| 16800 | 39948 | 0.0 | 42.9 | 7.0 |
| 16806 | 39236 | 0.0 | 71.4 | 7.0 |
| 16808 | 38540 | 0.0 | 42.9 | 7.0 |
| 16810 | 41720 | 0.0 | 42.9 | 7.0 |
| 16811 | 41728 | 0.0 | 42.9 | 7.0 |
| 16821 | 46293 | 0.0 | 37.5 | 8.0 |
| 16833 | 41358 | 0.0 | 71.4 | 7.0 |
| 16836 | 39954 | 0.0 | 57.1 | 7.0 |
| 16840 | 41360 | 0.0 | 42.9 | 7.0 |
| 16854 | 38550 | 0.0 | 42.9 | 7.0 |
| 16856 | 38409 | 0.0 | 31.7 | 41.0 |
| 16858 | 40652 | 0.0 | 42.9 | 7.0 |
| 16871 | 42070 | 0.0 | 57.1 | 7.0 |
| 16873 | 42072 | 0.0 | 57.1 | 7.0 |
| 16874 | 42074 | 0.0 | 42.9 | 7.0 |
| 16876 | 40658 | 0.0 | 42.9 | 7.0 |
| 16879 | 41372 | 0.0 | 42.9 | 7.0 |
| 16885 | 40670 | 0.0 | 42.9 | 7.0 |
| 16895 | 38147 | 0.0 | 42.9 | 7.0 |
| 16905 | 39563 | 0.0 | 42.9 | 7.0 |
| 16906 | 38863 | 0.0 | 42.9 | 7.0 |
| 16908 | 38859 | 0.0 | 42.9 | 7.0 |
| 16927 | 40346 | 0.0 | 42.9 | 7.0 |
| 16931 | 41046 | 0.0 | 42.9 | 7.0 |
| 16935 | 45605 | 0.0 | 62.5 | 8.0 |
| 16936 | 40326 | 0.0 | 71.4 | 7.0 |
| 16938 | 40328 | 0.0 | 42.9 | 7.0 |
| 16940 | 41032 | 0.0 | 42.9 | 7.0 |
| 16945 | 40342 | 0.0 | 42.9 | 7.0 |
| 16950 | 41742 | 0.0 | 42.9 | 7.0 |
| 16952 | 41056 | 0.0 | 42.9 | 7.0 |
| 16962 | 43215 | 0.0 | 50.0 | 8.0 |
| 16964 | 43203 | 0.0 | 37.5 | 8.0 |
| 16965 | 42497 | 0.0 | 37.5 | 8.0 |
| 16971 | 42505 | 0.0 | 62.5 | 8.0 |
| 16974 | 43209 | 0.0 | 50.0 | 8.0 |
| 16975 | 38431 | 0.0 | 57.1 | 7.0 |
| 16976 | 24379 | 0.0 | 36.6 | 41.0 |
| 16979 | 43909 | 0.0 | 100.0 | 8.0 |
| 16981 | 41667 | 0.0 | 42.9 | 7.0 |
| 16982 | 40985 | 0.0 | 42.9 | 7.0 |
| 16986 | 38873 | 0.0 | 42.9 | 7.0 |
| 16988 | 38875 | 0.0 | 42.9 | 7.0 |
| 16989 | 40977 | 0.0 | 42.9 | 7.0 |
| 16991 | 38169 | 0.0 | 42.9 | 7.0 |
| 16995 | 40987 | 0.0 | 42.9 | 7.0 |
| 16996 | 40261 | 0.0 | 42.9 | 7.0 |
| 17000 | 39809 | 0.0 | 42.9 | 7.0 |
| 17005 | 40973 | 0.0 | 42.9 | 7.0 |
| 17006 | 39579 | 0.0 | 42.9 | 7.0 |
| 17008 | 40965 | 0.0 | 42.9 | 7.0 |
| 17014 | 40263 | 0.0 | 42.9 | 7.0 |
| 17016 | 39811 | 0.0 | 57.1 | 7.0 |
| 17018 | 40513 | 0.0 | 57.1 | 7.0 |
| 17021 | 39821 | 0.0 | 42.9 | 7.0 |
| 17022 | 38871 | 0.0 | 42.9 | 7.0 |
| 17028 | 38175 | 0.0 | 42.9 | 7.0 |
| 17043 | 40267 | 0.0 | 42.9 | 7.0 |
| 17044 | 40273 | 0.0 | 42.9 | 7.0 |
| 17047 | 40525 | 0.0 | 42.9 | 7.0 |
| 17054 | 41685 | 0.0 | 42.9 | 7.0 |
| 17056 | 40991 | 0.0 | 42.9 | 7.0 |
| 17057 | 41217 | 0.0 | 71.4 | 7.0 |
| 17062 | 39907 | 0.0 | 57.1 | 7.0 |
| 17066 | 41221 | 0.0 | 42.9 | 7.0 |
| 17075 | 42027 | 0.0 | 42.9 | 7.0 |
| 17096 | 41227 | 0.0 | 42.9 | 7.0 |
| 17102 | 41923 | 0.0 | 71.4 | 7.0 |
| 17104 | 41223 | 0.0 | 42.9 | 7.0 |
| 17114 | 38503 | 0.0 | 42.9 | 7.0 |
| 17120 | 41933 | 0.0 | 42.9 | 7.0 |
| 17122 | 40623 | 0.0 | 42.9 | 7.0 |
| 17125 | 38527 | 0.0 | 42.9 | 7.0 |
| 17128 | 39905 | 0.0 | 42.9 | 7.0 |
| 17131 | 40613 | 0.0 | 42.9 | 7.0 |
| 17132 | 40615 | 0.0 | 42.9 | 7.0 |
| 17136 | 39925 | 0.0 | 42.9 | 7.0 |
| 17137 | 41333 | 0.0 | 42.9 | 7.0 |
| 17142 | 40627 | 0.0 | 42.9 | 7.0 |
| 17143 | 41339 | 0.0 | 42.9 | 7.0 |
| 17147 | 39933 | 0.0 | 42.9 | 7.0 |
| 17149 | 40629 | 0.0 | 42.9 | 7.0 |
| 17156 | 42045 | 0.0 | 42.9 | 7.0 |
| 17157 | 39921 | 0.0 | 42.9 | 7.0 |
| 17160 | 40637 | 0.0 | 71.4 | 7.0 |
| 17171 | 42035 | 0.0 | 42.9 | 7.0 |
| 17176 | 43931 | 0.0 | 37.5 | 8.0 |
| 17179 | 46029 | 0.0 | 37.5 | 8.0 |
| 17183 | 42523 | 0.0 | 37.5 | 8.0 |
| 17189 | 39829 | 0.0 | 42.9 | 7.0 |
| 17193 | 43923 | 0.0 | 62.5 | 8.0 |
| 17196 | 43229 | 0.0 | 50.0 | 8.0 |
| 17198 | 44629 | 0.0 | 37.5 | 8.0 |
| 17210 | 43219 | 0.0 | 50.0 | 8.0 |
| 17212 | 39835 | 0.0 | 100.0 | 7.0 |
| 17221 | 40529 | 0.0 | 100.0 | 7.0 |
| 17224 | 43921 | 0.0 | 37.5 | 8.0 |
| 17228 | 45319 | 0.0 | 50.0 | 8.0 |
| 17231 | 45313 | 0.0 | 37.5 | 8.0 |
| 17235 | 44627 | 0.0 | 37.5 | 8.0 |
| 17236 | 44631 | 0.0 | 37.5 | 8.0 |
| 17240 | 40531 | 0.0 | 42.9 | 7.0 |
| 17245 | 46035 | 0.0 | 62.5 | 8.0 |
| 17260 | 41233 | 0.0 | 85.7 | 7.0 |
| 17264 | 40537 | 0.0 | 42.9 | 7.0 |
| 17270 | 44637 | 0.0 | 37.5 | 8.0 |
| 17271 | 45335 | 0.0 | 37.5 | 8.0 |
| 17280 | 40535 | 0.0 | 57.1 | 7.0 |
| 17282 | 41241 | 0.0 | 42.9 | 7.0 |
| 17283 | 41943 | 0.0 | 42.9 | 7.0 |
| 17301 | 41947 | 0.0 | 42.9 | 7.0 |
| 17372 | 38765 | 0.0 | 57.1 | 7.0 |

TABLE 136-continued

| SEQ ID NO | SpotID | T/N Colon >2x | T/N Colon <halfx | T/N Colon Num Ratios |
|---|---|---|---|---|
| 17382 | 39467 | 0.0 | 57.1 | 7.0 |
| 17388 | 42861 | 0.0 | 62.5 | 8.0 |
| 17389 | 43559 | 0.0 | 37.5 | 8.0 |
| 17391 | 38146 | 0.0 | 37.5 | 8.0 |
| 17392 | 43553 | 0.0 | 37.5 | 8.0 |
| 17398 | 43555 | 0.0 | 42.9 | 7.0 |
| 17402 | 39463 | 0.0 | 71.4 | 7.0 |
| 17403 | 43557 | 0.0 | 42.9 | 7.0 |
| 17405 | 40175 | 0.0 | 42.9 | 7.0 |
| 17408 | 40167 | 0.0 | 42.9 | 7.0 |
| 17412 | 40260 | 0.0 | 37.5 | 8.0 |
| 17419 | 44965 | 0.0 | 37.5 | 8.0 |
| 17420 | 44969 | 0.0 | 42.9 | 7.0 |
| 17422 | 44967 | 0.0 | 42.9 | 7.0 |
| 17432 | 40165 | 0.0 | 42.9 | 7.0 |
| 17436 | 44265 | 0.0 | 42.9 | 7.0 |
| 17438 | 38162 | 0.0 | 37.5 | 8.0 |
| 17440 | 41678 | 0.0 | 37.5 | 8.0 |
| 17442 | 40974 | 0.0 | 37.5 | 8.0 |
| 17444 | 41674 | 0.0 | 37.5 | 8.0 |
| 17448 | 46379 | 0.0 | 37.5 | 8.0 |
| 17453 | 41670 | 0.0 | 37.5 | 8.0 |
| 17457 | 42871 | 0.0 | 50.0 | 8.0 |
| 17462 | 38172 | 0.0 | 37.5 | 8.0 |
| 17464 | 44273 | 0.0 | 50.0 | 8.0 |
| 17465 | 44277 | 0.0 | 50.0 | 8.0 |
| 17466 | 43569 | 0.0 | 37.5 | 8.0 |
| 17473 | 38872 | 0.0 | 50.0 | 8.0 |
| 17476 | 43577 | 0.0 | 50.0 | 8.0 |
| 17482 | 39576 | 0.0 | 57.1 | 7.0 |
| 17483 | 44977 | 0.0 | 50.0 | 8.0 |
| 17491 | 39580 | 0.0 | 62.5 | 8.0 |
| 17492 | 45689 | 0.0 | 37.5 | 8.0 |
| 17493 | 44985 | 0.0 | 50.0 | 8.0 |
| 17494 | 45681 | 0.0 | 75.0 | 8.0 |
| 17497 | 39578 | 0.0 | 57.1 | 7.0 |
| 17498 | 40984 | 0.0 | 50.0 | 8.0 |
| 17500 | 39584 | 0.0 | 42.9 | 7.0 |
| 17502 | 40990 | 0.0 | 37.5 | 8.0 |
| 17504 | 46391 | 0.0 | 37.5 | 8.0 |
| 17506 | 41682 | 0.0 | 42.9 | 7.0 |
| 17516 | 38769 | 0.0 | 42.9 | 7.0 |
| 17520 | 44612 | 0.0 | 37.5 | 8.0 |
| 17522 | 44622 | 0.0 | 37.5 | 8.0 |
| 17538 | 39473 | 0.0 | 57.1 | 7.0 |
| 17540 | 42281 | 0.0 | 42.9 | 7.0 |
| 17543 | 45320 | 0.0 | 37.5 | 8.0 |
| 17544 | 39479 | 0.0 | 42.9 | 7.0 |
| 17550 | 42287 | 0.0 | 42.9 | 7.0 |
| 17551 | 45314 | 0.0 | 37.5 | 8.0 |
| 17552 | 45326 | 0.0 | 37.5 | 8.0 |
| 17557 | 42273 | 0.0 | 42.9 | 7.0 |
| 17558 | 43210 | 0.0 | 37.5 | 8.0 |
| 17563 | 43910 | 0.0 | 37.5 | 8.0 |
| 17565 | 42279 | 0.0 | 42.9 | 7.0 |
| 17574 | 46034 | 0.0 | 37.5 | 8.0 |
| 17575 | 43934 | 0.0 | 50.0 | 8.0 |
| 17576 | 43936 | 0.0 | 50.0 | 8.0 |
| 17577 | 44632 | 0.0 | 50.0 | 8.0 |
| 17578 | 43222 | 0.0 | 50.0 | 8.0 |
| 17579 | 40187 | 0.0 | 42.9 | 7.0 |
| 17580 | 44626 | 0.0 | 50.0 | 8.0 |
| 17587 | 44640 | 0.0 | 50.0 | 8.0 |
| 17589 | 43232 | 0.0 | 37.5 | 8.0 |
| 17591 | 43930 | 0.0 | 37.5 | 8.0 |
| 17593 | 44628 | 0.0 | 37.5 | 8.0 |
| 17599 | 44638 | 0.0 | 37.5 | 8.0 |
| 17600 | 45332 | 0.0 | 50.0 | 8.0 |
| 17601 | 46042 | 0.0 | 37.5 | 8.0 |
| 17603 | 43228 | 0.0 | 37.5 | 8.0 |
| 17605 | 43932 | 0.0 | 37.5 | 8.0 |
| 17609 | 40183 | 0.0 | 57.1 | 7.0 |
| 17613 | 44260 | 0.0 | 37.5 | 8.0 |
| 17618 | 43562 | 0.0 | 62.5 | 8.0 |
| 17622 | 43564 | 0.0 | 37.5 | 8.0 |
| 17624 | 45666 | 0.0 | 50.0 | 8.0 |
| 17626 | 44968 | 0.0 | 37.5 | 8.0 |
| 17628 | 42852 | 0.0 | 37.5 | 8.0 |
| 17632 | 44974 | 0.0 | 50.0 | 8.0 |
| 17635 | 41587 | 0.0 | 42.9 | 7.0 |
| 17636 | 44266 | 0.0 | 37.5 | 8.0 |
| 17637 | 44268 | 0.0 | 37.5 | 8.0 |
| 17638 | 44962 | 0.0 | 37.5 | 8.0 |
| 17643 | 44972 | 0.0 | 37.5 | 8.0 |
| 17644 | 45668 | 0.0 | 50.0 | 8.0 |
| 17652 | 41593 | 0.0 | 42.9 | 7.0 |
| 17654 | 45676 | 0.0 | 50.0 | 8.0 |
| 17657 | 42866 | 0.0 | 62.5 | 8.0 |
| 17659 | 44274 | 0.0 | 37.5 | 8.0 |
| 17663 | 42874 | 0.0 | 50.0 | 8.0 |
| 17665 | 42876 | 0.0 | 37.5 | 8.0 |
| 17669 | 42289 | 0.0 | 57.1 | 7.0 |
| 17671 | 42880 | 0.0 | 37.5 | 8.0 |
| 17672 | 43580 | 0.0 | 50.0 | 8.0 |
| 17676 | 46384 | 0.0 | 37.5 | 8.0 |
| 17679 | 45682 | 0.0 | 37.5 | 8.0 |
| 17688 | 46396 | 0.0 | 50.0 | 8.0 |
| 17693 | 38406 | 0.0 | 57.1 | 7.0 |
| 17695 | 44282 | 0.0 | 37.5 | 8.0 |
| 17696 | 46400 | 0.0 | 37.5 | 8.0 |
| 17707 | 46388 | 0.0 | 37.5 | 8.0 |
| 17712 | 38416 | 0.0 | 42.9 | 7.0 |
| 17717 | 42301 | 0.0 | 42.9 | 7.0 |
| 17718 | 44978 | 0.0 | 37.5 | 8.0 |
| 17719 | 42543 | 0.0 | 37.5 | 8.0 |
| 17722 | 42535 | 0.0 | 37.5 | 8.0 |
| 17723 | 45684 | 0.0 | 50.0 | 8.0 |
| 17727 | 44990 | 0.0 | 50.0 | 8.0 |
| 17728 | 45686 | 0.0 | 62.5 | 8.0 |
| 17729 | 46390 | 0.0 | 37.5 | 8.0 |
| 17730 | 42531 | 0.0 | 50.0 | 8.0 |
| 17736 | 43243 | 0.0 | 37.5 | 8.0 |
| 17737 | 43947 | 0.0 | 50.0 | 8.0 |
| 17739 | 46055 | 0.0 | 50.0 | 8.0 |
| 17743 | 44651 | 0.0 | 37.5 | 8.0 |
| 17746 | 45347 | 0.0 | 37.5 | 8.0 |
| 17747 | 42547 | 0.0 | 37.5 | 8.0 |
| 17748 | 39816 | 0.0 | 42.9 | 7.0 |
| 17750 | 44643 | 0.0 | 50.0 | 8.0 |
| 17753 | 42555 | 0.0 | 37.5 | 8.0 |
| 17754 | 39114 | 0.0 | 57.1 | 7.0 |
| 17760 | 43945 | 0.0 | 37.5 | 8.0 |
| 17761 | 44647 | 0.0 | 37.5 | 8.0 |
| 17766 | 45359 | 0.0 | 37.5 | 8.0 |
| 17767 | 42551 | 0.0 | 50.0 | 8.0 |
| 17771 | 46049 | 0.0 | 37.5 | 8.0 |
| 17775 | 42545 | 0.0 | 37.5 | 8.0 |
| 17777 | 43261 | 0.0 | 37.5 | 8.0 |
| 17778 | 44657 | 0.0 | 50.0 | 8.0 |
| 17783 | 43249 | 0.0 | 37.5 | 8.0 |
| 17784 | 43255 | 0.0 | 37.5 | 8.0 |
| 17786 | 43959 | 0.0 | 50.0 | 8.0 |
| 17787 | 40524 | 0.0 | 42.9 | 7.0 |
| 17791 | 40526 | 0.0 | 42.9 | 7.0 |
| 17798 | 43961 | 0.0 | 50.0 | 8.0 |
| 17804 | 44661 | 0.0 | 50.0 | 8.0 |
| 17806 | 40520 | 0.0 | 42.9 | 7.0 |
| 17809 | 46075 | 0.0 | 50.0 | 8.0 |
| 17811 | 46079 | 0.0 | 50.0 | 8.0 |
| 17812 | 45375 | 0.0 | 37.5 | 8.0 |
| 17813 | 41222 | 0.0 | 42.9 | 7.0 |
| 17816 | 45367 | 0.0 | 37.5 | 8.0 |
| 17817 | 46067 | 0.0 | 37.5 | 8.0 |
| 17821 | 41224 | 0.0 | 42.9 | 7.0 |
| 17824 | 41230 | 0.0 | 57.1 | 7.0 |
| 17826 | 39204 | 0.0 | 42.9 | 7.0 |
| 17835 | 38504 | 0.0 | 42.9 | 7.0 |
| 17840 | 40612 | 0.0 | 42.9 | 7.0 |
| 17841 | 40616 | 0.0 | 42.9 | 7.0 |
| 17844 | 40614 | 0.0 | 42.9 | 7.0 |
| 17845 | 40624 | 0.0 | 42.9 | 7.0 |
| 17849 | 39912 | 0.0 | 42.9 | 7.0 |
| 17851 | 39918 | 0.0 | 42.9 | 7.0 |
| 17858 | 39906 | 0.0 | 42.9 | 7.0 |

TABLE 136-continued

| SEQ ID NO | SpotID | T/N Colon >2x | T/N Colon <halfx | T/N Colon Num Ratios |
|---|---|---|---|---|
| 17860 | 38528 | 0.0 | 42.9 | 7.0 |
| 17865 | 39226 | 0.0 | 42.9 | 7.0 |
| 17875 | 38514 | 0.0 | 42.9 | 7.0 |
| 17878 | 38522 | 0.0 | 42.9 | 7.0 |
| 17881 | 39230 | 0.0 | 42.9 | 7.0 |
| 17882 | 39922 | 0.0 | 42.9 | 7.0 |
| 17888 | 39924 | 0.0 | 42.9 | 7.0 |
| 17896 | 39936 | 0.0 | 42.9 | 7.0 |
| 17897 | 40626 | 0.0 | 42.9 | 7.0 |
| 17903 | 41240 | 0.0 | 57.1 | 7.0 |
| 17906 | 40225 | 0.0 | 42.9 | 7.0 |
| 17912 | 41641 | 0.0 | 42.9 | 7.0 |
| 17917 | 42036 | 0.0 | 42.9 | 7.0 |
| 17919 | 41938 | 0.0 | 42.9 | 7.0 |
| 17922 | 40235 | 0.0 | 42.9 | 7.0 |
| 17925 | 38117 | 0.0 | 42.9 | 7.0 |
| 17934 | 40929 | 0.0 | 42.9 | 7.0 |
| 17936 | 41952 | 0.0 | 42.9 | 7.0 |
| 17939 | 39527 | 0.0 | 57.1 | 7.0 |
| 17940 | 39533 | 0.0 | 42.9 | 7.0 |
| 17944 | 41944 | 0.0 | 42.9 | 7.0 |
| 17947 | 42046 | 0.0 | 42.9 | 7.0 |
| 17953 | 41342 | 0.0 | 42.9 | 7.0 |
| 17954 | 39535 | 0.0 | 42.9 | 7.0 |
| 17959 | 40544 | 0.0 | 42.9 | 7.0 |
| 17960 | 38821 | 0.0 | 42.9 | 7.0 |
| 17961 | 40231 | 0.0 | 42.9 | 7.0 |
| 17962 | 41647 | 0.0 | 42.9 | 7.0 |
| 17963 | 41344 | 0.0 | 42.9 | 7.0 |
| 17967 | 38823 | 0.0 | 42.9 | 7.0 |
| 17970 | 40943 | 0.0 | 42.9 | 7.0 |
| 17978 | 38831 | 0.0 | 42.9 | 7.0 |
| 17980 | 38127 | 0.0 | 42.9 | 7.0 |
| 17982 | 42044 | 0.0 | 42.9 | 7.0 |
| 17997 | 40945 | 0.0 | 42.9 | 7.0 |
| 17998 | 40953 | 0.0 | 42.9 | 7.0 |
| 18003 | 38135 | 0.0 | 42.9 | 7.0 |
| 18005 | 40959 | 0.0 | 42.9 | 7.0 |
| 18012 | 40249 | 0.0 | 42.9 | 7.0 |
| 18024 | 39551 | 0.0 | 42.9 | 7.0 |
| 18026 | 40949 | 0.0 | 42.9 | 7.0 |
| 18028 | 41651 | 0.0 | 42.9 | 7.0 |
| 18032 | 38143 | 0.0 | 42.9 | 7.0 |
| 18033 | 38835 | 0.0 | 42.9 | 7.0 |
| 18035 | 38843 | 0.0 | 42.9 | 7.0 |
| 18050 | 41987 | 0.0 | 42.9 | 7.0 |
| 18058 | 40587 | 0.0 | 42.9 | 7.0 |
| 18062 | 39875 | 0.0 | 42.9 | 7.0 |
| 18066 | 40589 | 0.0 | 42.9 | 7.0 |
| 18067 | 38471 | 0.0 | 42.9 | 7.0 |
| 18069 | 38483 | 0.0 | 42.9 | 7.0 |
| 18071 | 41283 | 0.0 | 42.9 | 7.0 |
| 18110 | 39195 | 0.0 | 42.9 | 7.0 |
| 18111 | 39891 | 0.0 | 42.9 | 7.0 |
| 18115 | 39193 | 0.0 | 42.9 | 7.0 |
| 18120 | 39199 | 0.0 | 42.9 | 7.0 |
| 18148 | 40593 | 0.0 | 42.9 | 7.0 |
| 18153 | 40603 | 0.0 | 42.9 | 7.0 |
| 18167 | 42009 | 0.0 | 42.9 | 7.0 |
| 18175 | 39526 | 0.0 | 42.9 | 7.0 |
| 18177 | 39536 | 0.0 | 42.9 | 7.0 |
| 18183 | 40942 | 0.0 | 42.9 | 7.0 |
| 18185 | 38120 | 0.0 | 42.9 | 7.0 |
| 18189 | 40238 | 0.0 | 42.9 | 7.0 |
| 18192 | 40240 | 0.0 | 42.9 | 7.0 |
| 18194 | 39522 | 0.0 | 42.9 | 7.0 |
| 18196 | 39534 | 0.0 | 42.9 | 7.0 |
| 18198 | 42011 | 0.0 | 42.9 | 7.0 |
| 18204 | 42013 | 0.0 | 42.9 | 7.0 |
| 18214 | 38132 | 0.0 | 42.9 | 7.0 |
| 18219 | 40256 | 0.0 | 42.9 | 7.0 |
| 18225 | 42343 | 0.0 | 37.5 | 8.0 |
| 18226 | 43041 | 0.0 | 37.5 | 8.0 |
| 18227 | 38144 | 0.0 | 42.9 | 7.0 |
| 18229 | 39548 | 0.0 | 57.1 | 7.0 |
| 18233 | 38842 | 0.0 | 42.9 | 7.0 |
| 18237 | 38142 | 0.0 | 42.9 | 7.0 |
| 18240 | 38138 | 0.0 | 42.9 | 7.0 |
| 18247 | 39552 | 0.0 | 57.1 | 7.0 |
| 18253 | 39544 | 0.0 | 42.9 | 7.0 |
| 18260 | 41650 | 0.0 | 42.9 | 7.0 |
| 18261 | 40952 | 0.0 | 42.9 | 7.0 |
| 18262 | 41652 | 0.0 | 42.9 | 7.0 |
| 18268 | 38470 | 0.0 | 42.9 | 7.0 |
| 18269 | 40954 | 0.0 | 42.9 | 7.0 |
| 18278 | 43753 | 0.0 | 50.0 | 8.0 |
| 18280 | 39176 | 0.0 | 57.1 | 7.0 |
| 18283 | 39874 | 0.0 | 42.9 | 7.0 |
| 18284 | 40590 | 0.0 | 42.9 | 7.0 |
| 18290 | 40592 | 0.0 | 42.9 | 7.0 |
| 18294 | 41292 | 0.0 | 42.9 | 7.0 |
| 18302 | 39180 | 0.0 | 42.9 | 7.0 |
| 18304 | 41294 | 0.0 | 42.9 | 7.0 |
| 18313 | 39192 | 0.0 | 42.9 | 7.0 |
| 18316 | 39888 | 0.0 | 42.9 | 7.0 |
| 18317 | 40584 | 0.0 | 42.9 | 7.0 |
| 18318 | 41282 | 0.0 | 42.9 | 7.0 |
| 18319 | 41990 | 0.0 | 42.9 | 7.0 |
| 18326 | 39184 | 0.0 | 42.9 | 7.0 |
| 18328 | 44459 | 0.0 | 62.5 | 8.0 |
| 18330 | 40586 | 0.0 | 42.9 | 7.0 |
| 18331 | 41992 | 0.0 | 42.9 | 7.0 |
| 18332 | 44457 | 0.0 | 37.5 | 8.0 |
| 18335 | 40580 | 0.0 | 42.9 | 7.0 |
| 18336 | 39186 | 0.0 | 85.7 | 7.0 |
| 18337 | 43747 | 0.0 | 50.0 | 8.0 |
| 18339 | 41288 | 0.0 | 42.9 | 7.0 |
| 18340 | 41986 | 0.0 | 42.9 | 7.0 |
| 18342 | 38494 | 0.0 | 71.4 | 7.0 |
| 18343 | 39188 | 0.0 | 85.7 | 7.0 |
| 18344 | 41996 | 0.0 | 42.9 | 7.0 |
| 18349 | 40608 | 0.0 | 42.9 | 7.0 |
| 18354 | 45165 | 0.0 | 50.0 | 8.0 |
| 18357 | 41312 | 0.0 | 42.9 | 7.0 |
| 18358 | 39198 | 0.0 | 42.9 | 7.0 |
| 18360 | 41306 | 0.0 | 42.9 | 7.0 |
| 18361 | 39904 | 0.0 | 57.1 | 7.0 |
| 18364 | 45163 | 0.0 | 37.5 | 8.0 |
| 18366 | 42002 | 0.0 | 42.9 | 7.0 |
| 18370 | 41310 | 0.0 | 42.9 | 7.0 |
| 18373 | 39200 | 0.0 | 42.9 | 7.0 |
| 18376 | 42899 | 0.0 | 50.0 | 8.0 |
| 18378 | 45869 | 0.0 | 37.5 | 8.0 |
| 18380 | 42901 | 0.0 | 37.5 | 8.0 |
| 18383 | 45709 | 0.0 | 62.5 | 8.0 |
| 18390 | 42893 | 0.0 | 50.0 | 8.0 |
| 18394 | 43585 | 0.0 | 37.5 | 8.0 |
| 18398 | 43599 | 0.0 | 50.0 | 8.0 |
| 18402 | 43587 | 0.0 | 37.5 | 8.0 |
| 18403 | 44301 | 0.0 | 50.0 | 8.0 |
| 18404 | 46411 | 0.0 | 37.5 | 8.0 |
| 18405 | 42909 | 0.0 | 62.5 | 8.0 |
| 18412 | 42895 | 0.0 | 37.5 | 8.0 |
| 18413 | 44995 | 0.0 | 37.5 | 8.0 |
| 18414 | 42911 | 0.0 | 50.0 | 8.0 |
| 18416 | 45865 | 0.0 | 37.5 | 8.0 |
| 18419 | 42885 | 0.0 | 37.5 | 8.0 |
| 18422 | 42887 | 0.0 | 50.0 | 8.0 |
| 18424 | 45705 | 0.0 | 37.5 | 8.0 |
| 18429 | 42012 | 0.0 | 42.9 | 7.0 |
| 18432 | 43593 | 0.0 | 37.5 | 8.0 |
| 18438 | 42905 | 0.0 | 37.5 | 8.0 |
| 18439 | 44303 | 0.0 | 50.0 | 8.0 |
| 18446 | 45697 | 0.0 | 50.0 | 8.0 |
| 18458 | 44305 | 0.0 | 62.5 | 8.0 |
| 18459 | 43609 | 0.0 | 37.5 | 8.0 |
| 18461 | 45009 | 0.0 | 50.0 | 8.0 |
| 18465 | 44317 | 0.0 | 50.0 | 8.0 |
| 18466 | 45719 | 0.0 | 37.5 | 8.0 |
| 18467 | 43761 | 0.0 | 50.0 | 8.0 |
| 18468 | 46431 | 0.0 | 50.0 | 8.0 |
| 18470 | 44311 | 0.0 | 62.5 | 8.0 |
| 18473 | 45017 | 0.0 | 50.0 | 8.0 |
| 18474 | 46421 | 0.0 | 50.0 | 8.0 |

TABLE 136-continued

| SEQ ID NO | SpotID | T/N Colon >2x | T/N Colon <halfx | T/N Colon Num Ratios |
|---|---|---|---|---|
| 18475 | 44313 | 0.0 | 50.0 | 8.0 |
| 18477 | 45019 | 0.0 | 37.5 | 8.0 |
| 18479 | 46417 | 0.0 | 37.5 | 8.0 |
| 18481 | 46423 | 0.0 | 37.5 | 8.0 |
| 18486 | 45713 | 0.0 | 37.5 | 8.0 |
| 18488 | 46425 | 0.0 | 37.5 | 8.0 |
| 18490 | 45013 | 0.0 | 37.5 | 8.0 |
| 18492 | 44319 | 0.0 | 37.5 | 8.0 |
| 18493 | 45723 | 0.0 | 37.5 | 8.0 |
| 18494 | 46427 | 0.0 | 37.5 | 8.0 |
| 18495 | 42534 | 0.0 | 37.5 | 8.0 |
| 18501 | 43938 | 0.0 | 37.5 | 8.0 |
| 18506 | 43950 | 0.0 | 37.5 | 8.0 |
| 18507 | 45360 | 0.0 | 37.5 | 8.0 |
| 18508 | 43944 | 0.0 | 37.5 | 8.0 |
| 18514 | 45348 | 0.0 | 37.5 | 8.0 |
| 18517 | 46052 | 0.0 | 37.5 | 8.0 |
| 18522 | 43946 | 0.0 | 37.5 | 8.0 |
| 18524 | 43236 | 0.0 | 37.5 | 8.0 |
| 18529 | 44650 | 0.0 | 37.5 | 8.0 |
| 18531 | 43242 | 0.0 | 50.0 | 8.0 |
| 18534 | 43244 | 0.0 | 50.0 | 8.0 |
| 18539 | 46056 | 0.0 | 50.0 | 8.0 |
| 18540 | 42556 | 0.0 | 37.5 | 8.0 |
| 18541 | 43262 | 0.0 | 50.0 | 8.0 |
| 18545 | 45169 | 0.0 | 37.5 | 8.0 |
| 18550 | 42550 | 0.0 | 37.5 | 8.0 |
| 18553 | 42552 | 0.0 | 37.5 | 8.0 |
| 18554 | 43966 | 0.0 | 50.0 | 8.0 |
| 18571 | 43968 | 0.0 | 37.5 | 8.0 |
| 18572 | 42554 | 0.0 | 50.0 | 8.0 |
| 18581 | 44660 | 0.0 | 37.5 | 8.0 |
| 18582 | 45362 | 0.0 | 37.5 | 8.0 |
| 18586 | 45376 | 0.0 | 62.5 | 8.0 |
| 18591 | 45364 | 0.0 | 37.5 | 8.0 |
| 18594 | 45374 | 0.0 | 37.5 | 8.0 |
| 18595 | 46066 | 0.0 | 37.5 | 8.0 |
| 18598 | 45368 | 0.0 | 37.5 | 8.0 |
| 18599 | 46078 | 0.0 | 50.0 | 8.0 |
| 18603 | 44668 | 0.0 | 50.0 | 8.0 |
| 18604 | 45370 | 0.0 | 37.5 | 8.0 |
| 18609 | 43592 | 0.0 | 37.5 | 8.0 |
| 18610 | 45875 | 0.0 | 37.5 | 8.0 |
| 18611 | 46068 | 0.0 | 75.0 | 8.0 |
| 18613 | 42882 | 0.0 | 37.5 | 8.0 |
| 18619 | 43588 | 0.0 | 37.5 | 8.0 |
| 18628 | 44296 | 0.0 | 37.5 | 8.0 |
| 18629 | 43401 | 0.0 | 50.0 | 8.0 |
| 18631 | 44298 | 0.0 | 37.5 | 8.0 |
| 18632 | 45710 | 0.0 | 50.0 | 8.0 |
| 18636 | 45008 | 0.0 | 50.0 | 8.0 |
| 18637 | 42910 | 0.0 | 62.5 | 8.0 |
| 18638 | 43596 | 0.0 | 75.0 | 8.0 |
| 18639 | 45706 | 0.0 | 37.5 | 8.0 |
| 18645 | 46410 | 0.0 | 37.5 | 8.0 |
| 18648 | 44994 | 0.0 | 50.0 | 8.0 |
| 18652 | 45708 | 0.0 | 50.0 | 8.0 |
| 18656 | 46416 | 0.0 | 37.5 | 8.0 |
| 18657 | 42912 | 0.0 | 37.5 | 8.0 |
| 18661 | 42902 | 0.0 | 37.5 | 8.0 |
| 18663 | 44300 | 0.0 | 37.5 | 8.0 |
| 18666 | 42904 | 0.0 | 50.0 | 8.0 |
| 18667 | 43598 | 0.0 | 50.0 | 8.0 |
| 18676 | 42906 | 0.0 | 50.0 | 8.0 |
| 18678 | 42695 | 0.0 | 37.5 | 8.0 |
| 18679 | 46404 | 0.0 | 37.5 | 8.0 |
| 18680 | 42898 | 0.0 | 50.0 | 8.0 |
| 18684 | 45885 | 0.0 | 37.5 | 8.0 |
| 18693 | 42908 | 0.0 | 37.5 | 8.0 |
| 18694 | 44292 | 0.0 | 37.5 | 8.0 |
| 18700 | 46412 | 0.0 | 37.5 | 8.0 |
| 18701 | 44306 | 0.0 | 37.5 | 8.0 |
| 18703 | 43614 | 0.0 | 37.5 | 8.0 |
| 18705 | 43616 | 0.0 | 37.5 | 8.0 |
| 18708 | 43612 | 0.0 | 50.0 | 8.0 |
| 18716 | 43606 | 0.0 | 87.5 | 8.0 |
| 18717 | 43610 | 0.0 | 50.0 | 8.0 |
| 18719 | 43602 | 0.0 | 37.5 | 8.0 |
| 18722 | 45714 | 0.0 | 37.5 | 8.0 |
| 18723 | 43604 | 0.0 | 50.0 | 8.0 |
| 18729 | 45018 | 0.0 | 50.0 | 8.0 |
| 18745 | 45718 | 0.0 | 37.5 | 8.0 |
| 18802 | 46418 | 0.0 | 37.5 | 8.0 |
| 18875 | 46215 | 0.0 | 37.5 | 8.0 |
| 18956 | 45529 | 0.0 | 37.5 | 8.0 |
| 18973 | 46229 | 0.0 | 37.5 | 8.0 |
| 18974 | 45533 | 0.0 | 50.0 | 8.0 |
| 18996 | 43756 | 0.0 | 50.0 | 8.0 |
| 19001 | 43758 | 0.0 | 62.5 | 8.0 |
| 19072 | 46222 | 0.0 | 37.5 | 8.0 |
| 19083 | 46212 | 0.0 | 37.5 | 8.0 |
| 19119 | 42718 | 0.0 | 37.5 | 8.0 |
| 19135 | 42710 | 0.0 | 37.5 | 8.0 |
| 19166 | 43424 | 0.0 | 37.5 | 8.0 |
| 19183 | 44822 | 0.0 | 37.5 | 8.0 |
| 19201 | 44818 | 0.0 | 50.0 | 8.0 |
| 19235 | 45860 | 0.0 | 50.0 | 8.0 |
| 19247 | 45858 | 0.0 | 37.5 | 8.0 |
| 19258 | 42356 | 0.0 | 37.5 | 8.0 |
| 19259 | 42364 | 0.0 | 37.5 | 8.0 |
| 19268 | 45862 | 0.0 | 37.5 | 8.0 |
| 19286 | 43064 | 0.0 | 37.5 | 8.0 |
| 19326 | 45170 | 0.0 | 37.5 | 8.0 |
| 19329 | 43768 | 0.0 | 50.0 | 8.0 |
| 19346 | 43776 | 0.0 | 50.0 | 8.0 |
| 19349 | 45176 | 0.0 | 50.0 | 8.0 |
| 19378 | 42698 | 0.0 | 50.0 | 8.0 |
| 19383 | 45184 | 0.0 | 37.5 | 8.0 |
| 19395 | 45878 | 0.0 | 37.5 | 8.0 |
| 19402 | 45884 | 0.0 | 37.5 | 8.0 |
| 19428 | 46020 | 0.0 | 37.5 | 8.0 |
| 19429 | 46032 | 0.0 | 50.0 | 8.0 |
| 19432 | 46026 | 0.0 | 37.5 | 8.0 |
| 19433 | 42516 | 0.0 | 50.0 | 8.0 |
| 19447 | 44117 | 0.0 | 50.0 | 8.0 |
| 19453 | 42719 | 0.0 | 50.0 | 8.0 |
| 19504 | 43423 | 0.0 | 50.0 | 8.0 |
| 19565 | 46233 | 0.0 | 37.5 | 8.0 |
| 19585 | 43054 | 0.0 | 50.0 | 8.0 |
| 19586 | 42352 | 0.0 | 37.5 | 8.0 |
| 19595 | 43746 | 0.0 | 50.0 | 8.0 |
| 19603 | 42366 | 0.0 | 50.0 | 8.0 |
| 19640 | 40101 | 0.0 | 42.9 | 7.0 |
| 19646 | 39407 | 0.0 | 42.9 | 7.0 |
| 19688 | 38695 | 0.0 | 42.9 | 7.0 |
| 19692 | 40107 | 0.0 | 42.9 | 7.0 |
| 19701 | 39401 | 0.0 | 42.9 | 7.0 |
| 19706 | 39405 | 0.0 | 42.9 | 7.0 |
| 19713 | 38697 | 0.0 | 42.9 | 7.0 |
| 19826 | 42213 | 0.0 | 42.9 | 7.0 |
| 19860 | 38717 | 0.0 | 42.9 | 7.0 |
| 19871 | 38719 | 0.0 | 42.9 | 7.0 |
| 19909 | 38707 | 0.0 | 42.9 | 7.0 |
| 19924 | 38713 | 0.0 | 42.9 | 7.0 |
| 19945 | 39419 | 0.0 | 42.9 | 7.0 |
| 20018 | 42274 | 0.0 | 42.9 | 7.0 |
| 20029 | 38772 | 0.0 | 42.9 | 7.0 |
| 20031 | 42286 | 0.0 | 42.9 | 7.0 |
| 20035 | 38770 | 0.0 | 42.9 | 7.0 |
| 20045 | 42282 | 0.0 | 42.9 | 7.0 |
| 20049 | 42284 | 0.0 | 42.9 | 7.0 |
| 20087 | 38774 | 0.0 | 42.9 | 7.0 |
| 20114 | 40313 | 0.0 | 42.9 | 7.0 |
| 20121 | 45625 | 0.0 | 50.0 | 8.0 |
| 20127 | 41005 | 0.0 | 42.9 | 7.0 |
| 20130 | 38203 | 0.0 | 42.9 | 7.0 |
| 20135 | 46325 | 0.0 | 37.5 | 8.0 |
| 20136 | 39611 | 0.0 | 42.9 | 7.0 |
| 20137 | 40309 | 0.0 | 57.1 | 7.0 |
| 20143 | 45619 | 0.0 | 37.5 | 8.0 |
| 20153 | 41697 | 0.0 | 42.9 | 7.0 |
| 20156 | 38899 | 0.0 | 42.9 | 7.0 |
| 20160 | 38903 | 0.0 | 42.9 | 7.0 |
| 20161 | 41003 | 0.0 | 42.9 | 7.0 |

TABLE 136-continued

| SEQ ID NO | SpotID | T/N Colon >2x | T/N Colon <halfx | T/N Colon Num Ratios |
|---|---|---|---|---|
| 20163 | 40995 | 0.0 | 42.9 | 7.0 |
| 20165 | 46321 | 0.0 | 37.5 | 8.0 |
| 20167 | 41017 | 0.0 | 42.9 | 7.0 |
| 20172 | 42474 | 0.0 | 50.0 | 8.0 |
| 20185 | 42478 | 0.0 | 37.5 | 8.0 |
| 20187 | 41015 | 0.0 | 42.9 | 7.0 |
| 20202 | 41713 | 0.0 | 42.9 | 7.0 |
| 20204 | 42480 | 0.0 | 37.5 | 8.0 |
| 20207 | 43886 | 0.0 | 37.5 | 8.0 |
| 20218 | 43888 | 0.0 | 37.5 | 8.0 |
| 20230 | 44586 | 0.0 | 37.5 | 8.0 |
| 20242 | 43188 | 0.0 | 37.5 | 8.0 |
| 20244 | 45304 | 0.0 | 62.5 | 8.0 |
| 20253 | 45996 | 0.0 | 37.5 | 8.0 |
| 20265 | 46016 | 0.0 | 37.5 | 8.0 |
| 20267 | 43198 | 0.0 | 37.5 | 8.0 |
| 20269 | 44606 | 0.0 | 50.0 | 8.0 |
| 20272 | 42496 | 0.0 | 50.0 | 8.0 |
| 20275 | 43900 | 0.0 | 37.5 | 8.0 |
| 20276 | 44608 | 0.0 | 37.5 | 8.0 |
| 20278 | 43902 | 0.0 | 75.0 | 8.0 |
| 20280 | 46006 | 0.0 | 37.5 | 8.0 |
| 20283 | 43192 | 0.0 | 37.5 | 8.0 |
| 20286 | 42490 | 0.0 | 37.5 | 8.0 |
| 20289 | 43896 | 0.0 | 37.5 | 8.0 |
| 20295 | 42492 | 0.0 | 37.5 | 8.0 |
| 20297 | 46008 | 0.0 | 50.0 | 8.0 |
| 20307 | 39941 | 0.0 | 42.9 | 7.0 |
| 20314 | 42053 | 0.0 | 42.9 | 7.0 |
| 20331 | 38541 | 0.0 | 42.9 | 7.0 |
| 20333 | 42055 | 0.0 | 42.9 | 7.0 |
| 20340 | 39241 | 0.0 | 42.9 | 7.0 |
| 20361 | 40647 | 0.0 | 42.9 | 7.0 |
| 20374 | 41355 | 0.0 | 42.9 | 7.0 |
| 20376 | 39261 | 0.0 | 42.9 | 7.0 |
| 20385 | 39967 | 0.0 | 42.9 | 7.0 |
| 20387 | 38559 | 0.0 | 42.9 | 7.0 |
| 20390 | 40663 | 0.0 | 42.9 | 7.0 |
| 20393 | 40669 | 0.0 | 42.9 | 7.0 |
| 20398 | 39263 | 0.0 | 42.9 | 7.0 |
| 20411 | 44930 | 0.0 | 37.5 | 8.0 |
| 20414 | 42071 | 0.0 | 42.9 | 7.0 |
| 20415 | 45638 | 0.0 | 37.5 | 8.0 |
| 20418 | 44228 | 0.0 | 37.5 | 8.0 |
| 20419 | 41371 | 0.0 | 42.9 | 7.0 |
| 20424 | 45640 | 0.0 | 50.0 | 8.0 |
| 20425 | 44163 | 0.0 | 37.5 | 8.0 |
| 20426 | 44171 | 0.0 | 37.5 | 8.0 |
| 20429 | 42818 | 0.0 | 50.0 | 8.0 |
| 20430 | 45634 | 0.0 | 50.0 | 8.0 |
| 20431 | 45644 | 0.0 | 50.0 | 8.0 |
| 20437 | 43471 | 0.0 | 37.5 | 8.0 |
| 20438 | 43536 | 0.0 | 62.5 | 8.0 |
| 20443 | 44944 | 0.0 | 37.5 | 8.0 |
| 20444 | 45646 | 0.0 | 37.5 | 8.0 |
| 20447 | 44238 | 0.0 | 37.5 | 8.0 |
| 20448 | 44936 | 0.0 | 50.0 | 8.0 |
| 20451 | 44161 | 0.0 | 37.5 | 8.0 |
| 20459 | 44938 | 0.0 | 50.0 | 8.0 |
| 20460 | 45636 | 0.0 | 50.0 | 8.0 |
| 20467 | 44804 | 0.0 | 37.5 | 8.0 |
| 20473 | 44100 | 0.0 | 50.0 | 8.0 |
| 20534 | 46230 | 0.0 | 37.5 | 8.0 |
| 20537 | 45532 | 0.0 | 37.5 | 8.0 |
| 20547 | 45526 | 0.0 | 50.0 | 8.0 |
| 20563 | 45536 | 0.0 | 37.5 | 8.0 |
| 20583 | 41535 | 0.0 | 42.9 | 7.0 |
| 20584 | 40123 | 0.0 | 57.1 | 7.0 |
| 20590 | 41525 | 0.0 | 42.9 | 7.0 |
| 20601 | 40817 | 0.0 | 42.9 | 7.0 |
| 20610 | 40821 | 0.0 | 42.9 | 7.0 |
| 20619 | 41529 | 0.0 | 42.9 | 7.0 |
| 20622 | 40825 | 0.0 | 42.9 | 7.0 |
| 20635 | 41527 | 0.0 | 42.9 | 7.0 |
| 20686 | 41527 | 0.0 | 42.9 | 7.0 |
| 20708 | 40823 | 0.0 | 42.9 | 7.0 |
| 20717 | 38758 | 0.0 | 57.1 | 7.0 |
| 20719 | 42229 | 0.0 | 42.9 | 7.0 |
| 20733 | 38764 | 0.0 | 42.9 | 7.0 |
| 20744 | 42235 | 0.0 | 42.9 | 7.0 |
| 20758 | 42239 | 0.0 | 42.9 | 7.0 |
| 20825 | 39472 | 0.0 | 42.9 | 7.0 |
| 20912 | 40868 | 0.0 | 57.1 | 7.0 |
| 20928 | 40866 | 0.0 | 42.9 | 7.0 |
| 20940 | 41576 | 0.0 | 42.9 | 7.0 |
| 20968 | 40870 | 0.0 | 42.9 | 7.0 |
| 21055 | 39488 | 0.0 | 42.9 | 7.0 |
| 21107 | 40888 | 0.0 | 42.9 | 7.0 |
| 21130 | 40886 | 0.0 | 42.9 | 7.0 |
| 21140 | 40890 | 0.0 | 42.9 | 7.0 |
| 21155 | 41588 | 0.0 | 42.9 | 7.0 |
| 21176 | 41596 | 0.0 | 42.9 | 7.0 |
| 21218 | 42290 | 0.0 | 42.9 | 7.0 |
| 21242 | 43118 | 0.0 | 50.0 | 8.0 |
| 21290 | 43114 | 0.0 | 62.5 | 8.0 |
| 21331 | 45220 | 0.0 | 37.5 | 8.0 |
| 21350 | 44518 | 0.0 | 37.5 | 8.0 |
| 21529 | 43120 | 0.0 | 37.5 | 8.0 |
| 21549 | 43812 | 0.0 | 50.0 | 8.0 |
| 21586 | 43810 | 0.0 | 50.0 | 8.0 |
| 21633 | 45224 | 0.0 | 50.0 | 8.0 |
| 21639 | 45226 | 0.0 | 37.5 | 8.0 |
| 21655 | 45922 | 0.0 | 37.5 | 8.0 |
| 21661 | 43265 | 0.0 | 37.5 | 8.0 |
| 21691 | 42573 | 0.0 | 37.5 | 8.0 |
| 21714 | 45232 | 0.0 | 37.5 | 8.0 |
| 21742 | 41161 | 0.0 | 71.4 | 7.0 |
| 21753 | 41163 | 0.0 | 42.9 | 7.0 |
| 21802 | 44591 | 0.0 | 50.0 | 8.0 |
| 21805 | 43189 | 0.0 | 37.5 | 8.0 |
| 21807 | 45293 | 0.0 | 37.5 | 8.0 |
| 21808 | 42487 | 0.0 | 37.5 | 8.0 |
| 21811 | 43191 | 0.0 | 37.5 | 8.0 |
| 21815 | 38917 | 0.0 | 42.9 | 7.0 |
| 21819 | 38913 | 0.0 | 42.9 | 7.0 |
| 21826 | 41875 | 0.0 | 42.9 | 7.0 |
| 21827 | 45987 | 0.0 | 37.5 | 8.0 |
| 21837 | 45289 | 0.0 | 37.5 | 8.0 |
| 21838 | 45989 | 0.0 | 50.0 | 8.0 |
| 21969 | 44537 | 0.0 | 50.0 | 8.0 |
| 16070 | 44681 | 12.5 | 37.5 | 8.0 |
| 16076 | 43981 | 12.5 | 50.0 | 8.0 |
| 16068 | 44675 | 37.5 | 0.0 | 8.0 |
| 16094 | 42428 | 37.5 | 0.0 | 8.0 |
| 19238 | 45866 | 37.5 | 0.0 | 8.0 |
| 17843 | 39216 | 42.9 | 0.0 | 7.0 |
| 18039 | 41657 | 42.9 | 0.0 | 7.0 |
| 21138 | 40188 | 42.9 | 0.0 | 7.0 |
| 16006 | 44200 | 50.0 | 0.0 | 8.0 |
| 19609 | 43404 | 50.0 | 0.0 | 8.0 |
| 16590 | 42108 | 57.1 | 0.0 | 7.0 |
| 20674 | 40125 | 57.1 | 0.0 | 7.0 |
| 17581 | 44634 | 62.5 | 0.0 | 8.0 |
| 17508 | 46399 | 71.4 | 0.0 | 7.0 |
| 17968 | 38827 | 71.4 | 0.0 | 7.0 |
| 16007 | 44202 | 75.0 | 0.0 | 8.0 |
| 17965 | 41244 | 85.7 | 0.0 | 7.0 |
| 16108 | 43970 | 87.5 | 0.0 | 8.0 |
| 16104 | 43972 | 100.0 | 0.0 | 8.0 |

Table 137 below provides the data for differential expression analysis on the arrays using samples from metastasized colon tissue. In this example, the samples used for hybridization sequences on the microarray were derived from the matched metastasized (MT) colon tissue and normal (N) colon tissues of the patients. Table 137 includes: 1) the SEQ ID NO: 2) the percentage of patients tested in which expression levels of the gene (as detected using the corresponding clone) was at least 2-fold greater in metastasized cancerous colon tissue (MT) than in matched normal tissue ("Colon>2× MT/N"); 5) the percentage of patients tested in which expression levels of the gene was less than or equal to one-half of the expression level in matched normal cells ("Colon<=halfxT/N"); and 8) the colon number ratios, indicating the number of patients upon which the provided ratios was based. The corresponding data with the same sequence of the colon tumor tissue versus matched normal colon tissue (T/N) are provided for convenience in comparison.

Methods for analysis using antisense technology are well known in the art. For example, a number of different oligonucleotides complementary to the mRNA generated by the differentially expressed genes identified herein can be designed as antisense oligonucleotides, and tested for their ability to suppress expression of the genes. Sets of antisense

TABLE 137

Polynucleotides Corresponding to Differnetially Expressed Genes in Metastasized Colon Cancer Tissue

| SEQ ID NO | Colon MT/N > 2x | Colon MT/N < halfx | Colon MT/N Num Ratios by Clone | Colon T/N > 2x | Colon T/N < halfx | Colon T/N Num Ratios |
|---|---|---|---|---|---|---|
| 16207 | 40.0 | 0.0 | 5.0 | 0.0 | 50.0 | 8.0 |
| 16314 | 0.0 | 40.0 | 5.0 | 0.0 | 37.5 | 8.0 |
| 17643 | 0.0 | 40.0 | 5.0 | 0.0 | 37.5 | 8.0 |
| 17962 | 40.0 | 0.0 | 5.0 | 0.0 | 42.9 | 7.0 |
| 18336 | 20.0 | 40.0 | 5.0 | 0.0 | 85.7 | 7.0 |
| 18342 | 20.0 | 80.0 | 5.0 | 0.0 | 71.4 | 7.0 |
| 18343 | 20.0 | 40.0 | 5.0 | 0.0 | 85.7 | 7.0 |
| 18637 | 0.0 | 40.0 | 5.0 | 0.0 | 62.5 | 8.0 |
| 21331 | 0.0 | 40.0 | 5.0 | 0.0 | 37.5 | 8.0 |

Table 138 below provides the data for differential expression analysis on the arrays using samples from matched cancerous and normal prostate tissue (PT/N). Table 138 includes: 1) the SEQ ID NO; 2) the percentage of patients tested in which expression levels of the gene (as detected using the corresponding clone) was at least 2-fold greater in metastasized cancerous prostate tissue (PT) than in matched normal tissue ("Colon>2xPT/N"); 3) the percentage of patients tested in which expression levels of the gene was less than or equal to one-half of the expression level in matched normal cells ("Colon<=halfxPT/N"); and 4) the prostate PT/N number ratios, indicating the number of patients upon which the provided ratios was based. The corresponding data with the same sequences for the colon tumor versus normal (T/N) and metastasized colon tissue versus normal (MT/N) are provided for convenience in comparison.

oligomers specific to each candidate target are designed using the sequences of the polynucleotides corresponding to a differentially expressed gene and the software program HYB-simulator Version 4 (available for Windows 95/Windows NT or for Power Macintosh, RNAture, Inc. 1003 Health Sciences Road, West, Irvine, Calif. 92612 USA). Factors considered when designing antisense oligonucleotides include: 1) the secondary structure of oligonucleotides; 2) the secondary structure of the target gene; 3) the specificity with no or minimum cross-hybridization to other expressed genes; 4) stability; 5) length and 6) terminal GC content. The antisense oligonucleotide is designed to so that it will hybridize to its target sequence under conditions of high stringency at physiological temperatures (e.g., an optimal temperature for the cells in culture to provide for hybridization in the cell, e.g., about 37° C.), but with minimal formation of homodimers.

TABLE 138

Polynucleotides Corresponding to Differnetially Expressed Genes in Prostate Cancer Tissue

| SEQ ID NO | Prostate (PT/N) > 2x | Prostate (PT/N) < halfx | Prostate (PT/N) Num Ratios | Colon T/N > 2x | Colon T/N < halfx | Colon T/N Num Ratios | Colon MT/N > 2x | Colon MT/N < halfx | Colon MT/N Num Ratios |
|---|---|---|---|---|---|---|---|---|---|
| 16129 | 11.1 | 33.3 | 9.0 | 0.0 | 50.0 | 8.0 | | | |
| 16480 | 37.5 | 12.5 | 8.0 | 0.0 | 71.4 | 7.0 | | | |
| 16619 | 33.3 | 11.1 | 9.0 | | | | | | |
| 16634 | 12.5 | 37.5 | 8.0 | 0.0 | 42.9 | 7.0 | | | |
| 17664 | 33.3 | 0.0 | 9.0 | | | | | | |
| 18336 | 37.5 | 25.0 | 8.0 | 0.0 | 85.7 | 7.0 | 20.0 | 40.0 | 5.0 |
| 18342 | 37.5 | 12.5 | 8.0 | 0.0 | 71.4 | 7.0 | 20.0 | 80.0 | 5.0 |
| 18410 | 22.2 | 33.3 | 9.0 | | | | | | |
| 19286 | 33.3 | 0.0 | 9.0 | 0.0 | 37.5 | 8.0 | | | |

Example 86

Antisense Regulation of Gene Expression

The expression of the differentially expressed genes represented by the polynucleotides in the cancerous cells can be further analyzed using antisense knockout technology to confirm the role and function of the gene product in tumorigenesis, e.g., in promoting a metastatic phenotype.

Once synthesized and quantitated, the oligomers are screened for efficiency of a transcript knock-out in a panel of cancer cell lines. The efficiency of the knock-out is determined by analyzing mRNA levels using lightcycler quantification. The oligomers that resulted in the highest level of transcript knock-out, wherein the level was at least about 50%, preferably about 80-90%, up to 95% or more up to undetectable message, are selected for use in a cell-based proliferation assay, an anchorage independent growth assay, and an apoptosis assay.

For example, where the polynucleotide is identified as having a role in colon cancer, the ability of the corresponding designed antisense oligonucleotide to inhibit gene expression is tested through transfection into SW620 colon colorectal carcinoma cells. For each transfection mixture, a carrier molecule, preferably a lipitoid or cholesteroid, is prepared to a working concentration of 0.5 mM in water, sonicated to yield a uniform solution, and filtered through a 0.45 μm PVDF membrane. The antisense or control oligonucleotide is then prepared to a working concentration of 100 μM in sterile Millipore water. The oligonucleotide is further diluted in OptiMEM™ (Gibco/BRL), in a microfuge tube, to 2 μM, or approximately 20 μg oligo/ml of OptiMEM™. In a separate microfuge tube, lipitoid or cholesteroid, typically in the amount of about 1.5-2 nmol lipitoid/μg antisense oligonucleotide, is diluted into the same volume of OptiMEM™ used to dilute the oligonucleotide. The diluted antisense oligonucleotide is immediately added to the diluted lipitoid and mixed by pipetting up and down. Oligonucleotide is added to the cells to a final concentration of 30 nM.

The level of target mRNA that corresponds to a target gene of interest in the transfected cells is quantitated in the cancer cell lines using the Roche LightCycler™ real-time PCR machine. Values for the target mRNA are normalized versus an internal control (e.g., beta-actin). For each 20 μl reaction, extracted RNA (generally 0.2-1 μg total) is placed into a sterile 0.5 or 1.5 ml microcentrifuge tube, and water added to a total volume of 12.5 μl. To each tube 7.5 μl of a buffer/enzyme mixture is added, which is prepared by mixing (in the order listed) 2.5 μl H$_2$O, 2.0 μl 10× reaction buffer, 10 μl oligo dT (20 pmol), 1.0 μl dNTP mix (10 mM each), 0.5 μl RNA-sin® (20 u) (Ambion, Inc., Hialeah, Fla.), and 0.5 μl MMLV reverse transcriptase (50 u) (Ambion, Inc.). The contents are mixed by pipetting up and down, and the reaction mixture incubated at 42° C. for 1 hour. The contents of each tube are centrifuged prior to amplification.

An amplification mixture is prepared by mixing in the following order: 1×PCR buffer II, 3 mM MgCl$_2$, 140 μM each dNTP, 0.175 pmol each oligo, 1:50,000 dil of SYBR® Green, 0.25 mg/ml BSA, 1 unit Taq polymerase, and H$_2$O to 20 μl. (PCR buffer II is available in 10× concentration from Perkin-Elmer, Norwalk, Conn.). In 1× concentration it contains 10 mM Tris pH 8.3 and 50 mM KCl. SYBR® Green (Molecular Probes, Eugene, Oreg.) is a dye which fluoresces when bound to double stranded DNA. As double stranded PCR product is produced during amplification, the fluorescence from SYBR® Green increases. To each 20 μl aliquot of amplification mixture, 2 μl of template RT are added, and amplification carried out according to standard protocols.

The results can be expressed as the percent decrease in expression of the corresponding gene product relative to non-transfected cells, vehicle-only transfected (mock-transfected) cells, or cells transfected with reverse control oligonucleotides.

Example 87

Effect of Expression on Proliferation

The effect of gene expression on the inhibition of cell proliferation can be assessed in, for example, metastatic breast cancer cell lines (MDA-MB-231 ("231")), SW620 colon colorectal carcinoma cells, or SKOV3 cells (a human ovarian carcinoma cell line).

Cells are plated to approximately 60-80% confluency in 96-well dishes. Antisense or reverse control oligonucleotide is diluted to 2 μM in OptiMEM™ and added to OptiMEM™ into which the delivery vehicle, lipitoid 116-6 in the case of SW620 cells or 1:1 lipitoid 1:cholesteroid 1 in the case of MDA-MB-231 cells, had been diluted. The oligo/delivery vehicle mixture is then further diluted into medium with serum on the cells. The final concentration of oligonucleotide for all experiments was 300 nM, and the final ratio of oligo to delivery vehicle for all experiments is 1.5 nmol lipitoid/μg oligonucleotide.

Antisense oligonucleotides are prepared as described above (see Example 86). Cells are transfected overnight at 37° C. and the transfection mixture replaced with fresh medium the next morning. Transfection is carried out as described above in Example 83.

Those antisense oligonucleotides that inhibit proliferation represent genes that play a role in production or maintenance of the cancerous phenotype.

Example 88

Effect of Gene Expression on Colony Formation

The effect of gene expression upon colony formation of, for example, SW620 cells, SKOV3 cells, and MD-MBA-231 cells can be tested in a soft agar assay. Soft agar assays are conducted by first establishing a bottom layer of 2 ml of 0.6% agar in media plated fresh within a few hours of layering on the cells. The cell layer is formed on the bottom layer by removing cells transfected as described above from plates using 0.05% trypsin and washing twice in media. The cells are counted in a Coulter counter, and resuspended to 106 per ml in media. 10 μl aliquots are placed with media in 96-well plates (to check counting with WST1), or diluted further for the soft agar assay. 2000 cells are plated in 800 μl 0.4% agar in duplicate wells above 0.6% agar bottom layer. After the cell layer agar solidifies, 2 ml of media is dribbled on top and antisense or reverse control oligo (produced as described in Example 86) added without delivery vehicles. Fresh media and oligos are added every 3-4 days. Colonies usually are expected to form in 10 days to 3 weeks. Fields of colonies are counted by eye. Wst-1 metabolism values can be used to compensate for small differences in starting cell number. Larger fields can be scanned for visual record of differences.

Those antisense oligonucleotides that inhibited colony formation represent genes that play a role in production or maintenance of the cancerous phenotype.

Example 89

Induction of Cell Death Upon Depletion of Polypeptides by Depletion of mRNA ("Antisense Knockout")

In order to assess the effect of depletion of a target message upon cell death, SW620 cells, or other cells derived from a cancer of interest, are transfected for proliferation assays. For cytotoxic effect in the presence of cisplatin (cis), the same protocol is followed but cells are left in the presence of 2 μM drug. Each day, cytotoxicity was monitored by measuring the amount of LDH enzyme released in the medium due to membrane damage. The activity of LDH is measured using the Cytotoxicity Detection Kit from Roche Molecular Biochemicals. The data is provided as a ratio of LDH released in the medium vs. the total LDH present in the well at the same time point and treatment (rLDH/tLDH). A positive control using antisense and reverse control oligonucleotides for BCL2 (a known anti-apoptotic gene) is included; loss of message for BCL2 leads to an increase in cell death compared with treatment with the control oligonucleotide (background cytotoxicity due to transfection).

Example 90

Functional Analysis of Gene Products Differentially Expressed in Cancer

The gene products of sequences of a gene differentially expressed in cancerous cells can be further analyzed to confirm the role and function of the gene product in tumorigenesis, e.g., in promoting or inhibiting development of a metastatic phenotype. For example, the function of gene products corresponding to genes identified herein can be assessed by blocking function of the gene products in the cell. For example, where the gene product is secreted or associated with a cell surface membrane, blocking antibodies can be generated and added to cells to examine the effect upon the cell phenotype in the context of, for example, the transformation of the cell to a cancerous, particularly a metastatic, phenotype.

Where the gene product of the differentially expressed genes identified herein exhibits sequence homology to a protein of known function (e.g., to a specific kinase or protease) and/or to a protein family of known function (e.g., contains a domain or other consensus sequence present in a protease family or in a kinase family), then the role of the gene product in tumorigenesis, as well as the activity of the gene product, can be examined using small molecules that inhibit or enhance function of the corresponding protein or protein family.

Additional functional assays include, but are not necessarily limited to, those that analyze the effect of expression of the corresponding gene upon cell cycle and cell migration. Methods for performing such assays are well known in the art.

Example 91

Contig Assembly and Additional Gene Characterization

The sequences of the polynucleotides provided in the present invention can be used to extend the sequence information of the gene to which the polynucleotides correspond (e.g., a gene, or mRNA encoded by the gene, having a sequence of the polynucleotide described herein). This expanded sequence information can in turn be used to further characterize the corresponding gene, which in turn provides additional information about the nature of the gene product (e.g., the normal function of the gene product). The additional information can serve to provide additional evidence of the gene product's use as a therapeutic target, and provide further guidance as to the types of agents that can modulate its activity.

For example, a contig can be assembled using the sequence of a polynucleotide described herein. A "contig" is a contiguous sequence of nucleotides that is assembled from nucleic acid sequences having overlapping (e.g., shared or substantially similar) sequence information. The sequences of publicly-available ESTs (Expressed Sequence Tags) and the sequences of various clones from several cDNA libraries synthesized at Chiron were used in the contig assembly. The contig is assembled using the software program Sequencher, version 4.05, according to the manufacturer's instructions.

The resulting contig can then be used to search both the public databases as well as databases internal to the applicants to match the polynucleotide contiged with homology data and/or differential gene expressed data.

The sequence information obtained in the contig assembly described above can be used to obtain a consensus sequence derived from the contig using the Sequencher program. The consensus sequence can then be used as a query sequence in a BLASTN search of the DGTI DoubleTwist Gene Index (DoubleTwist, Inc., Oakland, Calif.), which contains all the EST and non-redundant sequence in public databases. Alternatively, a sequence of a polynucleotide described herein can be used directly as a query sequence in a BLASTN search of the DGTI DoubleTwist Gene Index.

Through contig assembly and the use of homology searching software programs, the sequence information provided herein can be readily extended to confirm, or confirm a predicted, gene having the sequence of the polynucleotides described in the present invention. Further the information obtained can be used to identify the function of the gene product of the gene corresponding to the polynucleotides described herein. While not necessary to the practice of the invention, identification of the function of the corresponding gene, can provide guidance in the design of therapeutics that target the gene to modulate its activity and modulate the cancerous phenotype (e.g., inhibit metastasis, proliferation, and the like).

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims. Those skilled in the art will recognize, or be able to ascertain, using not more than routine experimentation, many equivalents to the specific embodiments of the invention described herein. Such specific embodiments and equivalents are intended to be encompassed by the following claims.

Deposit Information.

A deposit of the biological materials in the tables referenced below was made with the American Type Culture Collection, 10801 University Blvd., Manasas, Va. 20110-2209, under the provisions of the Budapest Treaty, on or before the filing date of the present application. The accession number indicated is assigned after successful viability testing, and the requisite fees were paid. Access to said cultures will be available during pendency of the patent application to one determined by the Commissioner to be entitled to such under 37 C.F.R. §1.14 and 35 U.S.C. §122. All restriction on availability of said cultures to the public will be irrevocably removed upon the granting of a patent based upon the application. Moreover, the designated deposits will be maintained for a period of thirty (30) years from the date of deposit, or for five (5) years after the last request for the deposit; or for the enforceable life of the U.S. patent, whichever is longer. Should a culture become nonviable or be inadvertently destroyed, or, in the case of plasmid-containing strains, lose its plasmid, it will be replaced with a viable culture(s) of the same taxonomic description.

These deposits are provided merely as a convenience to those of skill in the art, and are not an admission that a deposit is required. A license may be required to make, use, or sell the deposited materials, and no such license is hereby granted. The deposit below was received by the ATCC on or before the filing date of the present application.

TABLE 139

Cell Lines Deposited with ATCC

| Cell Line | Deposit Date | ATCC Accession No. | CMCC Accession No. |
|---|---|---|---|
| KM12L4-A | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

In addition, pools of selected clones, as well as libraries containing specific clones, were assigned an "ES" number (internal reference) and deposited with the ATCC. Table 141 below provides the ATCC Accession Nos. of the ES deposits, all of which were deposited on or before Jun. 13, 2000.

TABLE 140

Pools of Clones and Libraries Deposited with ATCC on or before Jun. 13, 2000.

| Library No. | CMCC No. | ATCC Accession No. |
|---|---|---|
| ES 168 | 5276 | PTA-2027 |
| ES 169 | 5277 | PTA-2028 |
| ES 170 | 5284 | PTA-2029 |
| ES 171 | 5285 | PTA-2030 |
| ES 172 | 5286 | PTA-2031 |
| ES 173 | 5287 | PTA-2032 |
| ES 174 | 5288 | PTA-2033 |
| ES 175 | 5289 | PTA-2034 |
| ES 176 | 5290 | PTA-2035 |
| ES 177 | 5291 | PTA-2036 |
| ES 178 | 5292 | PTA-2037 |
| ES 179 | 5293 | PTA-2038 |
| ES 180 | 5294 | PTA-2039 |
| ES 181 | 5295 | PTA-2040 |
| ES 182 | 5296 | PTA-2041 |
| ES 183 | 5297 | PTA-2042 |
| ES 184 | 5298 | PTA-2043 |
| ES 185 | 5299 | PTA-2044 |
| ES 186 | 5301 | PTA-2045 |
| ES 187 | 5302 | PTA-2046 |
| ES 188 | 5303 | PTA-2047 |
| ES 189 | 5304 | PTA-2052 |
| ES 190 | 5305 | PTA-2053 |
| ES 191 | 5306 | PTA-2054 |
| ES 192 | 5307 | PTA-2055 |
| ES 193 | 5308 | PTA-2056 |
| ES 194 | 5309 | PTA-2057 |
| ES 195 | 5310 | PTA-2058 |
| ES 196 | 5311 | PTA-2059 |
| ES 197 | 5312 | PTA-2060 |
| ES 198 | 5313 | PTA-2061 |
| ES 199 | 5314 | PTA-2062 |
| ES 200 | 5315 | PTA-2048 |
| ES 201 | 5316 | PTA-2049 |
| ES 202 | 5317 | PTA-2063 |
| ES 203 | 5318 | PTA-2064 |
| ES 204 | 5319 | PTA-2065 |
| ES 205 | 5320 | PTA-2066 |
| ES 206 | 5321 | PTA-2067 |
| ES 207 | 5322 | PTA-2068 |
| ES 208 | 5253 | PTA-2050 |
| ES 209 | 5324 | PTA-2051 |

Table 141 (inserted before the claims) provides the clones in each of the above libraries.

Retrieval of Individual Clones from Deposit of Pooled Clones. Where the ATCC deposit is composed of a pool of cDNA clones or a library of cDNA clones, the deposit was prepared by first transfecting each of the clones into separate bacterial cells. The clones in the pool or library were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

Example 92

Source of Biological Materials and Overview of Novel Polynucleotides Expressed by the Biological Materials Candidate polynucleotides that may represent novel polynucleotides were obtained from cDNA libraries generated from selected cell lines and patient tissues. In order to obtain the candidate polynucleotides, mRNA was isolated from several selected cell lines and patient tissues, and used to construct cDNA libraries. The cells and tissues that served as sources for these cDNA libraries are summarized in Table 142 below.

Human colon cancer cell line Km12L4-A (Morikawa, et al., Cancer Research (1988) 48:6863) is derived from the KM12C cell line. The KM12C cell line (Morikawa et al. Cancer Res. (1988) 48:1943-1948), which is poorly metastatic (low metastatic) was established in culture from a Dukes' stage B2 surgical specimen (Morikawa et al. Cancer Res. (1988) 48:6863). The KM12L4-A is a highly metastatic subline derived from KM12C (Yeatman et al. Nucl. Acids. Res. (1995) 23:4007; Bao-Ling et al. Proc. Annu. Meet. Am. Assoc. Cancer. Res. (1995) 21:3269). The KM12C and KM12C-derived cell lines (e.g., KM12L4, KM12L4-A, etc.) are well-recognized in the art as a model cell line for the study of colon cancer (see, e.g., Moriakawa et al., supra; Radinsky et al. Clin. Cancer Res. (1995) 1:19; Yeatman et al., (1995) supra; Yeatman et al. Clin. Exp. Metastasis (1996) 14:246).

The MDA-MB-231 cell line (Brinkley et al. Cancer Res. (1980) 40:3118-3129) was originally isolated from pleural effusions (Cailleau, J. Natl. Cancer. Inst. (1974) 53:661), is of high metastatic potential, and forms poorly differentiated adenocarcinoma grade II in nude mice consistent with breast carcinoma. The MCF7 cell line was derived from a pleural effusion of a breast adenocarcinoma and is non-metastatic. The MV-522 cell line is derived from a human lung carcinoma and is of high metastatic potential. The UCP-3 cell line is a low metastatic human lung carcinoma cell line; the MV-522 is a high metastatic variant of UCP-3. These cell lines are well-recognized in the art as models for the study of human breast and lung cancer (see, e.g., Chandrasekaran et al., Cancer Res. (1979) 39:870 (MDA-MB-231 and MCF-7); Gastpar et al., J Med Chem (1998) 41:4965 (MDA-MB-231 and MCF-7); Ranson et al., Br J Cancer (1998) 77:1586 (MDA-MB-231 and MCF-7); Kuang et al., Nucleic Acids Res (1998) 26:1116 (MDA-MB-231 and MCF-7); Varki et al., Int J Cancer (1987) 40:46 (UCP-3); Varki et al., Tumour Biol. (1990) 11:327; (MV-522 and UCP-3); Varki et al., Anticancer Res. (1990) 10:637; (MV-522); Kelner et al., Anticancer Res (1995) 15:867 (MV-522); and Zhang et al., Anticancer Drugs (1997) 8:696 (MV522)).

The samples of libraries 15-20 are derived from two different patients (UC#2, and UC#3). The bFGF-treated HMVEC were prepared by incubation with bFGF at 10 ng/ml for 2 hrs; the VEGF-treated HMVEC were prepared by incubation with 20 ng/ml VEGF for 2 hrs. Following incubation with the respective growth factor, the cells were washed and lysis buffer added for RNA preparation.

GRRpz was derived from normal prostate epithelium. The WOca cell line is a Gleason Grade 4 cell line.

carcinoma and matched normal prostate biopsies from a pool of at-risk subjects under medical surveillance.

The source materials for generating the normalized breast libraries of libraries 27, 28 and 29 were cryopreserved breast tissue from a primary breast tumor (infiltrating ductal carcinoma)(library 28), from a lymph node metastasis (library 29), or matched normal breast biopsies from a pool of at-risk subjects under medical surveillance. In each case, prostate or breast epithelia were harvested directly from frozen sections of tissue by laser capture microdissection (LCM, Arcturus Enginering Inc., Mountain View, Calif.), carried out according to methods well known in the art (see, Simone et al. Am J Pathol. 156(2):445-52 (2000)), to provide substantially homogenous cell samples.

TABLE 142

Description of cDNA Libraries

| Library (lib#) | Description | Number of Clones in Library |
|---|---|---|
| 0 | Artificial library composed of deselected clones (clones with no associated variant or cluster) | 673 |
| 1 | Human Colon Cell Line Km12 L4: High Metastatic Potential (derived from Km12C) | 308731 |
| 2 | Human Colon Cell Line Km12C: Low Metastatic Potential | 284771 |
| 3 | Human Breast Cancer Cell Line MDA-MB-231: High Metastatic Potential; micro-mets in lung | 326937 |
| 4 | Human Breast Cancer Cell Line MCF7: Non Metastatic | 318979 |
| 8 | Human Lung Cancer Cell Line MV-522: High Metastatic Potential | 223620 |
| 9 | Human Lung Cancer Cell Line UCP-3: Low Metastatic Potential | 312503 |
| 12 | Human microvascular endothelial cells (HMEC) - UNTREATED (PCR (OligodT) cDNA library) | 41938 |
| 13 | Human microvascular endothelial cells (HMEC) - bFGF TREATED (PCR (OligodT) cDNA library) | 42100 |
| 14 | Human microvascular endothelial cells (HMEC) - VEGF TREATED (PCR (OligodT) cDNA library) | 42825 |
| 15 | Normal Colon - UC#2 Patient (MICRODISSECTED PCR (OligodT) cDNA library) | 282722 |
| 16 | Colon Tumor - UC#2 Patient (MICRODISSECTED PCR (OligodT) cDNA library) | 298831 |
| 17 | Liver Metastasis from Colon Tumor of UC#2 Patient (MICRODISSECTED PCR (OligodT) cDNA library) | 303467 |
| 18 | Normal Colon - UC#3 Patient (MICRODISSECTED PCR (OligodT) cDNA library) | 36216 |
| 19 | Colon Tumor - UC#3 Patient (MICRODISSECTED PCR (OligodT) cDNA library) | 41388 |
| 20 | Liver Metastasis from Colon Tumor of UC#3 Patient (MICRODISSECTED PCR (OligodT) cDNA library) | 30956 |
| 21 | GRRpz Cells derived from normal prostate epithelium | 164801 |
| 22 | WOca Cells derived from Gleason Grade 4 prostate cancer epithelium | 162088 |
| 23 | Normal Lung Epithelium of Patient #1006 (MICRODISSECTED PCR (OligodT) cDNA library) | 306198 |
| 24 | Primary tumor, Large Cell Carcinoma of Patient #1006 (MICRODISSECTED PCR (OligodT) cDNA library) | 309349 |
| 25 | Normal Prostate Epithelium from Patient IF97-26811 | 279444 |
| 26 | Prostate Cancer Epithelium Gleason 3 + 3 Patient IF97-26811 | 269406 |
| 27 | Normal Breast Epithelium from Patient 515 | 239494 |
| 28 | Primary Breast tumor from Patient 515 | 259960 |
| 29 | Lymph node metastasis from Patient 515 | 326786 |
| 30 | Normal Prostate Epithelium from Chiron Patient ID 884 | 298431 |
| 31 | Prostate Cancer Epithelium (Gleason 4 + 4) from Chiron Patient ID 884 | 331941 |

The source materials for generating the normalized prostate libraries of libraries 25 and 26 were cryopreserved prostate tumor tissue from a patient with Gleason grade 3+3 adenocarcinoma and matched normal prostate biopsies from a pool of at-risk subjects under medical surveillance. The source materials for generating the normalized prostate libraries of libraries 30 and 31 were cryopreserved prostate tumor tissue from a patient with Gleason grade 4+4 adeno- Characterization of Sequences in the Libraries After using the software program Phred (ver 0.000925.c, Green and Weing, ©1993-2000) to select those polynucleotides having the best quality sequence, the polynucleotides were compared against the public databases to identify any homologous sequences. The sequences of the isolated polynucleotides were first masked to eliminate low complexity sequences using the RepeatMasker masking program, publicly available through a web site supported by the University of Washington (See also Smit, A. F. A. and Green, P., unpublished results). Generally, masking does not influence the final search results, except to eliminate sequences of relatively little interest due to their low complexity, and to eliminate multiple "hits" based on similarity to repetitive regions common to multiple sequences, e.g., Alu repeats.

The remaining sequences were then used in a homology search of the GenBank database using the TeraBLAST program (TimeLogic, Crystal Bay, Nev.). TeraBLAST is a version of the publicly available BLAST search algorithm developed by the National Center for Biotechnology, modified to operate at an accelerated speed with increased sensitivity on a specialized computer hardware platform. The program was run with the default parameters recommended by TimeLogic to provide the best sensitivity and speed for searching DNA and protein sequences. Sequences that exhibited greater than 70% overlap, 99% identity, and a p value of less than $1\times10e-40$ were discarded. Sequences from this search also were discarded if the inclusive parameters were met, but the sequence was ribosomal or vector-derived.

The resulting sequences from the previous search were classified into three groups (1, 2 and 3 below) and searched in a TeraBLASTX vs. NRP (non-redundant proteins) database search: (1) unknown (no hits in the GenBank search), (2) weak similarity (greater than 45% identity and p value of less than $1\times10e-5$), and (3) high similarity (greater than 60% overlap, greater than 80% identity, and p value less than $1\times10e-5$). Sequences having greater than 70% overlap, greater than 99% identity, and p value of less than $1\times10e-40$ were discarded.

The remaining sequences were classified as unknown (no hits), weak similarity, and high similarity (parameters as above). Two searches were performed on these sequences. First, a TeraBLAST vs. EST database search was performed and sequences with greater than 99% overlap, greater than 99% similarity and a p value of less than $1\times10e-40$ were discarded. Sequences with a p value of less than $1\times10e-65$ when compared to a database sequence of human origin were also excluded. Second, a TeraBLASTN vs. Patent GeneSeq database was performed and sequences having greater than 99% identity, p value less than $1\times10e-40$, and greater than 99% overlap were discarded.

The remaining sequences were subjected to screening using other rules and redundancies in the dataset. Sequences with a p value of less than $1\times10e-111$ in relation to a database sequence of human origin were specifically excluded. The final result provided the sequences listed as SEQ ID NOS: 22001-23267 in the accompanying Sequence Listing and summarized in Table 143 (inserted prior to claims). Each identified polynucleotide represents sequence from at least a partial mRNA transcript.

Summary of Polynucleotides of the Invention

Table 143 (inserted prior to claims) provides a summary of polynucleotides isolated as described. Specifically, Table 143 provides: 1) the SEQ ID NO ("SEQ ID") assigned to each sequence for use in the present specification; 2) the Cluster Identification No. ("CLUSTER"); 3) the Sequence Name assigned to each sequence; 3) the sequence name ("SEQ NAME") used as an internal identifier of the sequence; 4) the orientation of the sequence ("ORIENT") (either forward (F) or reverse (R)); 5) the name assigned to the clone from which the sequence was isolated ("CLONE ID"); and 6) the name of the library from which the sequence was isolated ("LIBRARY"). Because at least some of the provided polynucleotides represent partial mRNA transcripts, two or more polynucleotides may represent different regions of the same mRNA transcript and the same gene and/or may be contained within the same clone. Thus, for example, if two or more SEQ ID NOS: are identified as belonging to the same clone, then either sequence can be used to obtain the full-length mRNA or gene. Clones which comprise the sequences described herein were deposited as set out in the tables indicated below (see Example entitled "Deposit Information").

Example 93

Contig Assembly

The sequences of the polynucleotides provided in the present invention can be used to extend the sequence information of the gene to which the polynucleotides correspond (e.g., a gene, or mRNA encoded by the gene, having a sequence of the polynucleotide described herein). This expanded sequence information can in turn be used to further characterize the corresponding gene, which in turn provides additional information about the nature of the gene product (e.g., the normal function of the gene product). The additional information can serve to provide additional evidence of the gene product's use as a therapeutic target, and provide further guidance as to the types of agents that can modulate its activity.

For example, a contig was assembled using the sequence of a polynucleotide described herein. A "contig" is a contiguous sequence of nucleotides that is assembled from nucleic acid sequences having overlapping (e.g., shared or substantially similar) sequence information. The sequences of publicly-available ESTs (Expressed Sequence Tags) and the sequences of various of the above-described polynucleotides were used in the contig assembly. The contig was assembled using the software program Sequencher, version 4.05, according to the manufacturer's instructions. The sequence information obtained in the contig assembly was then used to obtain a consensus sequence derived from the contig using the Sequencher program. The resulting consensus sequence was used to search both the public databases as well as databases internal to the applicants to match the consensus polynucleotide with homology data and/or differential gene expressed data.

The final result provided the sequences listed as SEQ ID NOS: 23268-23385 in the accompanying Sequence Listing and summarized in Table 144 (inserted prior to claims). Table 144 provides a summary of the consensus sequences assembled as described. Specifically, Table 144 provides: 1) the SEQ ID NO ("SEQ ID") assigned to each sequence for use in the present specification; 2) the consensus sequence name ("CONSENSUS SEQ NAME") used as an internal identifier of the sequence; and 3) the sequence name ("POLYNTD SEQ NAME") of a polynucleotide of SEQ ID NOS: 22001-23267 used in assembly of the consensus sequence.

TABLE 144

| SEQ ID | CONSENSUS SEQ NAME | POLYNTD SEQ NAME |
|---|---|---|
| 23268 | Clu1009284.1 | 2490.J22.GZ43_363450 |
| 23269 | Clu1022935.2 | 2561.O19.GZ43_376586 |
| 23270 | Clu1037152.1 | 2558.L19.GZ43_374594 |
| 23271 | Clu13903.1 | 2489.A13.GZ43_362841 |
| 23272 | Clu139979.2 | 2504.B21.GZ43_365834 |
| 23273 | Clu163602.2 | 2561.H17.GZ43_376416 |
| 23274 | Clu187860.2 | 2474.P22.GZ43_361999 |
| 23275 | Clu189993.1 | 2505.N19.GZ43_366504 |
| 23276 | Clu20975.1 | 2466.F16.GZ43_360217 |
| 23277 | Clu217122.1 | 2458.N10.GZ43_356930 |
| 23278 | Clu218833.1 | 2562.O01.GZ43_375800 |

TABLE 144-continued

| SEQ ID | CONSENSUS SEQ NAME | POLYNTD SEQ NAME |
|---|---|---|
| 23279 | Clu244504.2 | 2367.E23.GZ43_346113 |
| 23280 | Clu271456.1 | 2365.G19.GZ43_345389 |
| 23281 | Clu376516.1 | 2457.J23.GZ43_356451 |
| 23282 | Clu376630.1 | 2467.B11.GZ43_360500 |
| 23283 | Clu377044.2 | 2499.A22.GZ43_365257 |
| 23284 | Clu379689.1 | 2540.M18.GZ43_372313 |
| 23285 | Clu380482.2 | 2542.D09.GZ43_372856 |
| 23286 | Clu387530.4 | 2475.N08.GZ43_362321 |
| 23287 | Clu388450.2 | 2497.L05.GZ43_364736 |
| 23288 | Clu396325.1 | 2561.P16.GZ43_376607 |
| 23289 | Clu397115.3 | 2560.K18.GZ43_375337 |
| 23290 | Clu398642.2 | 2542.N22.GZ43_373109 |
| 23291 | Clu400258.1 | 2504.O12.GZ43_366137 |
| 23292 | Clu402167.1 | 2540.C21.GZ43_372076 |
| 23293 | Clu402591.3 | 2483.E11.GZ43_359762 |
| 23294 | Clu402904.1 | 2504.J02.GZ43_366007 |
| 23295 | Clu404081.2 | 2483.K02.GZ43_359897 |
| 23296 | Clu411524.1 | 2497.C11.GZ43_364526 |
| 23297 | Clu41346.1 | 2560.K08.GZ43_375327 |
| 23298 | Clu415520.1 | 2561.L14.GZ43_376509 |
| 23299 | Clu416124.1 | 2367.G17.GZ43_346155 |
| 23300 | Clu417672.1 | 2367.I09.GZ43_346195 |
| 23301 | Clu423664.1 | 2488.H12.GZ43_362624 |
| 23302 | Clu429609.1 | 2457.M11.GZ43_356511 |
| 23303 | Clu442923.3 | 2498.G15.GZ43_365010 |
| 23304 | Clu446975.1 | 2459.K15.GZ43_357247 |
| 23305 | Clu449839.2 | 2497.O09.GZ43_364812 |
| 23306 | Clu449889.1 | 2475.N21.GZ43_362334 |
| 23307 | Clu451707.2 | 2554.P16.GZ43_376223 |
| 23308 | Clu454509.3 | 2542.M09.GZ43_373072 |
| 23309 | Clu454796.1 | 2540.P02.GZ43_372369 |
| 23310 | Clu455862.1 | 2560.I09.GZ43_375280 |
| 23311 | Clu460493.1 | 2483.O07.GZ43_359998 |
| 23312 | Clu464200.1 | 2465.G06.GZ43_358214 |
| 23313 | Clu465446.2 | 2457.L21.GZ43_356497 |
| 23314 | Clu470032.1 | 2474.C01.GZ43_361666 |
| 23315 | Clu474125.1 | 2457.E23.GZ43_356331 |
| 23316 | Clu474125.2 | 2541.A06.GZ43_372397 |
| 23317 | Clu477271.1 | 2540.E17.GZ43_372120 |
| 23318 | Clu480410.1 | 2498.H08.GZ43_365027 |
| 23319 | Clu483211.2 | 2510.J18.GZ43_369259 |
| 23320 | Clu497138.1 | 2458.N19.GZ43_356939 |
| 23321 | Clu498886.1 | 2465.L22.GZ43_358350 |
| 23322 | Clu498886.2 | 2541.B15.GZ43_372430 |
| 23323 | Clu5013.2 | 2559.D05.GZ43_374772 |
| 23324 | Clu5105.2 | 2542.D19.GZ43_372866 |
| 23325 | Clu510539.2 | 2558.H17.GZ43_374496 |
| 23326 | Clu514044.1 | 2367.F13.GZ43_346127 |
| 23327 | Clu516526.1 | 2456.F23.GZ43_355971 |
| 23328 | Clu519176.2 | 2559.H20.GZ43_374883 |
| 23329 | Clu520370.1 | 2541.N01.GZ43_372704 |
| 23330 | Clu524917.1 | 2464.H05.GZ43_357853 |
| 23331 | Clu528957.1 | 2540.F15.GZ43_372142 |
| 23332 | Clu533888.1 | 2557.L23.GZ43_374214 |
| 23333 | Clu534076.1 | 2456.C05.GZ43_355881 |
| 23334 | Clu540142.2 | 2456.H02.GZ43_355998 |
| 23335 | Clu540379.2 | 2491.O02.GZ43_363934 |
| 23336 | Clu549507.1 | 2483.B23.GZ43_359702 |
| 23337 | Clu551338.3 | 2457.I12.GZ43_356416 |
| 23338 | Clu552537.2 | 2540.C10.GZ43_372065 |
| 23339 | Clu556827.3 | 2558.E24.GZ43_374431 |
| 23340 | Clu558569.2 | 2558.D03.GZ43_374386 |
| 23341 | Clu565709.1 | 2542.P02.GZ43_373137 |
| 23342 | Clu568204.1 | 2456.M05.GZ43_356121 |
| 23343 | Clu570804.1 | 2475.M20.GZ43_362309 |
| 23344 | Clu572170.2 | 2557.H03.GZ43_374098 |
| 23345 | Clu573764.1 | 2365.C10.GZ43_345284 |
| 23346 | Clu587168.1 | 2483.F15.GZ43_359790 |
| 23347 | Clu588996.1 | 2466.G06.GZ43_360231 |
| 23348 | Clu597681.1 | 2459.A04.GZ43_356996 |
| 23349 | Clu598388.1 | 2562.E03.GZ43_375562 |
| 23350 | Clu604822.2 | 2504.F20.GZ43_365929 |
| 23351 | Clu621573.1 | 2535.A08.GZ43_370095 |
| 23352 | Clu625055.1 | 2511.A07.GZ43_369416 |
| 23353 | Clu627263.1 | 2466.D20.GZ43_360173 |
| 23354 | Clu635332.1 | 2480.D13.GZ43_358588 |
| 23355 | Clu640911.2 | 2541.M24.GZ43_372703 |
| 23356 | Clu641662.2 | 2555.D22.GZ43_373253 |
| 23357 | Clu659483.1 | 2365.F12.GZ43_345358 |
| 23358 | Clu6712.1 | 2535.P14.GZ43_370461 |
| 23359 | Clu676448.3 | 2464.B01.GZ43_357705 |
| 23360 | Clu682065.2 | 2467.E19.GZ43_360580 |
| 23361 | Clu685244.2 | 2561.J01.GZ43_376448 |
| 23362 | Clu691653.1 | 2560.O12.GZ43_375427 |
| 23363 | Clu692282.1 | 2561.I11.GZ43_376434 |
| 23364 | Clu697955.1 | 2557.J22.GZ43_374165 |
| 23365 | Clu702885.3 | 2555.H18.GZ43_373345 |
| 23366 | Clu70908.1 | 2561.C15.GZ43_376294 |
| 23367 | Clu709796.2 | 2542.C20.GZ43_372843 |
| 23368 | Clu715752.1 | 2459.A24.GZ43_357016 |
| 23369 | Clu727966.1 | 2489.F09.GZ43_362957 |
| 23370 | Clu732950.2 | 2475.L17.GZ43_362282 |
| 23371 | Clu752623.2 | 2561.I07.GZ43_376430 |
| 23372 | Clu756337.1 | 2561.I19.GZ43_376442 |
| 23373 | Clu782981.1 | 2489.L05.GZ43_363097 |
| 23374 | Clu805118.3 | 2480.D16.GZ43_358591 |
| 23375 | Clu806992.2 | 2467.D20.GZ43_360557 |
| 23376 | Clu823296.3 | 2558.P20.GZ43_374691 |
| 23377 | Clu830453.2 | 2540.M22.GZ43_372317 |
| 23378 | Clu839006.1 | 2507.H02.GZ43_367111 |
| 23379 | Clu847088.1 | 2542.H23.GZ43_372966 |
| 23380 | Clu853371.2 | 2491.I06.GZ43_363794 |
| 23381 | Clu88462.1 | 2510.K15.GZ43_369280 |
| 23382 | Clu935908.2 | 2505.O09.GZ43_366518 |
| 23383 | Clu948383.1 | 2541.F05.GZ43_372516 |
| 23384 | Clu966599.3 | 2507.L12.GZ43_367217 |
| 23385 | Clu993554.1 | 2558.F19.GZ43_374450 |

Example 94

Additional Gene Characterization

Sequences of the polynucleotides of SEQ ID NOS: 22001-23267 were used as a query sequence in a TeraBLASTN search of the DoubleTwist Human Genome Sequence Database (DoubleTwist, Inc., Oakland, Calif.), which contains all the human genomic sequences that have been assembled into a contiguous model of the human genome. Predicted cDNA and protein sequences were obtained where a polynucleotide of the invention was homologous to a predicted full-length gene sequence. Alternatively, a sequence of a contig or consensus sequence described herein could be used directly as a query sequence for use in a TeraBLASTN search of the DoubleTwist Human Genome Sequence Database.

The final results of the search provided the predicted cDNA sequences listed as SEQ ID NOS: 1386-1477 in the accompanying Sequence Listing and summarized in Table 145 (inserted prior to claims), and the predicted protein sequences listed as SEQ ID NOS:23478-23568 in the accompanying Sequence Listing and summarized in Table 146 (inserted prior to claims). Specifically, Table 145 provides: 1) the SEQ ID NO ("SEQ ID") assigned to each cDNA sequence for use in the present specification; 2) the cDNA sequence name ("cDNA SEQ NAME") used as an internal identifier of the sequence; 3) the sequence name ("POLYNTD SEQ NAME") of the polynucleotide of SEQ ID NO that maps to the cDNA; 4) The gene id number (GENE) of the DoubleTwist predicted gene; 5) the chromosome ("CHROM") containing the gene corresponding to the cDNA sequence; Table 146 provides: 1) the SEQ ID NO ("SEQ ID") assigned to each protein sequence for use in the present specification; 2) the protein sequence name ("PROTEIN SEQ NAME") used as an internal identifier of the sequence; 3) the sequence name ("POLYNTD SEQ NAME") of the polynucleotide of SEQ ID NOS: 22001-23267 that maps to the protein sequence; 4) The gene id number (GENE) of the DoubleTwist predicted gene; 5) the chromosome ("CHROM") containing the gene corresponding to the cDNA sequence.

TABLE 145

| SEQ ID | cDNA SEQ NAME | POLYNTD SEQ NAME | GENE | CHROM |
|---|---|---|---|---|
| 23386 | DTT00087024.1 | 2467.H18.GZ43__360651 | DTG00087008.1 | 1 |
| 23387 | DTT00089020.1 | 2367.I15.GZ43__346201 | DTG00089002.1 | 1 |
| 23388 | DTT00171014.1 | 2473.F14.GZ43__361367 | DTG00171001.1 | 1 |
| 23389 | DTT00514029.1 | 2488.G02.GZ43__362590 | DTG00514005.1 | 1 |
| 23390 | DTT00740010.1 | 2466.I08.GZ43__360281 | DTG00740003.1 | 1 |
| 23391 | DTT00945030.1 | 2466.D19.GZ43__360172 | DTG00945008.1 | 1 |
| 23392 | DTT01169022.1 | 2464.N05.GZ43__357997 | DTG01169003.1 | 2 |
| 23393 | DTT01178009.1 | 2510.O21.GZ43__369382 | DTG01178002.1 | 2 |
| 23394 | DTT01315010.1 | 2496.F14.GZ43__364217 | DTG01315001.1 | 2 |
| 23395 | DTT01503016.1 | 2538.M17.GZ43__371544 | DTG01503005.1 | 2 |
| 23396 | DTT01555018.1 | 2538.C07.GZ43__371294 | DTG01555002.1 | 2 |
| 23397 | DTT01685047.1 | 2496.C08.GZ43__364139 | DTG01685007.1 | 2 |
| 23398 | DTT01764019.1 | 2535.C23.GZ43__370158 | DTG01764003.1 | 2 |
| 23399 | DTT01890015.1 | 2482.J06.GZ43__359493 | DTG01890004.1 | 2 |
| 23400 | DTT02243008.1 | 2474.J19.GZ43__361852 | DTG02243002.1 | 3 |
| 23401 | DTT02367007.1 | 2366.P08.GZ43__345738 | DTG02367002.1 | 3 |
| 23402 | DTT02671007.1 | 2464.H22.GZ43__357870 | DTG02671002.1 | 3 |
| 23403 | DTT02737017.1 | 2538.M16.GZ43__371543 | DTG02737001.1 | 3 |
| 23404 | DTT02850005.1 | 2472.G03.GZ43__360996 | DTG02850001.1 | 3 |
| 23405 | DTT02966016.1 | 2510.M14.GZ43__369327 | DTG02966003.1 | 4 |
| 23406 | DTT03037029.1 | 2504.D16.GZ43__365877 | DTG03037005.1 | 4 |
| 23407 | DTT03150008.1 | 2491.P10.GZ43__363966 | DTG03150002.1 | 4 |
| 23408 | DTT03367008.1 | 2542.P19.GZ43__373154 | DTG03367003.1 | 4 |
| 23409 | DTT03630013.1 | 2510.O22.GZ43__369383 | DTG03630002.1 | 4 |
| 23410 | DTT03881017.1 | 2507.O12.GZ43__367289 | DTG03881007.1 | 5 |
| 23411 | DTT03913023.1 | 2459.P24.GZ43__357376 | DTG03913005.1 | 5 |
| 23412 | DTT03978010.1 | 2367.G22.GZ43__346160 | DTG03978001.1 | 5 |
| 23413 | DTT04070014.1 | 2540.H07.GZ43__372182 | DTG04070007.1 | 5 |
| 23414 | DTT04084010.1 | 2542.D19.GZ43__372866 | DTG04084001.1 | 5 |
| 23415 | DTT04160007.1 | 2472.M22.GZ43__361159 | DTG04160003.1 | 5 |
| 23416 | DTT04302021.1 | 2483.O07.GZ43__359998 | DTG04302002.1 | 5 |
| 23417 | DTT04378009.1 | 2368.O11.GZ43__346725 | DTG04378001.1 | 5 |
| 23418 | DTT04403013.1 | 2506.M05.GZ43__366850 | DTG04403003.1 | 5 |
| 23419 | DTT04414015.1 | 2368.D20.GZ43__346470 | DTG04414005.1 | 5 |
| 23420 | DTT04660017.1 | 2507.C03.GZ43__366992 | DTG04660003.1 | 6 |
| 23421 | DTT04956054.1 | 2538.I17.GZ43__371448 | DTG04956020.1 | 6 |
| 23422 | DTT04970018.1 | 2365.F24.GZ43__345370 | DTG04970007.1 | 6 |
| 23423 | DTT05205007.1 | 2459.J12.GZ43__357220 | DTG05205001.1 | 6 |
| 23424 | DTT05571010.1 | 2555.J10.GZ43__373385 | DTG05571004.1 | 7 |
| 23425 | DTT05650008.1 | 2557.L01.GZ43__374192 | DTG05650003.1 | 7 |
| 23426 | DTT05742029.1 | 2560.K10.GZ43__375329 | DTG05742002.1 | 7 |
| 23427 | DTT06137030.1 | 2565.B15.GZ43__398171 | DTG06137001.1 | 8 |
| 23428 | DTT06161014.1 | 2367.F06.GZ43__346120 | DTG06161007.1 | 8 |
| 23429 | DTT06706019.1 | 2467.D10.GZ43__360547 | DTG06706003.1 | 9 |
| 23430 | DTT06837021.1 | 2540.I10.GZ43__372209 | DTG06837002.1 | 9 |
| 23431 | DTT07040015.1 | 2504.E23.GZ43__365908 | DTG07040006.1 | 9 |
| 23432 | DTT07088009.1 | 2565.H01.GZ43__397953 | DTG07088001.1 | 9 |
| 23433 | DTT07182014.1 | 2536.G22.GZ43__370637 | DTG07182006.0 | 10 |
| 23434 | DTT07405044.1 | 2560.B11.GZ43__375114 | DTG07405010.1 | 10 |
| 23435 | DTT07408020.1 | 2466.M02.GZ43__360371 | DTG07408005.1 | 10 |
| 23436 | DTT07498014.1 | 2506.K20.GZ43__366817 | DTG07498002.1 | 10 |
| 23437 | DTT07600010.1 | 2464.H17.GZ43__357865 | DTG07600001.1 | 10 |
| 23438 | DTT08005024.1 | 2475.N21.GZ43__362334 | DTG08005009.1 | 11 |
| 23439 | DTT08098020.1 | 2540.M18.GZ43__372313 | DTG08098001.1 | 11 |
| 23440 | DTT08167018.1 | 2542.F05.GZ43__372900 | DTG08167002.1 | 11 |
| 23441 | DTT08249022.1 | 2498.G15.GZ43__365010 | DTG08249008.1 | 11 |
| 23442 | DTT08499022.1 | 2540.A24.GZ43__372031 | DTG08499009.1 | 12 |
| 23443 | DTT08514022.1 | 2541.L12.GZ43__372667 | DTG08514006.1 | 12 |
| 23444 | DTT08527013.1 | 2489.F09.GZ43__362957 | DTG08527005.1 | 12 |
| 23445 | DTT08595020.1 | 2554.N09.GZ43__376168 | DTG08595003.1 | 12 |
| 23446 | DTT08711019.1 | 2540.C19.GZ43__372074 | DTG08711001.1 | 12 |
| 23447 | DTT08773020.1 | 2559.I12.GZ43__374899 | DTG08773008.1 | 12 |
| 23448 | DTT08874012.1 | 2537.P14.GZ43__371229 | DTG08874001.1 | 12 |
| 23449 | DTT09387018.1 | 2561.P19.GZ43__376610 | DTG09387001.1 | 14 |
| 23450 | DTT09396022.1 | 2489.M11.GZ43__363127 | DTG09396001.1 | 14 |
| 23451 | DTT09553027.1 | 2505.J22.GZ43__366411 | DTG09553007.1 | 14 |
| 23452 | DTT09604016.1 | 2483.J07.GZ43__359878 | DTG09604006.1 | 14 |
| 23453 | DTT09705033.1 | 2536.O22.GZ43__370829 | DTG09705006.1 | 14 |
| 23454 | DTT09742009.1 | 2542.N21.GZ43__373108 | DTG09742002.1 | 15 |
| 23455 | DTT09753017.1 | 2464.L02.GZ43__357946 | DTG09753002.1 | 15 |
| 23456 | DTT09793019.1 | 2464.I04.GZ43__357876 | DTG09793004.1 | 15 |
| 23457 | DTT09796028.1 | 2366.L21.GZ43__345942 | DTG09796002.1 | 15 |
| 23458 | DTT10221016.1 | 2556.C19.GZ43__373610 | DTG10221004.1 | 16 |
| 23459 | DTT10360040.1 | 2475.M20.GZ43__362309 | DTG10360016.1 | 16 |
| 23460 | DTT10539016.1 | 2506.J20.GZ43__366793 | DTG10539005.1 | 17 |
| 23461 | DTT10564022.1 | 2475.H06.GZ43__362175 | DTG10564006.1 | 17 |
| 23462 | DTT10683041.1 | 2542.K21.GZ43__373036 | DTG10683007.1 | 17 |

TABLE 145-continued

| SEQ ID | cDNA SEQ NAME | POLYNTD SEQ NAME | GENE | CHROM |
| --- | --- | --- | --- | --- |
| 23463 | DTT10819011.1 | 2474.I06.GZ43__361815 | DTG10819003.1 | 17 |
| 23464 | DTT11363027.1 | 2542.C20.GZ43__372843 | DTG11363008.1 | 19 |
| 23465 | DTT11479018.1 | 2506.G24.GZ43__366725 | DTG11479007.1 | 19 |
| 23466 | DTT11483012.1 | 2459.H09.GZ43__357169 | DTG11483001.1 | 19 |
| 23467 | DTT11548015.1 | 2565.C17.GZ43__398204 | DTG11548002.1 | 19 |
| 23468 | DTT11730017.1 | 2535.B09.GZ43__370120 | DTG11730004.1 | 20 |
| 23469 | DTT11791010.1 | 2506.E12.GZ43__366665 | DTG11791003.1 | 20 |
| 23470 | DTT11864036.1 | 2456.H07.GZ43__356003 | DTG11864011.1 | 21 |
| 23471 | DTT11902028.1 | 2490.B06.GZ43__363242 | DTG11902009.1 | 21 |
| 23472 | DTT11915017.1 | 2474.G17.GZ43__361778 | DTG11915002.1 | 21 |
| 23473 | DTT11966040.1 | 2457.L21.GZ43__356497 | DTG11966014.1 | 22 |
| 23474 | DTT12042027.1 | 2459.G01.GZ43__357137 | DTG12042005.1 | 22 |
| 23475 | DTT12201062.1 | 2562.B09.GZ43__375496 | DTG12201018.1 | X |
| 23476 | DTT12470020.1 | 2489.A13.GZ43__362841 | DTG12470004.1 | X |
| 23477 | DTT12550009.1 | 2504.G01.GZ43__365934 | DTG12550003.1 | X |

TABLE 146

| SEQ ID | PROTEIN SEQ NAME | POLYNTD SEQ NAME | GENE | CHROM | DBL TWIST LOCUS ID |
| --- | --- | --- | --- | --- | --- |
| 23478 | DTP00087033.1 | 2467.H18.GZ43__360651 | DTG00087008.1 | 1 | DTL00087012.1 |
| 23479 | DTP00089029.1 | 2367.I15.GZ43__346201 | DTG00089002.1 | 1 | DTL00089002.1 |
| 23480 | DTP00171023.1 | 2473.F14.GZ43__361367 | DTG00171001.1 | 1 | DTL00171013.1 |
| 23481 | DTP00514038.1 | 2488.G02.GZ43__362590 | DTG00514005.1 | 1 | DTL00514023.1 |
| 23482 | DTP00740019.1 | 2466.I08.GZ43__360281 | DTG00740003.1 | 1 | DTL00740006.1 |
| 23483 | DTP00945039.1 | 2466.D19.GZ43__360172 | DTG00945008.1 | 1 | |
| 23484 | DTP01169031.1 | 2464.N05.GZ43__357997 | DTG01169004.1 | 2 | DTL01169014.1 |
| 23485 | DTP01178018.1 | 2510.O21.GZ43__369382 | DTG01178002.1 | 2 | DTL01178007.1 |
| 23486 | DTP01315019.1 | 2496.F14.GZ43__364217 | DTG01315001.1 | 2 | DTL01315004.1 |
| 23487 | DTP01503025.1 | 2538.M17.GZ43__371544 | DTG01503005.1 | 2 | DTL01503007.1 |
| 23488 | DTP01555027.1 | 2538.C07.GZ43__371294 | DTG01555003.1 | 2 | DTL01555005.1 |
| 23489 | DTP01685056.1 | 2496.C08.GZ43__364139 | DTG01685007.1 | 2 | DTL01685004.1 |
| 23490 | DTP01764028.1 | 2535.C23.GZ43__370158 | DTG01764003.1 | 2 | DTL01764005.1 |
| 23491 | DTP01890024.1 | 2482.J06.GZ43__359493 | DTG01890004.1 | 2 | DTL01890001.1 |
| 23492 | DTP02243017.1 | 2474.J19.GZ43__361852 | DTG02243002.1 | 3 | DTL02243002.1 |
| 23493 | DTP02367016.1 | 2366.P08.GZ43__345738 | DTG02367002.1 | 3 | DTL02367004.1 |
| 23494 | DTP02671016.1 | 2464.H22.GZ43__357870 | DTG02671002.1 | 3 | DTL02671002.1 |
| 23495 | DTP02737026.1 | 2538.M16.GZ43__371543 | DTG02737001.1 | 3 | DTL02737012.1 |
| 23496 | DTP02850014.1 | 2472.G03.GZ43__360996 | DTG02850001.1 | 3 | DTL02850004.1 |
| 23497 | DTP02966025.1 | 2510.M14.GZ43__369327 | DTG02966003.1 | 4 | DTL02966001.1 |
| 23498 | DTP03037038.1 | 2504.D16.GZ43__365877 | DTG03037005.1 | 4 | DTL03030074.1 |
| 23499 | DTP03150017.1 | 2491.P10.GZ43__363966 | DTG03150002.1 | 4 | DTL03149001.1 |
| 23500 | DTP03367017.1 | 2542.P19.GZ43__373154 | DTG03367005.1 | 4 | DTL03367003.1 |
| 23501 | DTP03630022.1 | 2510.O22.GZ43__369383 | DTG03630002.1 | 4 | DTL03630006.1 |
| 23502 | DTP03881026.1 | 2507.O12.GZ43__367289 | DTG03881007.1 | 5 | DTL03881006.1 |
| 23503 | DTP03913032.1 | 2459.P24.GZ43__357376 | DTG03913005.1 | 5 | DTL03913012.1 |
| 23504 | DTP03978019.1 | 2367.G22.GZ43__346160 | DTG03978001.1 | 5 | DTL03978003.1 |
| 23505 | DTP04070023.1 | 2540.H07.GZ43__372182 | DTG04070001.1 | 5 | |
| 23506 | DTP04084019.1 | 2542.D19.GZ43__372866 | DTG04084001.1 | 5 | DTL04084001.1 |
| 23507 | DTP04160016.1 | 2472.M22.GZ43__361159 | DTG04160003.1 | 5 | DTL04160003.1 |
| 23508 | DTP04302030.1 | 2483.O07.GZ43__359998 | DTG04302002.1 | 5 | DTL04302006.1 |
| 23509 | DTP04378018.1 | 2368.O11.GZ43__346725 | DTG04378001.1 | 5 | |
| 23510 | DTP04403022.1 | 2506.M05.GZ43__366850 | DTG04403003.1 | 5 | DTL04403004.1 |
| 23511 | DTP04414024.1 | 2368.D20.GZ43__346470 | DTG04414005.1 | 5 | DTL04414004.1 |
| 23512 | DTP04660026.1 | 2507.C03.GZ43__366992 | DTG04660003.1 | 6 | DTL04660002.1 |
| 23513 | DTP04956063.1 | 2538.I17.GZ43__371448 | DTG04956020.1 | 6 | DTL04956028.1 |
| 23514 | DTP04970027.1 | 2365.F24.GZ43__345370 | DTG04970007.1 | 6 | DTL04970008.1 |
| 23515 | DTP05205016.1 | 2459.J12.GZ43__357220 | DTG05205001.1 | 6 | DTL05205002.1 |
| 23516 | DTP05571019.1 | 2555.J10.GZ43__373385 | DTG05571004.1 | 7 | DTL05571003.1 |
| 23517 | DTP05650017.1 | 2557.L01.GZ43__374192 | DTG05650003.1 | 7 | DTL05650004.1 |
| 23518 | DTP05742038.1 | 2560.K10.GZ43__375329 | DTG05742002.1 | 7 | DTL05742003.1 |
| 23519 | DTP06137039.1 | 2565.B15.GZ43__398171 | DTG06137001.1 | 8 | DTL06137003.1 |
| 23520 | DTP06161023.1 | 2367.F06.GZ43__346120 | DTG06161007.1 | 8 | DTL06161006.1 |
| 23521 | DTP06706028.1 | 2467.D10.GZ43__360547 | DTG06706003.1 | 9 | DTL06705001.1 |
| 23522 | DTP06837030.1 | 2540.I10.GZ43__372209 | DTG06837002.1 | 9 | DTL06837010.1 |
| 23523 | DTP07040024.1 | 2504.E23.GZ43__365908 | DTG07040006.1 | 9 | DTL07040004.1 |
| 23524 | DTP07088018.1 | 2565.H01.GZ43__397953 | DTG07088001.1. | 9 | DTL07088004.1 |
| 23525 | DTP07405053.1 | 2560.B11.GZ43__375114 | DTG07405010.1 | 10 | DTL07405034.1 |
| 23526 | DTP07408029.1 | 2466.M02.GZ43__360371 | DTG07408005.1 | 10 | DTL07408005.1 |
| 23527 | DTP07498023.1 | 2506.K20.GZ43__366817 | DTG07498002.1 | 10 | DTL07498007.1 |
| 23528 | DTP07600019.1 | 2464.H17.GZ43__357865 | DTG07600001.1 | 10 | DTL07600004.1 |
| 23529 | DTP08005033.1 | 2475.N21.GZ43__362334 | DTG08005009.1 | 11 | DTL08005010.1 |
| 23530 | DTP08098029.1 | 2540.M18.GZ43__372313 | DTG08098001.1 | 11 | DTL08098013.1 |

TABLE 146-continued

| SEQ ID | PROTEIN SEQ NAME | POLYNTD SEQ NAME | GENE | CHROM | DBL TWIST LOCUS ID |
|---|---|---|---|---|---|
| 23531 | DTP08167027.1 | 2542.F05.GZ43_372900 | DTG08167002.1 | 11 | DTL08167003.1 |
| 23532 | DTP08249031.1 | 2498.G15.GZ43_365010 | DTG08249008.1 | 11 | DTL08249005.1 |
| 23533 | DTP08499031.1 | 2540.A24.GZ43_372031 | DTG08499009.1 | 12 | DTL08499012.1 |
| 23534 | DTP08514031.1 | 2541.L12.GZ43_372667 | DTG08514006.1 | 12 | DTL08514015.1 |
| 23535 | DTP08527022.1 | 2489.F09.GZ43_362957 | DTG08527005.1 | 12 | DTL08527008.1 |
| 23536 | DTP08595029.1 | 2554.N09.GZ43_376168 | DTG08595003.1 | 12 | DTL08595002.1 |
| 23537 | DTP08711028.1 | 2540.C19.GZ43_372074 | DTG08711001.1 | 12 | DTL08710003.1 |
| 23538 | DTP08773029.1 | 2559.I12.GZ43_374899 | DTG08773008.1 | 12 | DTL08773011.1 |
| 23539 | DTP08874021.1 | 2537.P14.GZ43_371229 | DTG08874001.1 | 12 | DTL08874009.1 |
| 23540 | DTP09387027.1 | 2561.P19.GZ43_376610 | DTG09387001.1 | 14 | DTL09387002.1 |
| 23541 | DTP09396031.1 | 2489.M11.GZ43_363127 | DTG09396001.1 | 14 | DTL09396016.1 |
| 23542 | DTP09553036.1 | 2505.J22.GZ43_366411 | DTG09553007.1 | 14 | DTL09553018.1 |
| 23543 | DTP09604025.1 | 2483.J07.GZ43_359878 | DTG09604006.1 | 14 | DTL09604010.1 |
| 23544 | DTP09705042.1 | 2536.O22.GZ43_370829 | DTG09705006.1 | 14 | DTL09705005.1 |
| 23545 | DTP09742018.1 | 2542.N21.GZ43_373108 | DTG09742002.1 | 15 | DTL09742007.1 |
| 23546 | DTP09753026.1 | 2464.L02.GZ43_357946 | DTG09753002.1 | 15 | DTL09753011.1 |
| 23547 | DTP09793028.1 | 2464.I04.GZ43_357876 | DTG09793004.1 | 15 | DTL09793004.1 |
| 23548 | DTP09796037.1 | 2366.L21.GZ43_345942 | DTG09796002.1 | 15 | DTL09796021.1 |
| 23549 | DTP10221025.1 | 2556.C19.GZ43_373610 | DTG10221004.1 | 16 | DTL10221002.1 |
| 23550 | DTP10360049.1 | 2475.M20.GZ43_362309 | DTG10360016.1 | 16 | DTL10360003.1 |
| 23551 | DTP10539025.1 | 2506.J20.GZ43_366793 | DTG10539005.1 | 17 | DTL10539004.1 |
| 23552 | DTP10564031.1 | 2475.H06.GZ43_362175 | DTG10564006.1 | 17 | DTL10564006.1 |
| 23553 | DTP10683050.1 | 2542.K21.GZ43_373036 | DTG10683007.1 | 17 | DTL10683002.1 |
| 23554 | DTP10819020.1 | 2474.106.GZ43_361815 | DTG10819003.1 | 17 | DTL10819002.1 |
| 23555 | DTP11363036.1 | 2542.C20.GZ43_372843 | DTG11363008.1 | 19 | DTL11363017.1 |
| 23556 | DTP11479027.1 | 2506.G24.GZ43_366725 | DTG11479007.1 | 19 | DTL11479006.1 |
| 23557 | DTP11483021.1 | 2459.H09.GZ43_357169 | DTG11483001.1 | 19 | DTL11483006.1 |
| 23558 | DTP11548024.1 | 2565.C17.GZ43_398204 | DTG11548002.1 | 19 | DTL11548003.1 |
| 23559 | DTP11730026.1 | 2535.B09.GZ43_370120 | DTG11730004.1 | 20 | DTL11730009.1 |
| 23560 | DTP11791019.1 | 2506.E12.GZ43_366665 | DTG11791003.1 | 20 | DTL11791005.1 |
| 23561 | DTP11864045.1 | 2456.H07.GZ43_356003 | DTG11864011.1 | 21 | DTL11864023.1 |
| 23562 | DTP11902037.1 | 2490.B06.GZ43_363242 | DTG11902009.1 | 21 | DTL11902002.1 |
| 23563 | DTP11915026.1 | 2474.G17.GZ43_361778 | DTG11915002.1 | 21 | DTL11915001.1 |
| 23564 | DTP11966049.1 | 2457.L21.GZ43_356497 | DTG11966014.1 | 22 | DTL11966006.1 |
| 23565 | DTP12042036.1 | 2459.G01.GZ43_357137 | DTG12042005.1 | 22 | DTL12042001.1 |
| 23566 | DTP12201071.1 | 2562.B09.GZ43_375496 | DTG12201018.1 | X | DTL12201023.1 |
| 23567 | DTP12470029.1 | 2489.A13.GZ43_3612841 | DTG12470004.1 | X | DTL12470016.1 |
| 23568 | DTP12550018.1 | 2504.G01.GZ43_365934 | DTG12550003.1 | X | DTL12550005.1 |

A correlation between the polynucleotide used as a query sequence as described above and the corresponding predicted cDNA and protein sequences is contained in Table 147. Specifically Table 147 provides: 1) the SEQ ID NO of the cDNA ("cDNA SEQ ID"); 2) the cDNA sequence name ("cDNA SEQ NAME") used as an internal identifier of the sequence; 3) the SEQ ID NO of the protein ("PROTEIN SEQ ID") encoded by the cDNA sequence 4) the sequence name of the protein ("PROTEIN SEQ NAME") encoded by the cDNA sequence; 5) the SEQ ID NO of the polynucleotide ("POLYNTD SEQ ID") of SEQ ID NOS: 22001-23267 that maps to the cDNA and protein; and 6) the sequence name ("POLYNTD SEQ NAME") of the polynucleotide of SEQ ID NOS: 22001-23267 that maps to the cDNA and protein.

Through contig and consensus sequence assembly and the use of homology searching software programs, the sequence information provided herein can be readily extended to confirm, or confirm a predicted, gene having the sequence of the polynucleotides described in the present invention. Further the information obtained can be used to identify the function of the gene product of the gene corresponding to the polynucleotides described herein. While not necessary to the practice of the invention, identification of the function of the corresponding gene, can provide guidance in the design of therapeutics that target the gene to modulate its activity and modulate the cancerous phenotype (e.g., inhibit metastasis, proliferation, and the like).

Example 95

Results of Public Database Search to Identify Function of Gene Products

SEQ ID NOS:22001-23477 were translated in all three reading frames, and the nucleotide sequences and translated amino acid sequences used as query sequences to search for homologous sequences in the GenBank (nucleotide sequences) database. Query and individual sequences were aligned using the TeraBLAST program available from TimeLogic, Crystal Bay, Nev. The sequences were masked to various extents to prevent searching of repetitive sequences or poly-A sequences, using the RepeatMasker masking program for masking low complexity as described above.

Table 148 (inserted prior to claims) provides the alignment summaries having a p value of 1×10e-2 or less indicating substantial homology between the sequences of the present invention and those of the indicated public databases. Specifically, Table 148 provides: 1) the SEQ ID NO ("SEQ ID") of the query sequence; 2) the sequence name ("SEQ NAME") used as an internal identifier of the query sequence; 3) the accession number ("ACCESSION") of the GenBank database entry of the homologous sequence; 4) a description of the GenBank sequences ("GENBANK DESCRIPTION"); and 5) the score of the similarity of the polynucleotide sequence and the GenBank sequence ("GENBANK SCORE"). The alignments provided in Table 148 are the best available alignment to a DNA sequence at a time just prior to filing of the present specification. Also incorporated by reference is all publicly available information regarding the sequence listed in Table 147 and their related sequences. The search program and database used for the alignment, as well as the calculation of the p value are also indicated. Full length sequences or fragments of the polynucleotide sequences can be used as probes and primers to identify and isolate the full length sequence of the corresponding polynucleotide.

TABLE 147

| cDNA SEQ ID | cDNA SEQ NAME | PROTEIN SEQ ID | PROTEIN SEQ NAME | POLYNTD SEQ ID | POLYNTD SEQ NAME |
|---|---|---|---|---|---|
| 23386 | DTT00087024.1 | 1478 | DTP00087033.1 | 963 | 2467.H18.GZ43_360651 |
| 23386 | DTT00087024.1 | 1478 | DTP00087033.1 | 33 | 2505.B05.GZ43_366202 |
| 23387 | DTT00089020.1 | 1479 | DTP00089029.1 | 213 | 2367.I15.GZ43_346201 |
| 23388 | DTT00171014.1 | 1480 | DTP00171023.1 | 1006 | 2473.F14.GZ43_361367 |
| 23388 | DTT00171014.1 | 1480 | DTP00171023.1 | 1122 | 2489.A03.GZ43_362831 |
| 23389 | DTT00514029.1 | 1481 | DTP00514038.1 | 1113 | 2488.G02.GZ43_362590 |
| 23390 | DTT00740010.1 | 1482 | DTP00740019.1 | 952 | 2466.I08.GZ43_360281 |
| 23391 | DTT00945030.1 | 1483 | DTP00945039.1 | 945 | 2466.D19.GZ43_360172 |
| 23392 | DTT01169022.1 | 1484 | DTP01169031.1 | 482 | 2540.I17.GZ43_372216 |
| 23392 | DTT01169022.1 | 1484 | DTP01169031.1 | 914 | 2464.N05.GZ43_357997 |
| 23393 | DTT01178009.1 | 1485 | DTP01178018.1 | 113 | 2510.O21.GZ43_369382 |
| 23394 | DTT01315010.1 | 1486 | DTP01315019.1 | 1181 | 2496.F14.GZ43_364217 |
| 23395 | DTT01503016.1 | 1487 | DTP01503025.1 | 386 | 2538.M17.GZ43_371544 |
| 23396 | DTT01555018.1 | 1488 | DTP01555027.1 | 366 | 2538.C07.GZ43_371294 |
| 23396 | DTT01555018.1 | 1488 | DTP01555027.1 | 368 | 2538.D03.GZ43_371314 |
| 23396 | DTT01555018.1 | 1488 | DTP01555027.1 | 369 | 2538.D04.GZ43_371315 |
| 23397 | DTT01685047.1 | 1489 | DTP01685056.1 | 1177 | 2496.C08.GZ43_364139 |
| 23398 | DTT01764019.1 | 1490 | DTP01764028.1 | 267 | 2535.C23.GZ43_370158 |
| 23398 | DTT01764019.1 | 1490 | DTP01764028.1 | 771 | 2456.D04.GZ43_355904 |
| 23399 | DTT01890015.1 | 1491 | DTP01890024.1 | 1087 | 2482.J06.GZ43_359493 |
| 23399 | DTT01890015.1 | 1491 | DTP01890024.1 | 1042 | 2475.B20.GZ43_362045 |
| 23399 | DTT01690015.1 | 1491 | DTP01890024.1 | 1200 | 2497.L21.GZ43_364752 |
| 23400 | DTT02243008.1 | 1492 | DTP02243017.1 | 1224 | 2562.G21.GZ43_375628 |
| 23400 | DTT02243008.1 | 1492 | DTP02243017.1 | 1204 | 2497.P04.GZ43_364831 |
| 23400 | DTT02243008.1 | 1492 | DTP02243017.1 | 1025 | 2474.J19.GZ43_361852 |
| 23400 | DTT02243008.1 | 1492 | DTP02243017.1 | 1191 | 2497.D11.GZ43_364550 |
| 23401 | DTT02367007.1 | 1493 | DTP02367016.1 | 174 | 2366.P08.G243_345738 |
| 23402 | DTT02671007.1 | 1494 | DTP02671016.1 | 903 | 2464.H22.G243_357870 |
| 23402 | DTT02671007.1 | 1494 | DTP02671016.1 | 1055 | 2480.G11.G243 358658 |
| 23403 | DTT02737017.1 | 1495 | DTP02737026.1 | 385 | 2538.M16.GZ43_371543 |
| 23404 | DTT02850005.1 | 1496 | DTP02850014.1 | 992 | 2472.G03.GZ43_360996 |
| 23404 | DTT02850005.1 | 1496 | DTP02850014 1 | 1111 | 2488. F06.GZ43_362570 |
| 23404 | DTT02850005.1 | 1496 | DTP02850014.1 | 1039 | 2475.N08.GZ43_362321 |
| 23405 | DTT02966016.1 | 1497 | DTP02966025.1 | 103 | 2510.M14.GZ43_369327 |
| 23406 | DTT03037029.1 | 1498 | DTP03037038.1 | 9 | 2504.D16.G243_365877 |
| 23407 | DTT03150008.1 | 1499 | DTP03150017.1 | 428 | 2565.G20.GZ43_ 398256 |
| 23407 | DTT03150008 1 | 1499 | DTP03150017.1 | 585 | 2555.I12.GZ43_373363 |
| 23407 | DTT03150008.1 | 1499 | DTP03150017.1 | 235 | 2368.D08.GZ43_346458 |
| 23407 | DTT031500081 | 1499 | DTP03150017.1 | 1174 | 2491.P10.C243_363966 |
| 23408 | DTT03367008.1 | 1500 | DTP03367017.1 | 519 | 2506.E18.GZ43_366671 |
| 23408 | DTT03367008.1 | 1500 | DTP03367017.1 | 557 | 2542.P19.GZ43_373154 |
| 23409 | DTT03630013.1 | 1501 | DTP03630022.1 | 114 | 2510.O22.GZ43_369383 |
| 23410 | DTT03881017 1 | 1502 | DTP03881026.1 | 1251 | 2507.O12.GZ43_ 367289 |
| 23411 | DTT03913023.1 | 1503 | DTP03913024.1 | 889 | 2459.P24.6243_357376 |
| 23412 | DTT03978010.1 | 1504 | DTP03978019.1 | 211 | 2367.G22.GZ43_346160 |
| 23413 | DTT04070014.1 | 1505 | DTP04070023.1 | 423 | 2565.D06.GZ43_398029 |
| 23413 | DTT04070014.1 | 1505 | DTP04070023.1 | 374 | 2538.F03GZ43_371362 |
| 23413 | DTT04070014.1 | 1505 | DTP04070023.1 | 17 | 2504.I13.GZ43_365994 |
| 23413 | DTT04070014.1 | 1505 | DTP04070023.1 | 692 | 2559.K12.GZ43_374947 |
| 23413 | DTT04070014.1 | 1505 | DTPO04070023.1 | 43 | 2505.E15.GZ43_366284 |
| 23413 | DTT04070014.1 | 1505 | DTP04070023.1 | 750 | 2561.M09.GZ43_376528 |
| 23413 | DTT04070014.1 | 1505 | DTP04070023.1 | 463 | 2540.H07.GZ43_372182 |
| 23413 | DTT04070014.1 | 1505 | DTP04070023.1 | 1069 | 2481.O13.GZ43_358972 |
| 23414 | DTT04084010.1 | 1506 | DTP04084019.1 | 543 | 2542.D19.GZ43_372866 |
| 23415 | DTT04160007.1 | 1507 | 0TP04160016.1 | 999 | 2472.M22.GZ43_361159 |
| 23416 | DTT04302021.1 | 1508 | DIPO04302030.1 | 1106 | 2483.O07.G243_359998 |
| 23417 | DTT04378009.1 | 1509 | DTP04378018.1 | 260 | 2368.O11.GZ43_346725 |
| 23418 | DTT04403013.1 | 1510 | DTP04403022.1 | 531 | 2506.M05.GZ43_366850 |
| 23419 | DTT04414015.1 | 1511 | DTP04414024.1 | 236 | 2368.D20.GZ43_346470 |
| 23420 | DTT04660017.1 | 1512 | DTP04660026.1 | 334 | 2537.D11.GZ43_370938 |
| 23420 | DTT04660017.1 | 1512 | DTP04660026.1 | 1244 | 2507.C03.GZ43_366992 |
| 23421 | DTT04956054.1 | 1513 | DTP04956063.1 | 379 | 2538.I17.GZ43_371448 |
| 23422 | DTT04970018.1 | 1514 | DTP04970027.1 | 363 | 2538.B03.GZ43_371266 |
| 23422 | DTT04970018.1 | 1514 | DTP04970027.1 | 259 | 2368.O03.GZ43_346717 |
| 23422 | DTT04970018.1 | 1514 | DTP04970027.1 | 1101 | 2483.K02.GZ43_359897 |
| 23422 | DTT04970018.1 | 1514 | DTP04970027.1 | 134 | 2365.F24.GZ43_345370 |
| 23423 | DTT05205007.1 | 1515 | DTP05205016.1 | 880 | 2459.J12.GZ43_357220 |
| 23424 | DTT05571010.1 | 1516 | DTP05571019.1 | 586 | 2555.J10.GZ43_373385 |
| 23425 | DTT05650008.1 | 1517 | DTP05650017.1 | 644 | 2557.L01.GZ43_374192 |
| 23426 | DTT05742029.1 | 1518 | DTP05742038.1 | 721 | 2560.K10.GZ43_375329 |
| 23426 | DTT05742029.1 | 1518 | DTP05742038.1 | 126 | 2365.D10.GZ43_345308 |

TABLE 147-continued

| cDNA SEQ ID | cDNA SEQ NAME | PROTEIN SEQ ID | PROTEIN SEQ NAME | POLYNTD SEQ ID | POLYNTD SEQ NAME |
|---|---|---|---|---|---|
| 23426 | DTT05742029.1 | 1518 | DTP05742038.1 | 756 | 2561.I19.GZ43_376442 |
| 23427 | DTT06137030.1 | 1519 | DTP06137039.1 | 419 | 2565.B15.GZ43_398171 |
| 23428 | DTT06161014.1 | 1520 | DTP06161023.1 | 205 | 2367.F06.GZ43_346120 |
| 23429 | DTT06706019.1 | 1521 | DTP06706028.1 | 967 | 2467.D10.GZ43_360547 |
| 23430 | DTT06837021.1 | 1522 | DTP06837030.1 | 465 | 2540.I10.GZ43_372209 |
| 23431 | DTT07040015.1 | 1523 | DTP07040024.1 | 10 | 2504.E23.GZ43_365908 |
| 23432 | DTT07088009.1 | 1524 | DTP07088018.1 | 170 | 2366.J06.GZ43_345700 |
| 23432 | DTT07088009.1 | 1524 | DTP07088018.1 | 429 | 2565.H01.GZ43_397953 |
| 23433 | DTT07182014.1 | | DTP07182023.1 | 306 | 2536.G22.GZ43_370637 |
| 23434 | DTT07405044.1 | 1525 | DTP07405053.1 | 703 | 2560.B11.GZ43_375114 |
| 23435 | DTT07408020.1 | 1526 | DTP07408029.1 | 956 | 2466.M02.GZ43_360371 |
| 23436 | DTT07498014.1 | 1527 | DTP07498023.1 | 529 | 2506.K20.GZ43_366817 |
| 23437 | DTT07600010.1 | 1528 | DTP07600019.1 | 902 | 2464.H17.GZ43_357865 |
| 23438 | DTT08005024.1 | 1529 | DTP08005033.1 | 1046 | 2475.N21.GZ43_362334 |
| 23439 | DTT08098020.1 | 1530 | DTP08098029.1 | 485 | 2540.M18.GZ43_372313 |
| 23440 | DTT08167018.1 | 1531 | DTP08167027.1 | 152 | 2365.N12.GZ43_345550 |
| 23440 | DTT08167018.1 | 1531 | DTP08167027.1 | 544 | 2542.F05.GZ43_372900 |
| 23441 | DTT08249022.1 | 1532 | DTP08249031.1 | 1235 | 2498.G15.GZ43_365010 |
| 23442 | DTT08499022.1 | 1533 | DTP08499031.1 | 452 | 2540.A24.GZ43_372031 |
| 23443 | DTT08514022.1 | 1534 | DTP08514031.1 | 508 | 2541.L12.GZ43_372667 |
| 23444 | DTT08527013.1 | 1535 | DTP08527022.1 | 109 | 2510.N14.GZ43_369351 |
| 23444 | DTT08527013.1 | 1535 | DTP08527022.1 | 394 | 2554.A16.GZ43_375863 |
| 23444 | DTT08527013.1 | 1535 | DTP08527022.1 | 1128 | 2489.F09.GZ43_362957 |
| 23444 | DTT08527013.1 | 1535 | DTP08527022.1 | 569 | 2555.F16.GZ43_373295 |
| 23445 | DTT08595020.1 | 1536 | DTP08595029.1 | 413 | 2554.N09.GZ43_376168 |
| 23446 | DTT08711019.1 | 1537 | DTP08711028.1 | 472 | 2540.C19.GZ43_372074 |
| 23447 | DTT08773020.1 | 1538 | DTP08773029.1 | 687 | 2559.I12.GZ43_374899 |
| 23448 | DTT08874012.1 | 1539 | DTP08874021.1 | 356 | 2537.P14.GZ43_371229 |
| 23449 | DTT09387018.1 | 1540 | DTP09387027.1 | 762 | 2561.P19.GZ43_376610 |
| 23450 | DTT09396022.1 | 1541 | DTP09396031.1 | 1140 | 2489.M11.GZ43_363127 |
| 23451 | DTT09553027.1 | 1542 | DTP09553036.1 | 54 | 2505.J22.GZ43_366411 |
| 23452 | DTT09604016.1 | 1543 | DTP09604025.1 | 1100 | 2483.J07.GZ43_359878 |
| 23453 | DTT09705033.1 | 1544 | DTP09705042.1 | 323 | 2536.O22.GZ43_370829 |
| 23454 | DTT09742009.1 | 1545 | DTP09742018.1 | 766 | 2456.B12.GZ43_355864 |
| 23454 | DTT09742009.1 | 1545 | DTP09742018.1 | 563 | 2542.N21.GZ43_373108 |
| 23455 | DTT09753017.1 | 1546 | DTP09753026.1 | 910 | 2464.L02.GZ43_357946 |
| 23456 | DTT09793019.1 | 1547 | DTP09793028.1 | 904 | 2464.I04.GZ43_357876 |
| 23457 | DTT09796028.1 | 1548 | DTP09796037.1 | 189 | 2366.L21.GZ43_345942 |
| 23458 | DTT10221016.1 | 1549 | DTP10221025.1 | 592 | 2556.C19.GZ43_373610 |
| 23459 | DTT10360040.1 | 1550 | DTP10360049.1 | 1045 | 2475.M20.GZ43_362309 |
| 23460 | DTT10539016.1 | 1551 | DTP10539025.1 | 527 | 2506.J20.GZ43_366793 |
| 23461 | DTT10564022.1 | 1552 | DTP10564031.1 | 1035 | 2475.H06.GZ43_362175 |
| 23462 | DTT10683041.1 | 1553 | DTP10683050.1 | 561 | 2542.K21.GZ43_373036 |
| 23463 | DTT10819011.1 | 1554 | DTP10819020.1 | 796 | 2457.C19.GZ43_356279 |
| 23463 | DTT10819011.1 | 1554 | DTP10819020.1 | 143 | 2365.J14.GZ43_345456 |
| 23463 | DTT10819011.1 | 1554 | DTP10819020.1 | 1023 | 2474.I06.GZ43_361815 |
| 23464 | DTT11363027.1 | 1555 | DTP11363036.1 | 540 | 2542.C20.GZ43_372843 |
| 23465 | DTT11479018.1 | 1556 | DTP11479027.1 | 521 | 2506.G24.GZ43_366725 |
| 23466 | DTT11483012.1 | 1557 | DTP11483021.1 | 877 | 2459.H09.GZ43_357169 |
| 23467 | DTT11548015.1 | 1558 | DTP11548024.1 | 422 | 2565.C17.GZ43_398204 |
| 23468 | DTT11730017.1 | 1559 | DTP11730026.1 | 264 | 2535.B09.GZ43_370120 |
| 23469 | DTT11791010.1 | 1560 | DTP11791019.1 | 518 | 2506.E12.GZ43_366665 |
| 23470 | DTT11864036.1 | 1561 | DTP11864045.1 | 778 | 2456.H07.GZ43_356003 |
| 23471 | DTT11902028.1 | 1562 | DTP11902037.1 | 1144 | 2490.B06.GZ43_363242 |
| 23472 | DTT11915017.1 | 1563 | DTP11915026.1 | 591 | 2556.C11.GZ43_373602 |
| 23472 | DTT11915017.1 | 1563 | DTP11915026.1 | 1021 | 2474.G17.GZ43_361778 |
| 23472 | DTT11915017.1 | 1563 | DTP11915026.1 | 1163 | 2491.C13.GZ43_363657 |
| 23473 | DTT11966040.1 | 1564 | DTP11966049.1 | 1216 | 2562.E14.GZ43_375573 |
| 23473 | DTT11966040.1 | 1564 | DTP11966049.1 | 818 | 2457.L21.GZ43_356497 |
| 23473 | DTT11966040.1 | 1564 | DTP11966049.1 | 532 | 2506.M13.GZ43_366858 |
| 23474 | DTT12042027.1 | 1565 | DTP12042036.1 | 874 | 2459.G01.GZ43_357137 |
| 23475 | DTT12201062.1 | 1566 | DTP12201071.1 | 759 | 2561.O17.GZ43_376584 |
| 23475 | DTT12201062.1 | 1566 | DTP12201071.1 | 1207 | 2562.B09.GZ43_375496 |
| 23476 | DTT12470020.1 | 1567 | DTP12470029.1 | 1124 | 2489.A13.GZ43_362841 |
| 23476 | DTT12470020.1 | 1567 | DTP12470029.1 | 799 | 2457.D12.GZ43_356296 |
| 23476 | DTT12470020.1 | 1567 | DTP12470029.1 | 690 | 2559.J02.GZ43_374913 |
| 23476 | DTT12470020.1 | 1567 | DTP12470029.1 | 568 | 2555.E20.GZ43_373275 |
| 23477 | DTT12550009.1 | 1568 | DTP12550018.1 | 12 | 2504.G01.GZ43_365934 |

TABLE 148

| SEQ ID | SEQ NAME | ACCESSION | GENBANK DESCRIPTION | GENBANK SCORE |
|---|---|---|---|---|
| 22006 | 2504.C08.GZ43_365845 | AP000321 | gi|4835690|dbj|AP000321.1AP000321 Homo sapiens genomic DNA, chromosome 21q22.1, D21S226-AML region, clone: Q82F5, complete sequence | 1.6E−31 |
| 22007 | 2504.C11.GZ43_365848 | AP002938 | gi|16267134|dbj|AP002938.1AP002938 Hoplostethus japonicus mitochondrial DNA, complete genome | 4.8E−58 |
| 22009 | 2504.D16.GZ43_365877 | AK023496 | gi|10435445|dbj|AK023496.1AK023496 Homo sapiens cDNA FLJ13434 fis, clone PLACE1002578 | 0 |
| 22010 | 2504.E23.GZ43_365908 | M80340 | gi|339767|gb|M80340.1HUMTNL12 Human transposon L1.1 with a base deletion relative to L1.2B resulting in a premature stop codon in t | 6.1E−182 |
| 22011 | 2504.F20.GZ43_365929 | AE007289 | gi|14524175|gb|AE007289.1AE007289 Sinorhizobium meliloti plasmid pSymA section 95 of 121 of the complete plasmid sequence | 2.1E−98 |
| 22017 | 2504.I13.GZ43_365994 | AJ312523 | gi|12830519|emb|AJ312523.1GGO312523 Gorilla gorilla gorilla Xq13.3 chromosome non-coding sequence, isolate G167W | 1.1E−44 |
| 22031 | 2504.O12.GZ43_366137 | AF342020 | gi|12961941|gb|AF342020.1AF342020 Sclerotinia sclerotiorum strain LES-1 28S ribosomal RNA gene, partial sequence; intergenic spacer | 1.1E−90 |
| 22033 | 2505.B05.GZ43_366202 | U93571 | gi|2072968|gb|U93571.1HSU93571 Human L1 element L1.24 p40 gene, complete cds | 1.1E−226 |
| 22037 | 2505.C17.GZ43_366238 | AJ325713 | gi|158701107|emb|AJ325713.1HSA325713 Homo sapiens genomic sequence surrounding NotI site, clone NB1-110S | 1.4E−21 |
| 22040 | 2505.D03.GZ43_366248 | AJ224335 | gi|3413799|emb|AJ224335.1HSAJ4335 Homo sapien mRNA for putative secretory protein, hBET3 | 5.2E−71 |
| 22043 | 2505.E15.GZ43_366284 | AB030001 | gi|7416074|dbj|AB030001.1AB030001 Homo sapiens gene for SGRF, complete cds | 8.1E−55 |
| 22046 | 2505.G16.GZ43_366333 | AE005683 | gi|13421186|gb|AE005683.1AE005683 Caulobacter crescentus section 9 of 359 of the complete genome | 3.6E−63 |
| 22048 | 2505.I04.GZ43_366369 | AF255613 | gi|8925326|gb|AF255613.1AF255613 Homo sapiens teratoma-associated tyrosine kinase (TAPK) gene, exons 1 through 6 and partial cds | 7.9E−73 |
| 22063 | 2505.O09.GZ43_366518 | AF053644 | gi|3598786|gb|AF053644.1HSCSE1G2 Homo sapiens cellular apoptosis susceptibility protein (CSE1) gene, exon 2 | 9.4E−45 |
| 22072 | 2510.C10.GZ43_369083 | AB002353 | gi|2224650|dbj|AB002353.1AB002353 Human mRNA for KIAA0355 gene, complete cds | 1.4E−71 |
| 22078 | 2510.G06.GZ43_369175 | AF084935 | gi|3603422|gb|AF084935.1AF084935 Homo sapiens galactokinase (GALK1) gene, partial cds | 8.9E−24 |
| 22089 | 2510.J11.GZ43_369252 | AK024617 | gi|10436933|dbj|AK024617.1AK024617 Homo sapiens cDNA: FLJ20964 fis, clone ADSH00902 | 0 |
| 22102 | 2510.L21.GZ43_369310 | AK023677 | gi|10435673|dbj|AK023677.1AK023677 Homo sapiens cDNA FLJ13615 fis, clone PLACE1010896, weakly similar to NUF1 PROTEIN | 1.2E−90 |
| 22109 | 2510.N14.GZ43_369351 | AF271388 | gi|8515842|gb|AF271388.1AF271388 Homo sapiens CMP-N-acetylneuraminic acid synthase mRNA, complete cds | 0 |
| 22115 | 2510.O23.GZ43_369384 | AF113169 | gi|4164598|gb|AF113169.1AF113169 Homo sapiens glandular kallikrein enhancer region, complete sequence | 2.2E−39 |
| 22124 | 2365.C20.GZ43_345294 | AF069489 | gi|3560568|gb|AF069489.1HSPDE4A3 Homo sapiens cAMP specific phosphodiesterase 4A varient pde46 (PDE4A) gene, exons 2 through 13 and | 6.6E−24 |
| 22134 | 2365.F24.GZ43_345370 | AK012908 | gi|12849956|dbj|AK012908.1AK012908 Mus musculus 10, 11 days embryo cDNA, RIKEN full-length enriched library, clone: 2810046L04, full | 2.9E−224 |
| 22143 | 2365.J14.GZ43_345456 | BC007999 | gi|14124949|gb|BC007999.1BC007999 Homo sapiens, hypothetical protein FLJ10759, clone MGC: 15757 IMAGE: 3357436, mRNA, complete cds | 4.4E−56 |

TABLE 148-continued

| SEQ ID | SEQ NAME | ACCESSION | GENBANK DESCRIPTION | GENBANK SCORE |
|---|---|---|---|---|
| 22152 | 2365.N12.GZ43_345550 | U20391 | gi|1483626|gb|U20391.1HSU20391 Human folate reeceptor (FOLR1) gene, complete cds | 3.9E-41 |
| 22162 | 2366.E03.GZ43_345647 | AB025285 | gi|5917586|dbj|AB025285.1AB025285 *Homo sapiens* c-ERBB-2 gene, exons 1', 2', 3', 4' | 4.3E-30 |
| 22163 | 2366.J03.GZ43_345652 | M15885 | gi|338414|gb|M15885.1HUMSPP Human prostate secreted seminal plasma protein mRNA, complete cds | 1.1E-68 |
| 22170 | 2366.J06.GZ43_345700 | AF326517 | gi|15080738|gb|AF326517.1AF326517 *Abies grandis* pinene synthase gene, partial cds | 0 |
| 22182 | 2366.K13.GZ43_345813 | U27333 | gi|967202|gb|U27333.1HSU27333 Human alpha(1,3) fucosyltransferase (FUT6) mRNA, major transcript I, complete cds | 2.5E-44 |
| 22189 | 2366.L21.GZ43_345942 | AF272390 | gi|8705239|gb|AF272390.1AF272390 *Homo sapiens* mysoin 5c (MYO5C) mRNA, complete cds | 1.4E-290 |
| 22195 | 2367.B10.GZ43_346028 | AJ279823 | gi|11932035|emb|AJ279823.1ASF279823 Ascovirus SfA V1b partial pol gene for DNA polymerase, Pol2-Pol3-Pol1 fragment | 1.4E-231 |
| 22198 | 2367.C12.GZ43_346054 | BC014669 | gi|15779227|gb|BC014669.1BC014669 *Homo sapiens*, clone IMAGE: 4849317, mRNA, partial cds | 2.9E-57 |
| 22200 | 2367.D18.GZ43_346084 | AE008517 | gi|15459138|gb|AE008517.1AE008517 *Streptococcus pneumoniae* R6 section 133 of 184 of the complete genome | 1.4E-34 |
| 22205 | 2367.F06.GZ43_346120 | AJ330464 | gi|15874882|emb|AJ330464.1HSA330464 *Homo sapiens* genomic sequence surrounding NotI site, clone NR1-IL7C | 3.1E-100 |
| 22206 | 2367.F13.GZ43_3 346127 | AY035075 | gi|14334803|gb|AY035075.1 *Arabidopsis thaliana* putative H+-transporting ATPase (AT4g30190) mRNA, complete cds | 4.1E-229 |
| 22208 | 2367.G13.GZ43_346151 | AK025355 | gi|10437854|dbj|AK025355.1AK025355 *Homo sapiens* cDNA: FLJ21702 fis, clone COL09874 | 1.8E-58 |
| 22209 | 2367.G17.GZ43_346155 | AK000293 | gi|7020278|dbj|AK000293.1AK000293 *Homo sapiens* cDNA FLJ20286 fis, clone HEP04358 | 4.4E-34 |
| 22210 | 2367.G20.GZ43_346158 | AL137592 | gi|6808332|emb|AL137592.1HSM802347 *Homo sapiens* mRNA; cDNA DKFZp434L0610 (from clone DKFZp434L0610); partial cds | 1.6E-60 |
| 22211 | 2367.G22.GZ43_346160 | BC015529 | gi|15930193|gb|BC015529.1BC015529 *Homo sapiens*, Similar to ribose 5-phosphate isomerase A, clone MGC: 9441 IMAGE: 3904718, mRNA, comp | 9.7E-60 |
| 22213 | 2367.I15.GZ43_346201 | AF324172 | gi|12958747|gb|AF324172.1AF324172 *Dictyophora indusiata* strain ASI 32001 internal transcribed spacer 1, partial sequence; 5.8S ribo | 4.8E-65 |
| 22217 | 2367.K24.GZ43_346258 | AF009251 | gi|2352833|gb|AF009251.1CLCN6HUM05 *Homo sapiens* putative chloride channel gene (CLCN6), exon 6 | 3.8E-62 |
| 22219 | 2367.M06.GZ43_346288 | AF178322 | gi|13344845|gb|AF178322.1AF178322 *Schmidtea mediterranea* cytochrome oxidase C subunit I (COI) gene, partial cds; mitochondrial gene | 1.5E-43 |
| 22220 | 2367.M14.GZ43_346296 | AK026286 | gi|10439097|dbj|AK026286.1AK026286 *Homo sapiens* cDNA: FLJ22633 fis, clone HSI06502 | 1E-300 |
| 22221 | 2367.M16.GZ43_346298 | AF368920 | gi|14039926|gb|AF368920.1AF368920 *Caenorhabditis elegans* voltage-dependent calcium channel alpha13 subunit (cca-1) mRNA, complete c | 1.6E-83 |
| 22224 | 2367.N16.GZ43_346322 | Z78727 | gi|1508005|emb|Z78727.1HSPA15B9 *H. sapiens* flow-sorted chromosome 6 HindIII fragment, SC6pA15B9 | 1.3E-37 |
| 22231 | 2368.B18.GZ43_346420 | AK000293 | gi|7020278|dbj|AK000293.1AK000293 *Homo sapiens* cDNA FLJ20286 fis, clone HEP04358 | 5E-34 |
| 22235 | 2368.D08.GZ43_346458 | AJ276936 | gi|12214232|emb|AJ276936.1NME276936 *Neisseria meningitidis* partial tbpB gene for transferrin binding protein B subunit, allele 66, | 0 |

TABLE 148-continued

| SEQ ID | SEQ NAME | ACCESSION | GENBANK DESCRIPTION | GENBANK SCORE |
|---|---|---|---|---|
| 22245 | 2368.I04.GZ43_346574 | AY042191 | gi|15546022|gb|AY042191.1 *Mus musculus* RF-amide G protein-coupled receptor (MrgA1) mRNA, complete cds | 3.1E−26 |
| 22249 | 2368.K21.GZ43_346639 | AJ310931 | gi|15718363|emb|AJ310931.1HSA310931 *Homo sapiens* mRNA for myosin heavy chain | 7E−55 |
| 22252 | 2368.M19.GZ43_346685 | AK025595 | gi|10438161|dbj|AK025595.1AK025595 *Homo sapiens* cDNA: FLJ21942 fis, clone HEP04527 | 4.7E−21 |
| 22257 | 2368.N15.GZ43_346705 | AK014328 | gi|12852104|dbj|AK014328.1AK014328 *Mus musculus* 14, 17 days embryo head cDNA, RIKEN full-length enriched library, clone: 3230401M21, | 3.1E−103 |
| 22258 | 2368.N23.GZ43_346713 | AL391428 | gi|9864373|emb|AL391428.1AL391428 Human DNA sequence from clone RP11-60P19 on chromosome 1, complete sequence [*Homo sapiens*] | 4.8E−28 |
| 22259 | 2368.O03.GZ43_346717 | AK012908 | gi|12849956|dbj|AK012908.1AK012908 *Mus musculus* 10, 11 days embryo cDNA, RIKEN full-length enriched library, clone: 2810046L04, full | 2.1E−227 |
| 22260 | 2368.O11.GZ43_346725 | AF102129 | gi|5922722|gb|AF102129.1AF102129 *Rattus norvegicus* KPL2 (Kp12) mRNA, complete cds | 2.5E−103 |
| 22264 | 2535.B09.GZ43_370120 | AF292648 | gi|12656358|gb|AF292648.1AF292648 *Mus musculus* zinc finger 202 ml (Znf202) mRNA, complete cds | 2E−39 |
| 22267 | 2535.C23.GZ43_370158 | AF307053 | gi|12018057|gb|AF307053.1AF307053 *Thermococcus litoralis* sugar kinase, trehalose/maltose binding protein (malE), trehalose/maltose | 0 |
| 22269 | 2535.F05.GZ43_370212 | AF367433 | gi|14486704|gb|AF367433.1AF367433 *Lotus japonicus* phosphatidylinositol transfer-like protein III (LjPLP-III) mRNA, complete cds | 3.8E−38 |
| 22276 | 2535.L03.GZ43_370354 | AK000099 | gi|7019966|dbj|AK000099.1AK000099 *Homo sapiens* cDNA FLJ20092 fis, clone COL04215 | 7.1E−52 |
| 22280 | 2535.O07.GZ43_370430 | BC008425 | gi|14250051|gb|BC008425.1BC008425 *Homo sapiens*, clone MGC: 14582 IMAGE: 4246114, mRNA, complete cds | 3.8E−34 |
| 22282 | 2535.P02.GZ43_370449 | NM_024074 | gi|13129059|ref|NM_024074.1 *Homo sapiens* hypothetical protein MGC3169 (MGC3169), mRNA | 2.4E−23 |
| 22292 | 2536.A22.GZ43_370493 | AF310311 | gi|13517433|gb|AF310311.1AF310311 *Homo sapiens* isolate Nigeria 9 membrane protein CH1 gene, partial cds | 0 |
| 22297 | 2536.D17.GZ43_370560 | AF015148 | gi|2353128|gb|AF015148.1AF015148 *Homo sapiens* clone HS19.2 Alu-Ya5 sequence | 1.6E−46 |
| 22303 | 2536.G05.GZ43_370620 | AF045605 | gi|3228525|gb|AF045605.1AF045605 *Homo sapiens* germline chromosome 11, 11q13 region | 6.2E−77 |
| 22305 | 2536.G21.GZ43_370636 | AK026490 | gi|10439363|dbj|AK026490.1AK026490 *Homo sapiens* cDNA: FLJ22837 fis, clone KAIA4417 | 3.5E−143 |
| 22306 | 2536.G22.GZ43_370637 | NC_002707 | gi|13540758|ref|NC_002707.1 *Anguilla japonica* mitochondrion, complete genome | 2.3E−39 |
| 22309 | 2536.I05.GZ43_370668 | AK000099 | gi|7019966|dbj|AK000099.1AK000099 *Homo sapiens* cDNA FLJ20092 fis, clone COL04215 | 3.4E−63 |
| 22310 | 2536.I15.GZ43_370678 | AB013897 | gi|6177784|dbj|AB013897.1AB013897 *Homo sapiens* mRNA for HKR1, partial cds | 5.1E−53 |
| 22313 | 2536.J11.GZ43_370698 | AK023448 | gi|10435386|dbj|AK023448.1AK023448 *Homo sapiens* cDNA FLJ13386 fis, clone PLACE1001104, weakly similar to MYOSIN HEAVY CHAIN, NON-MU | 0 |
| 22314 | 2536.K12.GZ43_370723 | U14573 | gi|551542|gb|U14573.1HSU14573 ***ALU WARNING: Human Alu-Sq subfamily consensus sequence | 1E−96 |
| 22319 | 2536.N05.GZ43_370788 | AK001347 | gi|7022548|dbj|AK001347.1AK001347 *Homo sapiens* cDNA FLJ10485 fis, clone NT2RP2000195 | 6.7E−43 |
| 22320 | 2536.N20.GZ43_370803 | Y15724 | gi|3021395|emb|Y15724.1HSSERCA1 *Homo sapiens* SERCA3 gene, exons 1–7 (and joined CDS) | 1.9E−27 |

TABLE 148-continued

| SEQ ID | SEQ NAME | ACCESSION | GENBANK DESCRIPTION | GENBANK SCORE |
|---|---|---|---|---|
| 22330 | 2537.B07.GZ43_370886 | X69516 | gi|288876|emb|X69516.1HSFOLA *H. sapiens* gene for folate receptor | 2.8E−60 |
| 22334 | 2537.D11.GZ43_370938 | NM_025080 | gi|13376633|ref|NM_025080.1 *Homo sapiens* hypothetical protein FLJ22316 (FLJ22316), mRNA | 8.7E−289 |
| 22338 | 2537.G05.GZ43_371004 | L04193 | gi|187144|gb|L04193.1HUMLIMGP Human lens membrane protein (mp19) gene, exon 11 | 7.4E−52 |
| 22341 | 2537.I03.GZ43_371050 | Z78727 | gi|1508005|emb|Z78727.1HSPA15B9 *H. sapiens* flow-sorted chromosome 6 HindIII fragment, SC6pA15B9 | 1.7E−37 |
| 22345 | 2537.K17.GZ43_371112 | AL603947 | gi|15384818|emb|AL603947.1UMA0006 *Ustilago maydis* gene for predicted plasmamembrane-ATPase | 9.3E−76 |
| 22350 | 2537.N23.GZ43_371190 | AF242865 | gi|985870|gb|AF242865.1AF242862S4 *Homo sapiens* coxsackie virus and adenovirus receptor (CXADR) gene, exon 7 and complete cds | 2.4E−30 |
| 22352 | 2537.O05.GZ43_371196 | AB060827 | gi|13874462|dbj|AB060827.1AB060827 *Macaca fascicularis* brain cDNA clone: QtrA-10256, full insert sequence | 2.2E−24 |
| 22356 | 2537.P14.GZ43_371229 | AK026442 | gi|10439307|dbj|AK026442.1AK026442 *Homo sapiens* cDNA: FLJ22789 fis, clone KAIA2171 | 6.3E−256 |
| 22361 | 2538.A10.GZ43_371249 | AK001432 | gi|7022685|dbj|AK001432.1AK001432 *Homo sapiens* cDNA FLJ10570 fis, clone NT2RP2003117 | 1.9E−52 |
| 22363 | 2538.B03.GZ43_371266 | AK013900 | gi|12285449|dbj|AK013900.1AK013900 *Mus musculus* 12 days embryo head cDNA, RIKEN full-length enriched library, clone: 3010026L22, ful | 1.2E−201 |
| 22366 | 2538.C07.GZ43_371294 | AK022973 | gi|10434673|dbj|AK022973.1AK022973 *Homo sapiens* cDNA FLJ12911 fis, clone NT2RP2004425, highly similar to *Mus musculus* axotrophin mR | 0 |
| 22367 | 2538.C14.GZ43_371301 | M87914 | gi|174891|gb|M87914.1HUMALNE461 Human carcinoma cell-derived Alu RNA transcript, clone NE461 | 2E−89 |
| 22368 | 2538.D03.GZ43_371314 | AK022973 | gi|10434673|dbj|AK022973.1AK022973 *Homo sapiens* cDNA FLJ12911 fis, clone NT2RP2004425, highly similar to *Mus musculus* axotrophin mR | 4.3E−275 |
| 22369 | 2538.D04.GZ43_371315 | AK022973 | gi|10434673|dbj|AK022973.1AK022973 *Homo sapiens* cDNA FLJ12911 fis, clone NT2RP2004425, highly similar to *Mus musculus* axotrophin mR | 1.3E−287 |
| 22371 | 2538.E01.GZ43_371336 | AF074397 | gi|3916231|gb|AF074397.1AF074397 *Homo sapiens* anti-mullerian hormone type II receptor (AMHR2) gene, promoter region and partial cds | 4E−40 |
| 22374 | 2538.F03.GZ43_371362 | L34639 | gi|598203|gb|L34639.1HUMPECAM09 *Homo sapiens* platelet/endothelial cell adhesion molecule-1 (PECAM-1) gene, exon 6 | 1.5E−43 |
| 22375 | 2538.H02.GZ43_371409 | AF220173 | gi|9651700|gb|AF220173.1AF220172S2 *Homo sapiens* acid ceramidase (ASAH) gene, exons 2 through 4 | 2.5E−39 |
| 22379 | 2538.I17.GZ43_371448 | AF050179 | gi|3319283|gb|AF050179.1AF050179 *Homo sapiens* CENP-C binding protein (DAXX) mRNA, complete cds | 4.9E−41 |
| 22380 | 2538.J10.GZ43_371465 | AY035075 | gi|14334803|gb|AY035075.1 *Arabidopsis thaliana* putative H+-transporting ATPase (AT4g30190) mRNA, complete cds | 3.5E−245 |
| 22381 | 2538.K17.GZ43_371496 | AK022749 | gi|10434332|dbj|AK022749.1AK022749 *Homo sapiens* cDNA FLJ12687 fis, clone NT2RM4002532, weakly similar to PROTEIN HOM1 | 1.5E−31 |
| 22385 | 2538.M16.GZ4_371543 | AF375410 | gi|14030638|gb|AF375410.1AF375410 *Arabidopsis thaliana* At2g43970/F6E13.10 gene, complete cds | 1.9E−53 |
| 22386 | 2538.M17.GZ43_371544 | AK025473 | gi|10437996|dbj|AK025473.1AK025473 *Homo sapiens* cDNA: FLJ21820 fis, clone HEP01232 | 3.2E−282 |
| 22389 | 2538.P16.GZ43_371615 | AK026286 | gi|10439097|dbj|AK026286.1AK026286 *Homo sapiens* cDNA: FLJ22633 fis, clone HSI06502 | 0 |

TABLE 148-continued

| SEQ ID | SEQ NAME | ACCESSION | GENBANK DESCRIPTION | GENBANK SCORE |
|---|---|---|---|---|
| 22391 | 2554.A06.GZ43_375853 | AK001324 | gi|7022509|dbj|AK001324.1AK001324 *Homo sapiens* cDNA FLJ10462 fis, clone NT2RP1001494, weakly similar to MALE STERILITY PROTEIN 2 | 4E−44 |
| 22394 | 2554.A16.GZ43_375863 | AF271388 | gi|8515842|gb|AF271388.1AF271388 *Homo sapiens* CMP-N-acetylneuraminic acid synthase mRNA, complete cds | 0 |
| 22406 | 2554.I15.GZ43 376054 | AY050376 | gi|15215695|gb|AY050376.1 *Arabidopsis thaliana* AT3g16950/K14A17_7 mRNA, complete cds | 8.8E−27 |
| 22415 | 2554.P16.GZ43_376223 | AK022368 | gi|10433751|dbj|AK022368.1AK022368 *Homo sapiens* cDNA FLJ12306 fis, clone MAMMA 1001907 | 6.7E−46 |
| 22418 | 2565.B13.GZ43_398139 | AL050012 | gi|4884261|emb|AL050012.1HSM800354 *Homo sapiens* mRNA; cDNA DKFZp564K133 (from clone DKFZp564K133) | 1E−44 |
| 22419 | 2565.B15.GZ43_398171 | AY049285 | gi|15146287|gb|AY049285.1 *Arabidopsis thaliana* AT3g58570/F14P22_160 mRNA, complete cds | 2.1E−62 |
| 22422 | 2565.C17.GZ43_398204 | M24543 | gi|341200|gb|M24543.1 HUMPSANTIG Human prostate-specific antigen (PA) gene, complete cds | 2.5E−49 |
| 22423 | 2565.D06.GZ43_398029 | AF331321 | gi|13095271|gb|AF331321.1AF331321 HIV1 isolate T7C44 from the Netherlands nonfunctional pol polyprotein gene, partial sequence | 4.7E−30 |
| 22428 | 2565.G20.GZ43_398256 | AJ276936 | gi|1221232|emb|AJ276936.1NME276936 *Neisseria meningitidis* partial tbpB gene for transferrin binding protein B subunit, allele 66, | 0 |
| 22429 | 2565.H01.GZ43_397953 | AF326517 | gi|15080738|gb|AF326517.1AF326517 *Abies grandis* pinene synthase gene, partial cds | 1E−300 |
| 22433 | 2565.I22.GZ43_398290 | AK001926 | gi|7023492|dbj|AK001926.1AK001926 *Homo sapiens* cDNA FLJ11064 fis, clone PLACE1004824 | 8.9E−295 |
| 22442 | 2565.M14.GZ43_398166 | AF275699 | gi|12275949|gb|AF275699.1AF275699 Unidentified Hailaer soda lake bacterium F16 16S ribosomal RNA gene, partial sequence | 1.4E−21 |
| 22447 | 2565.O07.GZ43_398056 | AK024752 | gi|10437118|dbj|AK024752.1AK024752 *Homo sapiens* cDNA: FLJ21099 fis, clone CAS04610 | 4.3E−51 |
| 22452 | 2540.A24.GZ43_372031 | Z69920 | gi|1217632|emb|Z69920.1HS91K3D Human DNA sequence from cosmid 91K3, Huntington's Disease Region, chromosome 4p16.3 | 1.1E−41 |
| 22463 | 2540.H07.GZ43_372182 | AE008025 | gi|15155943|gb|AE008025.1AE008025 *Agrobacterium tumefaciens* strain C58 circular chromosome, section 83 of 254 of the complete seque | 1.7E−40 |
| 22465 | 2540.I10.GZ43_372209 | AK000658 | gi|7020892|dbj|AK000658.1AK000658 *Homo sapiens* cDNA FLJ20651 fis, clone KAT01814 | 1.3E−53 |
| 22468 | 2540.M22.GZ43_372317 | AF375597 | gi|14150816|gb|AF375597.1AF375596S2 *Mus musculus* medium and short chain L-3-hydroxyacyl-Coenzyme A dehydrogenase (Mschad) gene, exo | 0 |
| 22472 | 2540.C19.GZ43_372074 | AB019559 | gi|4579750|dbj|AB019559.1AB019559 *Sus scrofa* mRNA for 130 kDa regulatory subunit of myosin phosphatase, partial cds | 3.1E−24 |
| 22477 | 2540.F15.GZ43_372142 | AY016428 | gi|13891961|gb|AY016428.1 *Plasmodium falciparum* isolate Fas 30-6-7 apical membrane antigen-1 (AMA-1) gene, partial cds | 2.2E−33 |
| 22485 | 2540.M18.GZ43_372313 | AJ331177 | gi|15875595|emb|AJ331177.1HSA331177 *Homo sapiens* genomic sequence surrounding NotI site, clone NL1-ZF18RS | 7.7E−237 |
| 22507 | 2541.L08.GZ43_372663 | BC003673 | gi|13277537|gb|BC003673.1BC003673 *Homo sapiens*, protamine 1, clone MGC: 12307 IMAGE: 3935638, mRNA, complete cds | 2.6E−53 |
| 22508 | 2541.L12.GZ43_372667 | AJ297708 | gi|12055486|emb|AJ297708.1RNO297708 *Rattus norvegicus* RT6 gene for T cell differentiation marker RT6.2, exons 1–8 | 9.4E−45 |

TABLE 148-continued

| SEQ ID | SEQ NAME | ACCESSION | GENBANK DESCRIPTION | GENBANK SCORE |
|---|---|---|---|---|
| 22514 | 2506.C15.GZ43_366620 | AE007488 | gi\|14973493\|gb\|AE007488.1AE007488 *Streptococcus pneumoniae* TIGR4 section 171 of 194 of the complete genome | 1.4E−287 |
| 22519 | 2506.E18.GZ4_366671 | AK025164 | gi\|10437625\|dbj\|AK025164.1AK025164 *Homo sapiens* cDNA: FLJ21511 fis, clone COL05748 | 0 |
| 22521 | 2506.G24.GZ43_366725 | AY030962 | gi\|13736961\|gb\|AY030962.1 HIV-1 isolate, NC3964-1999 from USA pol polyprotein (pol) gene, partial cds | 9.1E−233 |
| 22527 | 2506.J20.GZ43_366793 | AF152924 | gi\|5453323\|gb\|AF152924.1AF152924 *Mus musculus* syntaxin4-interacting protein synip mRNA, complete cds | 2.3E−79 |
| 22528 | 2506.J22.GZ43_366795 | AK000169 | gi\|7020080\|dbj\|AK000169.1AK000169 *Homo sapiens* cDNA FLJ20162 fis, clone COL09280 | 1.8E−99 |
| 22531 | 2506.M05.GZ43_366850 | AE007580 | gi\|15023517\|gb\|AE007580.1AE007580 *Clostridium acetobutylicum* ATCC824 section 68 of 356 of the complete genome | 2.1E−217 |
| 22534 | 2506.P07.GZ43_366924 | AF035442 | gi\|3142369\|gb\|AF035442.1AF035442 *Homo sapiens* VAV-like protein mRNA, partial cds | 1E−44 |
| 22540 | 2542.C20.GZ43_372843 | AE007424 | gi\|14972724\|gb\|AE007424.1AE007424 *Streptococcus pneumoniae* TIGR4 section 107 of 194 of the complete genome | 2.3E−42 |
| 22543 | 2542.D19.GZ43_372866 | BC008333 | gi\|14249906\|gb\|BC008333.1BC008333 *Homo sapiens*, clone IMAGE: 3506145, mRNA, partial cds | 5.3E−284 |
| 22544 | 2542.F05.GZ43_372900 | AK024179 | gi\|10436495\|dbj\|AK024179.1AK024179 *Homo sapiens* cDNA FLJ14117 fis, clone MAMMA1001785 | 2.4E−41 |
| 22553 | 2542.M09.GZ43_373072 | AK022973 | gi\|1043673\|dbj\|AK022973.1AK022973 *Homo sapiens* cDNA FLJ12911 fis, clone NT2RP2004425, highly similar to *Mus musculus* axotrophin mR | 5.8E−243 |
| 22557 | 2542.P19.GZ43_373154 | AK025164 | gi\|10437625\|dbj\|AK025164.1AK025164 *Homo sapiens* cDNA: FLJ21511 fis, clone COL05748 | 0 |
| 22562 | 2542.M24.GZ43_373087 | AK022173 | gi\|10433509\|dbj\|AK022173.1AK022173 *Homo sapiens* cDNA FLJ12111 fis, clone MAMMA1000025 | 1.2E−284 |
| 22563 | 2542.N21.GZ43_373108 | AF025409 | gi\|2582414\|gb\|AF025409.1AF025409 *Homo sapiens* zinc transporter 4 (ZNT4) mRNA, complete cds | 2E−70 |
| 22567 | 2555.D22.GZ43_373253 | AL1576971 | gi\|11121002\|emb\|AL157697.11AL157697 Human DNA sequence from clone RP5-1092C14 on chromosome 6, complete sequence [*Homo sapiens*] | 1.1E−87 |
| 22568 | 2555.E20.GZ43_373275 | AK026618 | gi\|10439509\|dbj\|AK026618.1AK026618 *Homo sapiens* cDNA: FLJ22965 fis, clone KAT10418 | 0 |
| 22569 | 2555.F16.GZ43_373295 | AF271388 | gi\|8515842\|gb\|AF271388.1AF271388 *Homo sapiens* CMP-N-acetylneuraminic acid synthase mRNA, complete cds | 0 |
| 22574 | 2555.K17.GZ43_373416 | AK026686 | gi\|10439593\|dbj\|AK026686.1AK026686 *Homo sapiens* cDNA: FLJ23033 fis, clone LNG02005 | 1.8E−23 |
| 22578 | 2555.P22.GZ43_373541 | AF087913 | gi\|5081331\|gb\|AF087913.1AF087913 Human endogenous retrovirus HERV-P-T47D | 5.8E−74 |
| 22579 | 2555.A11.GZ43_373170 | NC_000957 | gi\|11497445\|ref\|NC_000957.1 *Borrelia burgdorferi* plasmid lp5, complete sequence | 1.3E−57 |
| 22585 | 2555.I12.GZ43_373363 | AJ276936 | gi\|12214232\|emb\|AJ276936.1NME276936 *Neisseria meningitidis* partial tbpB gene for transferrin binding protein B subunit, allele 66, | 1.6E−237 |
| 22589 | 2556.A02.GZ43_373545 | AE007289 | gi\|14524175\|gb\|AE007289.1AE007289 *Sinorhizobium meliloti* plasmid pSymA section 95 of 121 of the complete plasmid sequence | 2E−55 |
| 22591 | 2556.C11.GZ43_373602 | AY039252 | gi\|15418981\|gb\|AY039252.1 *Macaca mulatta* immunoglobulin alpha heavy chain constant region (IgA) gene, IgA-C.II allele, partial cds | 3.1E−29 |
| 22602 | 2556.H15.GZ43_373726 | AK021966 | gi\|10433275\|dbj\|AK021966.1AK021966 *Homo sapiens* cDNA FLJ11904 fis, clone HEMBB1000048 | 1.6E−70 |

TABLE 148-continued

| SEQ ID | SEQ NAME | ACCESSION | GENBANK DESCRIPTION | GENBANK SCORE |
|---|---|---|---|---|
| 22620 | 2557.B22.GZ43_373973 | AB071392 | gi\|15721873\|dbj\|AB071392.1AB071392 Expression vector pAQ-EX1 DNA, complete sequence | 1.2E−25 |
| 22627 | 2557.J14.GZ43_374157 | AK023721 | gi\|10435737\|dbj\|AK023721.1AK023721 *Homo sapiens* cDNA FLJ13659 fis, clone PLACE1011576, moderately similar to Human Kruppel related | 1.6E−209 |
| 22635 | 2557.N14.GZ43_374253 | AB013897 | gi\|6177784\|dbj\|AB013897.1AB013897 *Homo sapiens* mRNA for HKR1, partial cds | 1E−44 |
| 22648 | 2558.B24.GZ43_374359 | AB064318 | gi\|14595115\|dbj\|AB064318.1AB064318 *Comamonas testosteroni* gene for 16S rRNA, partial sequence | 4.6E−28 |
| 22657 | 2558.G07.GZ43_374462 | M92069 | gi\|337698\|gb\|M92069.1HUMRTVLC Human retrovirus-like sequence-isoleucine c (RTVL-Ic) gene, Alu repeats | 6.7E−46 |
| 22661 | 2558.H17.GZ43_374496 | AK023812 | gi\|10435860\|dbj\|AK023812.1AK023812 *Homo sapiens* cDNA FLJ13750 fis, clone PLACE3000331 | 5.2E−31 |
| 22662 | 2558.J01.GZ43_374528 | AK023448 | gi\|10435386\|dbj\|AK023448.1AK023448 *Homo sapiens* cDNA FLJ13386 fis, clone PLACE1001104, weakly similar to MYOSIN HEAVY CHAIN, NON-MU | 4.8E−278 |
| 22666 | 2558.K02.GZ43_374553 | U14573 | gi\|551542\|gb\|U14573.1HSU14573 ***ALU WARNING: Human Alu-Sq subfamily consensus sequence | 1.3E−62 |
| 22683 | 2559.D05.GZ43_374772 | AF338713 | gi\|14039582\|gb\|AF338713.1AF338713 *Casuarius casuarius* mitochondrion, partial genome | 4E−297 |
| 22687 | 2559.I12.GZ43_374899 | AY036096 | gi\|14486435\|gb\|AY036096.1 HIV-1 isolate L2Q2P from Belgium reverse transcriptase (pol) gene, partial cds | 1.4E−41 |
| 22690 | 2559.J02.GZ43_374913 | AK026618 | gi\|10439509\|dbj\|AK026618.1AK026618 *Homo sapiens* cDNA: FLJ22965 fis, clone KAT10418 | 0 |
| 22692 | 2559.K12.GZ43_374947 | Z96776 | gi\|2181853\|emb\|Z96776.1HS9QT023 *H. sapiens* telomeric DNA sequence, clone 9QTEL023, read 9QTELOO023.seq | 5.1E−52 |
| 22694 | 2559.L09.GZ43_374968 | AE007426 | gi\|14972746\|gb\|AE007426.1AE007426 *Streptococcus pneumoniae* TIGR4 section 109 of 194 of the complete genome | 8.1E−21 |
| 22696 | 2559.M21.GZ43_375004 | AJ414564 | gi\|15990852\|emb\|AJ414564.1HSA414564 *Homo sapiens* mRNA for connexin40.1 (CX40.1 gene) | 9.2E−30 |
| 22698 | 2559.N13.GZ43_375020 | AL137330 | gi\|6807822\|emp\|AL137330.1HSM802010 *Homo sapiens* mRNA; cDNA DKFZp434F0272 (from clone DKFZp434F0272) | 4.1E−47 |
| 22714 | 2560.H01.GZ43_375248 | U14567 | gi\|551536\|gb\|U14567.1HSU14567 ***ALU WARNING: Human Alu-J subfamily consensus sequence | 2.7E−42 |
| 22719 | 2560.K02.GZ43_375321 | AF178754.3 | gi\|7770069\|gb\|AF178754.3AF178754 *Homo sapiens* lithium-sensitive myoinositol monophosphatase A1 (IMPA1) gene, promoter region and p | 3.1E−51 |
| 22720 | 2560.K08.GZ43_375327 | AK009327 | gi\|12844057\|dbj\|AK009327.1AK009327 *Mus musculus* adult male tongue cDNA, RIKEN full-length enriched library, clone: 2310012P17, full | 6.3E−80 |
| 22721 | 2560.K10.GZ43_375329 | AF344987 | gi\|13448249\|gb\|AF344987.1AF344987 Hepatitis C virus isolate RDpostSC1c2 polyprotein gene, partial cds | 1E−300 |
| 22729 | 2560.O08.GZ43_375423 | AY037285 | gi\|15982643\|gb\|AY037285.1AY037284S2 HIV-1 from Cameroon vpu protein (vpu) and envelope glycoprotein (env) genes, complete cds; and | 5.2E−54 |
| 22732 | 2561.B03.GZ43_376258 | AF035968.2 | gi\|8714504\|gb\|AF035968.2AF035968 *Home sapiens* integrin alpha 2 (ITGA2) gene, ITGA2-1 allele, exons 6–9, and partial, cds | 3.9E−32 |
| 22733 | 2561.B12.GZ43_376267 | AP000276 | gi\|4835645\|dbj\|AP000276.1AP000276 *Homo sapiens* genomic DNA, chromosome 21q22.1, D21S226-AML region, clone: 55A9, complete sequence | 1.9E−27 |
| 22750 | 2561.M09.GZ43_376528 | AF052684 | gi\|2995716\|gb\|AF052684.1HSPRACAD2 *Homo sapiens* protocadherin 43 gene, exon 2 | 4.1E−41 |

TABLE 148-continued

| SEQ ID | SEQ NAME | ACCESSION | GENBANK DESCRIPTION | GENBANK SCORE |
|---|---|---|---|---|
| 22753 | 2561.E22.GZ43_376349 | AF132952 | gi\|4680674\|gb\|AF132952.1AF132952 Homo sapiens CGI-18 protein mRNA, complete cds | 3E−41 |
| 22754 | 2561.G20.GZ43_376395 | U14573 | gi\|551542\|gb\|U14573.1HSU14573 ***ALU WARNING: Human Alu-Sq subfamily consensus sequence | 1.5E−71 |
| 22755 | 2561.H17.GZ43_376416 | AF052685 | gi\|2995717\|gb\|AF052685.1HSPRCAD3 Homo sapiens protocadherin 43 gene, exon 3, exon 4, and complete cds | 2.1E−24 |
| 22756 | 2561.I19.GZ43_376442 | AF344987 | gi\|13448249\|gb\|AF344987.1AF344987 Hepatitis C virus isolate RDpostsSC1c2 polyprotein gene, partial cds | 3.2E−201 |
| 22761 | 2561.P16.GZ43_376607 | Z78727 | gi\|1508005\|emb\|Z78727.1HSPA15B9 H. sapiens flow-sorted chromosome 6 HindIII fragment, SC6pA15B9 | 1.6E−37 |
| 22762 | 2561.P19.GZ43_376610 | U66535 | gi\|2270915\|gb\|U66535.1HSITGBF07 Human beta4-integrin (ITGB4) gene, exons 19, 20, 21, 22, 23, 24 and 25 | 8.6E−41 |
| 22763 | 2561.P23.GZ43_376614 | AF167458 | gi\|6467463\|gb\|AF167458.1HSDSRPKR04 Homo sapiens double stranded RNA activated protein kinase (PKR) gene, intron 1 | 1E−22 |
| 22771 | 2456.D04.GZ43_355904 | AF307053 | gi\|12018057\|gb\|AF307053.1AF307053 Thermococcus litoralis sugar kinase, trehalose/maltose binding protein (malE), trehalose/maltose | 0 |
| 22777 | 2456.H02.GZ43_355998 | AJ005821 | gi\|3123571\|emb\|AJ005821.1HSA5821 Homo sapiens mRNA for X-like 1 protein | 5.8E−37 |
| 22788 | 2456.N23.GZ43_356163 | AF188746 | gi\|6425045\|gb\|AF188746.1AF188746 Homo sapiens prostrate kallikrein 2 (KLK2) mRNA, complete cds | 9.6E−63 |
| 22796 | 2457.C19.GZ43_356279 | AF368920 | gi\|14039926\|gb\|AF368920.1AF368920 Caenorhabditis elegans voltage-dependent calcium channel alpha13 subunit (cca-1) mRNA, complete c | 1E−47 |
| 22799 | 2457.D12.GZ43_356296 | AK026618 | gi\|10439509\|dbj\|AK026618.AK026618 Homo sapiens cDNA: FLJ22965 fis, clone KAT10418 | 0 |
| 22810 | 2457.H17.GZ43_356397 | AE007614 | gi\|15023883\|gb\|AE007614.1AE007614 Clostridium acetobutylicum ATCC824 section 102 of 356 of the complete genome | 9E−63 |
| 22823 | 2458.A10.GZ43_356618 | AK026920 | gi\|10439892\|dbj\|AK026920.1AK026920 Homo sapiens cDNA: FLJ23267 fis, clone COL07266 | 6.2E−84 |
| 22827 | 2458.B23.GZ43_356655 | AB050432 | gi\|10998295\|dbj\|AB050432.1AB050432 Macaca fascicularis brain cDNA, clone: QnpA-21861 | 4.3E−129 |
| 22829 | 2458.C06.GZ43_356662 | U49973 | gi\|2226003\|gb\|U49973.1HSU49973 Human Tigger1 transposable element, complete consensus sequence | 2E−24 |
| 22842 | 2458.I09.GZ43_356809 | AK023496 | gi\|10435445\|dbj\|AK023496.1AK023496 Homo sapiens cDNA FLJ13434 fis, clone PLACE1002578 | 2.4E−39 |
| 22843 | 2458.I10.GZ43_356810 | AF031077 | gi\|6649934\|gb\|AF031077.1AF031077 Homo sapiens chromosome X, cosmid LLNLc110C1837, complete sequence | 1.3E−52 |
| 22845 | 2458.I17.GZ43_356817 | AK026569 | gi\|10439451\|dbj\|AK026569.1AK026569 Homo sapiens cDNA: FLJ22916 fis, clone KAT06406, highly similar to HSCYCR Human mRNA for T-cell | 1.8E−38 |
| 22846 | 2458.I20.GZ43_356820 | AF184614 | gi\|6983939\|gb\|AF184614.1AF184614 Homo sapiens p47-phox (NCF1) gene, complete cds | 4.2E−33 |
| 22855 | 2458.N06.GZ43_356926 | AF367251 | gi\|14161363\|gb\|AF367251.1AF367251 Helicobacter pylori strain CAPM N93 cytotoxin associated protein A (cagA) gene, complete cds | 2.2E−70 |
| 22865 | 2459.B11.GZ43_357027 | AF375597 | gi\|14150816\|gb\|AF375597.1AF375596S2 Mus musculus medium and short chain L-3-hydroxyacyl-Coenzyme A dehydrogenase (Mschad) gene, exo | 0 |
| 22866 | 2459.C05.GZ43_357045 | X04803.2 | gi\|6647297\|emb\|X04803.2HSYUBG1 Homo sapiens ubiquitin gene | 6.4E−52 |
| 22873 | 2459.F20.GZ43_357132 | AK025207 | gi\|10437672\|dbj\|AK025207.1AK025207 Homo sapiens cDNA: FLJ21554 fis, clone COL06330 | 0 |

TABLE 148-continued

| SEQ ID | SEQ NAME | ACCESSION | GENBANK DESCRIPTION | GENBANK SCORE |
|---|---|---|---|---|
| 22877 | 2459.H09.GZ43_357169 | AB046623 | gi\|9651056\|dbj\|AB046623.1AB046623 *Macaca fascicularis* brain cDNA, clone QccE-10576 | 1.7E−35 |
| 22888 | 2459.O23.GZ43_357351 | AL049301 | gi\|4500067\|emb\|AL049301.1HSM800086 *Homo sapiens* mRNA; cDNA DKFZp564P073 (from clone DKFZp564P073) | 1.3E−31 |
| 22889 | 2459.P24.GZ43_357376 | AK018110 | gi\|12857675\|dbj\|AK018110.1AK018110 *Mus musculus* adult male medulla oblongata cDNA, RIKEN full-length enriched library, clone: 633040 | 1.5E−33 |
| 22903 | 2464.H22.GZ43_357870 | AB035344 | gi\|8176599\|dbj\|AB035344.1AB035344S1 *Homo sapiens* TCL6 gene, exon 1–10b | 1.1E−127 |
| 22904 | 2464.I04.GZ43_357876 | AK025125 | gi\|10437578\|dbj\|AK025125.1AK025125 *Homo sapiens* cDNA: FLJ21472 fis, clone COL04936 | 0 |
| 22905 | 2464.I20.GZ43_357892 | AK025966 | gi\|10438647\|dbj\|AK025966.1AK025966 *Homo sapiens* cDNA: FLJ22313 fis, clone HRC05216 | 2.8E−61 |
| 22909 | 2464.K18.GZ43_357938 | AF287938 | gi\|12656333\|gb\|AF287938.1AF287938 *Guichenotia ledifolia* NADH dehydrogenase subunit F (ndhF) gene, partial cds; chloroplast gene for | 8.3E−44 |
| 22912 | 2464.L15.GZ43_357959 | AF141308 | gi\|5737754\|gb\|AF141308.1HSPMFG1 *Homo sapiens* polyamine modulated factor-1 (PMF1) gene, exon 1 | 9.9E−76 |
| 22918 | 2464.P17.GZ43_358057 | AF052684 | gi\|2995716\|gb\|AF052684.1HSPRCAD2 *Homo sapiens* protocadherin 43 gene, exon 2 | 3E−29 |
| 22934 | 2465.J19.GZ43_358299 | X02571 | gi\|31870\|emb\|X02571.1HSGP5MOS Human gene fragment related to oncogene c-mos with Alu repeats (locus gp5, region NV-1) | 2.7E−48 |
| 22935 | 2465.K20.GZ43_358324 | AK019509 | gi\|12859761\|dbj\|AK019509.1AK019509 *Mus musculus* 0 day neonate skin cDNA, RIKEN full-length enriched library, clone: 4632435C11, full | 2.5E−63 |
| 22937 | 2465.L06.GZ43_358334 | AK009327 | gi\|12844057\|dbj\|AK009327.1AK009327 *Mus musculus* adult male tongue cDNA, RIKEN full-length enriched library, clone: 2310012P17, full | 7.9E−73 |
| 22939 | 2465.M11.GZ43_358363 | AK022253 | gi\|10433611\|dbj\|AK022253.1AK022253 *Homo sapiens* cDNA FLJ12191 fis, clone MAMMA1000843 | 1.4E−112 |
| 22943 | 2466.B02.GZ43_360107 | AK023055 | gi\|10434796\|dbj\|AK023055.1AK023055 *Homo sapiens* cDNA FLJ12993 fis, clone NT2RP3000197 | 7.5E−39 |
| 22944 | 2466.C15.GZ43_360144 | AB013897 | gi\|6177784\|dbj\|AB013897.1AB013897 *Homo sapiens* mRNA for HKR1, partial cds | 4.3E−53 |
| 22945 | 2466.D19.GZ43_360172 | AL050141 | gi\|4884352\|emb\|AL050141.1HSM800441 *Homo sapiens* mRNA; cDNA DKFZp586O031 (from clone DKFZp586O031) | 3.4E−110 |
| 22952 | 2466.I08.GZ43_360281 | AJ271729 | gi\|6900103\|emb\|AJ271729.1HSA271729 *Homo sapiens* mRNA for glucose-regulated protein (HSPA5 gene) | 6.2E−72 |
| 22953 | 2466.J01.GZ43_360298 | AY058527 | gi\|16197970\|gb\|AY058527.1 *Drosophila melanogaster* LD23445 full length cDNA | 9.4E−40 |
| 22954 | 2466.J24.GZ43_360321 | AF331425 | gi\|13375486\|gb\|AF331425.1AF331425 HIV-1 D311 from Australia envelope protein (env) gene, partial cds | 1.6E−77 |
| 22958 | 2467.B24.GZ43_360513 | AJ005821 | gi\|3123571\|emb\|AJ005821.1HSA5821 *Homo sapiens* mRNA for X-like 1 protein | 1.4E−34 |
| 22963 | 2467.H18.GZ43_360651 | AF036235 | gi\|2695679\|gb\|AF036235.1AF036235 *Gorilla gorilla* L1 retrotransposon L1Gg-1A, complete sequence | 2E−169 |
| 22964 | 2467.A03.GZ43_360468 | BC012960 | gi\|5277963\|gb\|BC012960.1BC012960 *Mus musculus*, ring finger protein 12, clone MGC: 13712 IMAGE: 4193003, mRNA, complete cds | 8.7E−36 |
| 22965 | 2467.A05.GZ43_360470 | BC009113 | gi\|14318629\|gb\|BC009113.1BC009113 *Homo sapiens*, clone MGC: 18122 IMAGE: 4153377, mRNA, complete cds | 4.1E−167 |
| 22969 | 2467.G01.GZ43_360610 | U14573 | gi\|551542\|gb\|U14573.1HSU14573 ***ALU WARNING: Human Alu-Sq subfamily consensus sequence | 2E−61 |

TABLE 148-continued

| SEQ ID | SEQ NAME | ACCESSION | GENBANK DESCRIPTION | GENBANK SCORE |
|---|---|---|---|---|
| 22971 | 2467.N22.GZ43_360799 | AF117756 | gi|4530440|gb|AF117756.1AF117756 Homo sapiens thyroid hormone receptor-associated protein complex component TRAP150 mRNA, complete | 6.8E−77 |
| 22973 | 2467.I12.GZ43_360669 | AK024049 | gi|10436318|dbj|AK024049.1AK024049 Homo sapiens cDNA FLJ13987 fis, clone Y79AA1001963, weakly similar to PUTATIVE PRE-MRNA SPLICING | 2.1E−47 |
| 22977 | 2467.K14.GZ43_360719 | AB030001 | gi|7416074|dbj|AB030001.1AB030001 Homo sapiens gene for SGRF, complete cds | 7.2E−22 |
| 22979 | 2467.N03.GZ43_360780 | AK023448 | gi|10435386|dbj|AK023448.1AK023448 Homo sapiens cDNA FLJ13386 fis, clone PLACE1001104, weakly similar to MYOSIN HEAVY CHAIN, NON-MU | 0 |
| 22980 | 2467.N07.GZ43_360784 | AK001931 | gi|7023502|dbj|AK001931.1AK001931 Homo sapiens cDNA FLJ11069 fis, clone PLACE1004930, highly similar to Homo sapiens MDC-3.13 isofo | 2.3E−54 |
| 22981 | 2467.N09.GZ43_360786 | AE008338 | gi|15159908|gb|AE008338.1AE008338 Agrobacterium tumefaciens strain C58 linear chromosome, section 142 of 187 of the complete sequen | 3.7E−50 |
| 22986 | 2472.C18.GZ43_360915 | K01921 | gi|339606|gb|K01921.1HUMTGNB Human Asn-tRNA gene, clone pHt6-2, complete sequence and flanks | 3E−29 |
| 22992 | 2472.G03.GZ43_360996 | AF321082 | gi|12958576|gb|AF321082.1AF321082 HIV-1 isolate DGOB from France envelope glycoprotein (env) gene, complete cds | 5.1E−28 |
| 22999 | 2472.M22.GZ43_361159 | AF338299 | gi|12958808|gb|AF338299.1AF338299 Amazona ochrocephala auropalliata mitochondrial control region 1, partial sequence | 1.4E−145 |
| 23002 | 2472.P22.GZ43_361231 | AJ330257 | gi|15874675|emb|AJ330257.1HSA330257 Homo sapiens genomic sequence surrounding NotI site, clone NL1-FA14R | 1.1E−63 |
| 23005 | 2473.F08.GZ43_361361 | AF306355 | gi|14573206|gb|AF306355.1AF306355 Homo sapiens clone TF3.19 immunoglobulin heavy chain variable region mRNA, partial cds | 3.2E−29 |
| 23006 | 2473.F14.GZ43_361367 | AB050477 | gi|11034759|dbj|AB050477.1AB050477 Homo sapiens NIBAN mRNA, complete cds | 0 |
| 23011 | 2473.I08.GZ43_361433 | AF224341 | gi|15982934|gb|AF224341.1AF224341 Mus musculus thiamine transporter 1 (S1c19a2) gene, exons 1 through 6 and complete cds | 8.7E−67 |
| 23015 | 2473.O13.GZ43_361582 | AF203815 | gi|6979641|gb|AF203815.1AF203815 Homo sapiens alpha gene sequence | 5.4E−44 |
| 23018 | 2474.C08.GZ43_361673 | AK000373 | gi|7020417|dbj|AK000373.1AK000373 Homo sapiens cDNA FLJ20366 fis, clone HEP18008 | 5.6E−47 |
| 23021 | 2474.G17.GZ43_361778 | U75285 | gi|2315862|gb|U75285.1HSU75285 Homo sapiens apoptosis inhibitor survivin gene, complete cds | 1.1E−87 |
| 23023 | 2474.I06.GZ43_361815 | Z81315 | gi|1644298|emb|Z81315.1HSF62D4 Human DNA sequence from fosmid F62D4 on chromosome 22q12-qter | 2.1E−67 |
| 23024 | 2474.J18.GZ43_361851 | AF029062 | gi|3712662|gb|AF029062.1AF029062 Homo sapiens DEAD-box protein (BAT1) gene, partial cds | 1.2E−28 |
| 23030 | 2474.P22.GZ43_361999 | AL050204 | gi|4884443|emb|AL050204.1HSM800501 Homo sapiens mRNA; cDNA DKFZp586F1223 (from clone DKFZp586F1223) | 8.9E−33 |
| 23031 | 2475.A05.GZ43_362006 | AL109666 | gi|5689800|emb|AL109666.1IRO35907 Homo sapiens mRNA full length insert cDNA clone EUROIMAGE 35907 | 6.3E−43 |
| 23032 | 2475.C18.GZ43_362067 | AK023739 | gi|10435762|dbj|AK023739.1AK023739 Homo sapiens cDNA FLJ13677 fis, clone PLACE1011982 | 2.8E−180 |
| 23033 | 2475.E18.GZ43_362115 | AK024206 | gi|10436527|dbj|AK024206.1AK024206 Homo sapiens cDNA FLJ14144 fis, clone MAMMA1002909 | 1.9E−21 |
| 23035 | 2475.H06.GZ43_362175 | AF322634 | gi|12657820|gb|AF322634.1AF322634S1 Human herpesvirus 3 strain VZV-Iceland glycoprotein B gene, complete cds | 1.2E−173 |

TABLE 148-continued

| SEQ ID | SEQ NAME | ACCESSION | GENBANK DESCRIPTION | GENBANK SCORE |
|---|---|---|---|---|
| 23036 | 2475.H13.GZ43_362182 | AF026853 | gi|3882436|gb|AF026853.1HSHADHSC 1 *Homo sapiens* mitochondrial short-chain L-3-hydroxyacyl-CoA dehydrogenase (HADHSC) gene, nuclear | 2.1E−30 |
| 23039 | 2475.N08.GZ43_362321 | AK011295 | gi|12847322|dbj|AK011295.1AK011295 *Mus musculus* 10 days embryo cDNA, RIKEN full-length enriched library, clone: 2610002L04, full ins | 1.1E−84 |
| 23045 | 2475.M20.GZ43_362309 | AK023843 | gi|10435902|dbj|AK023843.1AK023843 *Homo sapiens* cDNA FLJ13781 fis, clone PLACE4000465 | 8.8E−42 |
| 23046 | 2475.N21.GZ43_362334 | S45332 | gi|255496|gb|S45332.1S45332 erythropoietin receptor [human, placental, Genomic, 8647 nt] | 1.4E−101 |
| 23055 | 2480.G11.GZ43_358658 | X83497 | gi|603558|emb|X83497.1HSLTRERV9 *H. sapiens* DNA for ZNF80-linked ERV9 long terminal repeat | 6.1E−40 |
| 23056 | 2480.H06.GZ43_358677 | AB002070 | gi|12862447|dbj|AB002070.1AB002070 *Aspergillus clavatus* gene for 18S rRNA, partial sequence, strain: NRRL 1 | 5.5E−28 |
| 23061 | 2480.M20.GZ43_358811 | AL1576971 | gi|11121002|emb|AL157697.11AL157697 Human DNA sequence from clone RP5-1092C14 on chromosome 6, complete sequence [*Homo sapiens*] | 9.3E−36 |
| 23064 | 2480.P23.GZ43_358886 | AB037719 | gi|7242950|dbj|AB037719.1AB037719 *Homo sapiens* mRNA for KIAA1298 protein, partial cds | 3.6E−35 |
| 23065 | 2481.B06.GZ43_358917 | AK023471 | gi|10435415|dbj|AK023471.1AK023471 *Homo sapiens* cDNA FLJ13409 fis, clone PLACE1001716 | 0 |
| 23068 | 2481.D10.GZ43_358969 | AL021306 | gi|2808416|emb|AL021306.1HS1109B5 Human DNA sequence from clone CTB-1109B5 on chromosome 22 Contains a GSS, complete sequence [*Homo* | 7E−52 |
| 23069 | 2481.D13.GZ43_358972 | X64467 | gi|28579|emb|X64467.1HSALADG *H. sapiens* ALAD gene for porphobilinogen synthase | 4.2E−53 |
| 23075 | 2481.K12.GZ43_359139 | AK026901 | gi|10439868|dbj|AK026901.1AK026901 *Homo sapiens* cDNA: FLJ23248 fis, clone COL03555 | 5.9E−52 |
| 23083 | 2482.E17.GZ43_359384 | AK022821 | gi|10434440|dbj|AK022821.1AK022821 *Homo sapiens* cDNA FLJ12759 fis, clone NT2RP2001347 | 9.4E−35 |
| 23084 | 2482.E20.GZ43_359387 | AK014328 | gi|12852104|dbj|AK014328.1AK014328 *Mus musculus* 14, 17 days embryo head cDNA, RIKEN full-length enriched library, clone: 3230401M21, | 5.2E−99 |
| 23091 | 2482.N09.GZ43_359592 | AE008514 | gi|15459095|gb|AE008514.1AE008514 *Streptococcus pneumoniae* R6 section 130 of 184 of the complete genome | 6.9E−107 |
| 23100 | 2483.J07.GZ43_359878 | AK022722 | gi|10434285|dbj|AK022722.1AK022722 *Homo sapiens* cDNA FLJ12660 fis, clone NT2RM4002174, moderately similar to MRP PROTEIN | 1E−300 |
| 23101 | 2483.K02.GZ43_359897 | AK012908 | gi|12849956|dbj|AK012908.1AK012908 *Mus musculus* 10, 11 days embryo cDNA, RIKEN full-length enriched library, clone: 2810046L04, full | 3.7E−189 |
| 23106 | 2483.O07.GZ43_359998 | AK014328 | gi|12852104|dbj|AK014328.1AK014328 *Mus musculus* 14, 17 days embryo head cDNA, RIKEN full-length enriched library, clone: 3230401M21, | 3.2E−103 |
| 23108 | 2488.C19.GZ43_362511 | AB023199 | gi|4589607|dbj|AB023199.1AB023199 *Homo sapiens* mRNA for KIAA0982 protein, complete cds | 1.1E−50 |
| 23110 | 2488.E20.GZ43_362560 | AK001136 | gi|7022203|dbj|AK001136.1AK001136 *Homo sapiens* cDNA FLJ10274 fis, clone HEMBB1001169 | 1E−35 |
| 23111 | 2488.F06.GZ43_362570 | AK011295 | gi|12847322|dbj|AK011295.1AK011295 *Mus musculus* 10 days embryo cDNA, RIKEN full-length enriched library, clone: 2610002L04, full ins | 8.1E−55 |
| 23113 | 2488.G02.GZ43_362590 | X15723 | gi|31481|emb|X15723.1HSFURIN Human fur gene, exons 1 through 8 | 1.8E−85 |

TABLE 148-continued

| SEQ ID | SEQ NAME | ACCESSION | GENBANK DESCRIPTION | GENBANK SCORE |
|---|---|---|---|---|
| 23117 | 2488.K04.GZ43_362688 | AF026853 | gi\|3882436\|gb\|AF026853.1HSHADHSC 1 *Homo sapiens* mitochondrial short-chain L-3-hydroxyacyl-CoA dehydrogenase (HADHSC) gene, nuclear | 2.1E−30 |
| 23122 | 2489.A03.GZ43_362831 | AB050477 | gi\|11034759\|dbj\|AB050477.1AB050477 *Homo sapiens* NIBAN mRNA, complete cds | 6.7E−46 |
| 23124 | 2489.A13.GZ43_362841 | AK026618 | gi\|10439509\|dbj\|AK026618.1AK026618 *Homo sapiens* cDNA: FLJ22965 fis, clone KAT10418 | 1.8E−178 |
| 23127 | 2489.D18.GZ43_362918 | AF086310 | gi\|3483655\|gb\|AF086310.1HUMZD51F08 *Homo sapiens* full length insert cDNA clone ZD51F08 | 2.5E−79 |
| 23128 | 2489.F09.GZ43_362957 | AF271388 | gi\|8515842\|gb\|AF271388.1AF271388 *Homo sapiens* CMP-N-acetylneuraminic acid synthase mRNA, complete cds | 0 |
| 23129 | 2489.G05.GZ43_362977 | AK023739 | gi\|10435762\|dbj\|AK023739.1AK023739 *Homo sapiens* cDNA FLJ13677 fis, clone PLACE1011982 | 6.8E−209 |
| 23140 | 2489.M11.GZ43_363127 | AE008029 | gi\|15155994\|gb\|AE008029.1AE008029 *Agrobacterium tumefaciens* strain C58 circular chromosome, section 87 of 254 of the complete seque | 4.2E−44 |
| 23144 | 2490.B06.GZ43_363242 | AK001915 | gi\|7023475\|dbj\|AK001915.1AK001915 *Homo sapiens* cDNA FLJ11053 fis, clone PLACE1004664 | 1.7E−43 |
| 23155 | 2490.J22.GZ43_363450 | AF026853 | gi\|3882436\|gb\|AF026853.1HSHADHSC 1 *Homo sapiens* mitochondrial short-chain L-3-hydroxyacyl-CoA dehydrogenase (HADHSC) gene, nuclear | 2E−30 |
| 23160 | 2490.N24.GZ43_363548 | AF167438 | gi\|9622123\|gb\|AF167438.1AF167438 *Homo sapiens* androgen-regulated short-chain dehydrogenase/reductase 1 (ARSDR1) mRNA, complete cds | 8.8E−74 |
| 23163 | 2491.C13.GZ43_363657 | AK022338 | gi\|10433714\|dbj\|AK022338.1AK022338 *Homo sapiens* cDNA FLJ12276 fis, clone MAMMA1001692 | 6.2E−30 |
| 23174 | 2491.P10.GZ43_363966 | AJ276936 | gi\|12214232\|emb\|AJ276936.1NME276936 *Neisseria meningitidis* partial tbpB gene for transferrin binding protein B subunit, allele 66, | 0 |
| 23175 | 2491.P20.GZ43_363976 | AY027632 | gi\|15418751\|gb\|AY027632.1 Measles virus strain MVs/Masan.KOR/49.00/2 hemagglutinin (H) mRNA, complete cds | 7.8E−283 |
| 23177 | 2496.C08.GZ43_364139 | U67829 | gi\|2289943\|gb\|U67829.1HSU67829 Human primary Alu transcript | 3.6E−90 |
| 23181 | 2496.F14.GZ43_364217 | X16983 | gi\|33945\|emb\|X16983.1HSINTAL4 Human mRNA for integrin alpha-4 subunit | 4.7E−53 |
| 23183 | 2496.I06.GZ43_364281 | BC004138 | gi\|13278716\|gb\|BC004138.1BC004138 *Homo sapiens*, ribosomal protein L6, clone MGC: 1635 IMAGE: 2823733, mRNA, complete cds | 8.3E−53 |
| 23184 | 2496.K15.GZ43_364338 | NM_024711 | gi\|13376008\|ref\|NM_024711.1 *Homo sapiens* hypothetical protein FLJ22690 (FLJ22690), mRNA | 1.1E−28 |
| 23192 | 2497.E09.GZ43_364572 | AF284421 | gi\|15088516\|gb\|AF284421.1AF284421 *Homo sapiens* complement factor MASP-3 mRNA, complete cds | 4.1E−158 |
| 23195 | 2497.J05.GZ43_364688 | Z56298 | gi\|1027529\|emb\|Z56298.1HS10C4R *H. sapiens* CpG island DNA genomic Mse1 fragment, clone 10c4, reverse read cpg10c4.rt1a | 2.5E−42 |
| 23199 | 2497.L05.GZ43_364736 | AK023448 | gi\|10435386\|dbj\|AK023448.1AK023448 *Homo sapiens* cDNA FLJ13386 fis, clone PLACE1001104, weakly similar to MYOSIN HEAVY CHAIN, NON-MU | 0 |
| 23207 | 2562.B09.GZ43_375496 | M64241 | gi\|190813\|gb\|M64241.1HUMQM Human Wilm's tumor-related protein (QM) mRNA, complete cds | 3.2E−52 |
| 23210 | 2562.I01.GZ43_375656 | AF083247 | gi\|5106788\|gb\|AF083247.1AF083247 *Homo sapiens* MDG1 mRNA, complete cds | 2.4E−48 |
| 23214 | 2562.O01.GZ43_375800 | AF223389 | gi\|11066459\|gb\|AF223389.1AF223389 *Homo sapiens* PCGEM1 gene, non-coding mRNA | 8.7E−57 |
| 23217 | 2562.H11.GZ43_375642 | AK023442 | gi\|10435378\|dbj\|AK023442.1AK023442 *Homo sapiens* cDNA FLJ13380 fis, clone PLACE1001007 | 1.7E−64 |

TABLE 148-continued

| SEQ ID | SEQ NAME | ACCESSION | GENBANK DESCRIPTION | GENBANK SCORE |
|---|---|---|---|---|
| 23218 | 2562.B24.GZ43_375511 | AF287932 | gi\|12656321\|gb\|AF287932.1AF287932 *Rayleya bahiensis* NADH dehydrogenase subunit F (ndhF) gene, partial cds; chloroplast gene for chl | 1.8E−31 |
| 23229 | 2498.A02.GZ43_364853 | AY031766 | gi\|13738569\|gb\|AY031766.1 HIV-1 isolate NC5203-1999 from USA pol polyprotein (pol) gene, partial cds | 1.3E−29 |
| 23230 | 2498.A19.GZ43_364870 | AL122114 | gi\|6102936\|emb\|AL122114.1HSM801274 *Homo sapiens* mRNA; cDNA DKFZp434K0221 (from clone DKFZp434K0221); partial cds | 1E−59 |
| 23235 | 2498.G15.GZ43_365010 | M86752 | gi\|184564\|gb\|M86752.1HUMIEF Human transformation-sensitive protein (IEF SSP 3521) mRNA, complete cds | 3.4E−54 |
| 23238 | 2498.I17.GZ43_365060 | AJ335654 | gi\|15880072\|emb\|AJ335654.1HSA335654 *Homo sapiens* genomic sequence surrounding NotI site, clone NR5-IJ21R | 4.3E−41 |
| 23239 | 2498.K20.GZ43_365111 | X15940 | gi\|36129\|emb\|X15940.1HSRPL31 Human mRNA for ribosomal protein L31 | 1.7E−25 |
| 23240 | 2498.M19.GZ43_365158 | AF203815 | gi\|6979641\|gb\|AF203815.1AF203815 *Homo sapiens* alpha gene sequence | 4E−47 |
| 23242 | 2498.P07.GZ43_365218 | AF410975 | gi\|15553753\|gb\|AF410975.1AF410975 Measles virus genotype D4 strain MVi/Montreal.CAN/12.89 hemagglutinin gene, complete cds | 3.5E−29 |
| 23244 | 2507.C03.GZ43_366992 | NM_025080 | gi\|13376633\|ref\|NM_025080.1 *Homo sapiens* hypothetical protein FLJ22316 (FLJ22316), mRNA | 1E−232 |
| 23259 | 2511.J18.GZ43_369643 | M81806 | gi\|184406\|gb\|M81806.1HUMHSKPQZ7 Human housekeeping (Q1Z 7F5) gene, exons 2 through 7, complete cds | 4.7E−34 |
| 23261 | 2499.A22.GZ43_365257 | AK024860 | gi\|10437268\|dbj\|AK024860.1AK024860 *Homo sapiens* cDNA: FLJ21207 fis, clone COL00362 | 6.4E−49 |
| 23263 | 2499.C09.GZ43_365292 | AJ330464 | gi\|15874882\|emb\|AJ330464.1HSA330464 *Homo sapiens* genomic sequence surrounding NotI site, clone NR1-IL7C | 3.3E−100 |
| 23268 | Clu1009284.1 | AF026853 | gi\|3882436\|gb\|AF026853.1HSADHSC 1 *Homo sapiens* mitochondrial short-chain L-3-hydroxyacyl-CoA dehydrogenase (HADHSC) gene, nuclear | 1.3E−30 |
| 23269 | Clu1022935.2 | AL590711.7 | gi\|16304966\|emb\|AL590711.7AL590711 Human DNA sequence from clone RP11-284O18 on chromosome 9, complete sequence [*Homo sapiens*] | 3.9E−118 |
| 23270 | Clu1037152.1 | M87652 | gi\|182743\|gb\|M87652.1HUMFPRPR Human formylpeptide receptor gene, promoter region | 1.1E−21 |
| 23271 | Clu13903.1 | AK026618 | gi\|10439509\|dbj\|AK026618.1AK026618 *Homo sapiens* cDNA: FLJ22965 fis, clone KAT10418 | 1.5E−293 |
| 23272 | Clu139979.2 | AB056828 | gi\|13365953\|dbj\|AB056828.1AB056828 *Macaca fascicularis* brain cDNA clone: QflA-13447, full insert sequence | 1.4E−33 |
| 23274 | Clu187860.2 | AL050204 | gi\|4884443\|emb\|AL050204.1HSM800501 *Homo sapiens* mRNA; cDNA DKFZp586F1223 (from clone DKFZp586F1223) | 4.7E−33 |
| 23275 | Clu189993.1 | AB030001 | gi\|7416074\|dbj\|AB030001.1AB030001 *Homo sapiens* gene for SGRF, complete cds | 9.6E−87 |
| 23276 | Clu20975.1 | AF039687 | gi\|3170173\|gb\|AF039687.1AF039687 *Homo sapiens* antigen NY-CO-1 (NY-CO-) 1) mRNA, complete cds | 2.7E−190 |
| 23278 | Clu218833.1 | AF223389 | gi\|11066459\|gb\|AF223389.1AF223389 *Homo sapiens* PCGEM1 gene, non-coding mRNA | 1E−139 |
| 23279 | Clu244504.2 | Z59663 | gi\|1031576\|emb\|Z59663.1HS168F9F *H. sapiens* CpG island DNA genomic Mse1 fragment, clone 168f9, forward read cpg168f9.ft1a | 7.5E−22 |
| 23281 | Clu376516.1 | AK018003 | gi\|12857525\|dbj\|AK018003.1AK018003 *Mus musculus* adult male thymus cDNA, RIKEN full-length enriched library, clone: 5830450H20, full | 1.7E−63 |
| 23282 | Clu376630.1 | U93571 | gi\|2072968\|gb\|U93571.1HSU93571 Human L1 element L1.24 p40 gene, complete cds | 8.7E−291 |

TABLE 148-continued

| SEQ ID | SEQ NAME | ACCESSION | GENBANK DESCRIPTION | GENBANK SCORE |
|---|---|---|---|---|
| 23283 | Clu377044.2 | AK024860 | gi\|10437268\|dbj\|AK024860.1AK024860 *Homo sapiens* cDNA: FLJ21207 fis, clone COL00362 | 1.6E−49 |
| 23284 | Clu379689.1 | BC007110 | gi\|13937991\|gb\|BC007110.1BC007110 *Homo sapiens*, clone MGC: 14768 IMAGE: 4291902, mRNA, complete cds | 0 |
| 23286 | Clu387530.4 | AK009770 | gi\|12844769\|dbj\|AK009770.1AK009770 *Mus musculus* adult male tongue cDNA, RIKEN full-length enriched library, clone: 2310043C14, full | 1.5E−80 |
| 23287 | Clu388450.2 | AK023448 | gi\|10435386\|dbj\|AK023448.1AK023448 *Homo sapiens* cDNA FLJ13386 fis, clone PLACE1001104, weakly similar to MYOSIN HEAVY CHAIN, NON-MU | 0 |
| 23288 | Clu396325.1 | Z78727 | gi\|1508005\|emb\|Z78727.1HSPA15B9 *H. sapiens* flow-sorted chromosome 6 HindIII fragment, SC6pA15B9 | 1.2E−38 |
| 23291 | Clu400258.1 | AB038971 | gi\|12862672\|dbj\|AB038971.1AB038965S7 *Homo sapiens* CFLAR gene, exon 10, exon 11 | 4E−74 |
| 23293 | Clu402591.3 | AF170811 | gi\|6715105\|gb\|AF170811.AF170811 *Homo sapiens* CaBP2 (CABP2) gene, complete cds | 7E−26 |
| 23295 | Clu404081.2 | AK011443 | gi\|12847570\|dbj\|AK011443.1AK011443 *Mus musculus* 10 days embryo cDNA, RIKEN full-length enriched library, clone: 2610018B07, full ins | 5E−153 |
| 23297 | Clu41346.1 | AB042029 | gi\|16326128\|dbj\|AB042029.1AB042029 *Homo sapiens* DEPC-1 mRNA for prostate cancer antigen-1, complete cds | 0 |
| 23299 | Clu416124.1 | AK000293 | gi\|7020278\|dbj\|AK000293.1AK000293 *Homo sapiens* cDNA FLJ20286 fis, clone HEP04358 | 3.3E−34 |
| 23300 | Clu417672.1 | AK027667 | gi\|14042514\|dbj\|AK027667.1AK027667 *Homo sapiens* cDNA FLJ14761 fis, clone NT2RP3003302 | 1.6E−183 |
| 23301 | Clu423664.1 | AF287270 | gi\|9844925\|gb\|AF287270.1AF287270 *Homo sapiens* mucolipin (MCOLN1) gene, complete cds | 6.3E−34 |
| 23303 | Clu442923.3 | BC014256 | gi\|15559816\|gb\|BC014256.1BC014256 *Homo sapiens*, Similar to guanine nucleotide binding protein (G protein), beta polypeptide 2-like | 1.5E−236 |
| 23304 | Clu446975.1 | AL022342.6 | gi\|7159715\|emb\|AL022342.6HS29M10 Human DNA sequence from clone RP1-29M10 on chromosome 20, complete sequence [*Homo sapiens*] | 1.8E−74 |
| 23305 | Clu449839.2 | BC001607 | gi\|12804410\|gb\|BC001607.1BC001607 *Homo sapiens*, clone IMAGE: 3543874, mRNA, partial cds | 1.9E−27 |
| 23306 | Clu449889.1 | S45332 | gi\|255496\|gb\|S45332.1S45332 erythropoietin receptor [human, placental, Genomic, 8647 nt] | 8E−101 |
| 23307 | Clu451707.2 | AJ004862 | gi\|4038586\|emb\|AJ004862.1HSAJ4862 *Homo sapiens* partial MUC5B gene, exon 1−29 | 4.7E−49 |
| 23308 | Clu454509.3 | AK022973 | gi\|10434673\|dbj\|AK022973.1AK022973 *Homo sapiens* cDNA FLJ12911 fis, clone NT2RP2004425, highly similar to *Mus musculus* axotrophin mR | 1.7E−285 |
| 23310 | Clu455862.1 | AK023951 | gi\|10436049\|dbj\|AK023951.1AK023951 *Homo sapiens* cDNA FLJ13889 fis, clone THYRO1001595 | 3.3E−27 |
| 23311 | Clu460493.1 | AK012865 | gi\|12849888\|dbj\|AK012865.1AK012865 *Mus musculus* 10, 11 days embryo cDNA, RIKEN full-length enriched library, clone: 2810036K01, full | 1.7E−57 |
| 23314 | Clu470032.1 | AF223389 | gi\|11066459\|gb\|AF223389.1AF223389 *Homo sapiens* PCGEM1 gene, non-coding mRNA | 1.2E−116 |
| 23317 | Clu477271.1 | BC007307 | gi\|13938350\|gb\|BC007307.1BC007307 *Homo sapiens*, Similar to zinc finger protein 268, clone IMAGE: 3352268, mRNA, partial cds | 4.6E−56 |
| 23318 | Clu480410.1 | AK000713 | gi\|7020973\|dbj\|AK000713.1AK000713 *Homo sapiens* cDNA FLJ20706 fis, clone KAIA1273 | 0 |

TABLE 148-continued

| SEQ ID | SEQ NAME | ACCESSION | GENBANK DESCRIPTION | GENBANK SCORE |
|---|---|---|---|---|
| 23320 | Clu497138.1 | AF270579 | gi\|9755121\|gb\|AF270579.1AF270579 *Homo sapiens* clone 18ptel_481c6 sequence | 3.8E−29 |
| 23321 | Clu498886.1 | U49973 | gi\|2226003\|gb\|U49973.1HSU49973 Human Tigger1 transposable element, complete consensus sequence | 1.4E−24 |
| 23323 | Clu5013.2 | BC007458 | gi\|13938610\|gb\|BC007458.1BC007458 *Homo sapiens*, clone MGC: 12217 IMAGE: 3828631, mRNA, complete cds | 0 |
| 23324 | Clu5105.2 | AL512712 | gi\|12224956\|emb\|AL512712.1HSM80291 5 *Homo sapiens* mRNA; cDNA DKFZp761J139 (from clone DKFZp761J139) | 0 |
| 23325 | Clu510539.2 | AK023812 | gi\|10435860\|dbj\|AK023812.1AK023812 *Homo sapiens* cDNA FLJ13750 fis, clone PLACE3000331 | 1.4E−32 |
| 23326 | Clu514044.1 | AJ403947 | gi\|14270388\|emb\|AJ403947.1HSA403947 *Homo sapiens* partial SLC22A3 gene for organic cation transporter 3, exon 2 | 4.4E−295 |
| 23329 | Clu520370.1 | AF093016 | gi\|5579305\|gb\|AF093016.1AF093016 *Homo sapiens* 22k48 gene, 5'UTR | 7.3E−67 |
| 23330 | Clu524917.1 | AL1573620 | gi\|15028613\|emb\|AL157362.10AL157362 Human DNA sequence from clone RP11-142D16 on chromosome 13q14.3–21.31, complete sequence [*Homo* | 4.9E−23 |
| 23331 | Clu528957.1 | AB060919 | gi\|13874604\|dbj\|AB060919.1AB060919 *Macaca fascicularis* brain cDNA clone: QtrA-14728, full insert sequence | 1.5E−31 |
| 23334 | Clu540142.2 | AJ005821 | gi\|3123571\|emb\|AJ005821.1HSA5821 *Homo sapiens* mRNA for X-like 1 protein | 3.5E−36 |
| 23335 | Clu540379.2 | AF088011 | gi\|3523217\|gb\|AF088011.1HUMYY75G10 *Homo sapiens* full length insert cDNA clone YY75G10 | 2.4E−49 |
| 23336 | Clu549507.1 | U14571 | gi\|551540\|gb\|U14571.1HSU14571 ***ALU WARNING: Human Alu-Sc subfamily consensus sequence | 1.6E−48 |
| 23339 | Clu556827.3 | AB038163 | gi\|10280537\|dbj\|AB038163.1AB038163 *Homo sapiens* NDUFV3 gene for mitochondrial NADH-Ubiquinone oxidoreductase, complete cds | 9.7E−22 |
| 23340 | Clu558569.2 | AF061258 | gi\|3108092\|gb\|AF061258.1AF061258 *Homo sapiens* LIM protein mRNA, complete cds | 1E−300 |
| 23343 | Clu570804.1 | AK023843 | gi\|10435902\|dbj\|AK023843.1AK023843 *Homo sapiens* cDNA FLJ13781 fis, clone PLACE4000465 | 4.4E−42 |
| 23344 | Clu572170.2 | U18271 | gi\|885681\|gb\|U18271.1HSTMPO6 Human thymopoietin (TMPO) gene, partial exon 6, complete exon 7, partial exon 8, and partial cds for t | 4.9E−57 |
| 23346 | Clu587168.1 | AJ276804 | gi\|10803412\|emb\|AJ276804.1HSA276804 *Homo sapiens* mRNA for protocadherin (PCDHX gene) | 5.8E−69 |
| 23347 | Clu588996.1 | U73166 | gi\|1613889\|gb\|U73166.1U73166 *Homo sapiens* cosmid clone LUCA15 from 3p21.3, complete sequence | 9.3E−22 |
| 23349 | Clu598388.1 | AF327178 | gi\|11878341\|gb\|AF327178.1AF327178 *Homo sapiens* clone 20ptel_cA35_21t7 sequence | 1.1E−26 |
| 23350 | Clu604822.2 | AB063021 | gi\|14388457\|dbj\|AB063021.1AB063021 *Macaca fascicularis* brain cDNA clone: QmoA-11389, full insert sequence | 2.6E−65 |
| 23353 | Clu627263.1 | AK021759 | gi\|10433005\|dbj\|AK021759.1AK021759 *Homo sapiens* cDNA FLJ11697 fis, clone HEMBA1005035 | 5.7E−30 |
| 23356 | Clu641662.2 | AL1576971 | gi\|11121002\|emb\|AL157697.11AL157697 Human DNA sequence from clone RP5-1092C14 on chromosome 6, complete sequence [*Homo sapiens*] | 7E−84 |
| 23358 | Clu6712.1 | AK024029 | gi\|10436287\|dbj\|AK024029.1AK024029 *Homo sapiens* cDNA FLJ13967 fis, clone Y79AA1001402, weakly similar to *Homo sapiens* paraneoplasti | 0 |
| 23361 | Clu685244.2 | S56773 | gi\|298606\|gb\|S56773.1S56773 putative serine-threonine protein kinase {3' UTR, Alu repeats} [human, Genomic, 1470 nt] | 1.1E−35 |

TABLE 148-continued

| SEQ ID | SEQ NAME | ACCESSION | GENBANK DESCRIPTION | GENBANK SCORE |
|---|---|---|---|---|
| 23362 | Clu691653.1 | D28126 | gi\|559316\|dbj\|D28126.1HUMATPSAS Human gene for ATP synthase alpha subunit, complete cds (exon 1 to 12) | 6.3E−37 |
| 23367 | Clu709796.2 | AB070013 | gi\|15207866\|dbj\|AB070013.1AB070013 *Macaca* fascicularis testis cDNA clone: QtsA-11243, full insert sequence | 8.4E−118 |
| 23369 | Clu727966.1 | AF271388 | gi\|8515842\|gb\|AF271388.1AF271388 *Homo sapiens* CMP-N-acetylneuraminic acid synthase mRNA, complete cds | 0 |
| 23372 | Clu756337.1 | BC004923 | gi\|13436241\|gb\|BC004923.1BC004923 *Homo sapiens*, clone IMAGE: 3605104, mRNA, partial cds | 4.1E−250 |
| 23376 | Clu823296.3 | AK023179 | gi\|10434987\|dbj\|AK023179.1AK023179 *Homo sapiens* cDNA FLJ13117 fis, clone NT2RP3002660 | 6.4E−33 |
| 23377 | Clu830453.2 | AK027301 | gi\|14041890\|dbj\|AK027301.1AK027301 *Homo sapiens* cDNA FLJ14395 fis, clone HEMBA1003250, weakly similar to PROTEIN KINASE APK1A (EC 2 | 0 |
| 23378 | Clu839006.1 | AB023199 | gi\|4589607\|dbj\|AB023199.1AB023199 *Homo sapiens* mRNA for KIAA0982 protein, complete cds | 3.3E−51 |
| 23379 | Clu847088.1 | AL078632.6 | gi\|6002309\|emb\|AL078632.6HSA255N20 Human DNA sequence from clone 255N20 on chromosome 22, complete sequence [*Homo sapiens*] | 4.2E−40 |
| 23380 | Clu853371.2 | S79349 | gi\|1110571\|gb\|S79349.1S79349 *Homo sapiens* type 1 iodothyronine deiodinase (hdiol) gene, partial cds | 1.6E−48 |
| 23381 | Clu88462.1 | AF026855 | gi\|3882438\|gb\|AF026855.1HSADHSC 3 *Homo sapiens* mitochondrial short-chain L-3-hydroxyacyl-CoA dehydrogenase (HADHSC) gene, nuclear | 1.1E−65 |
| 23382 | Clu935908.2 | AK025271 | gi\|10437753\|dbj\|AK025271.1AK025271 *Homo sapiens* cDNA: FLJ21618 fis, clone COL07487 | 8.2E−54 |
| 23386 | DTT00087024.1 | AF036235 | gi\|2695679\|gb\|AF036235.1AF036235 *Gorilla gorilla* L1 retrotransposon L1Gg-1A, complete sequence | 0 |
| 23387 | DTT00089020.1 | AF324172 | gi\|12958747\|gb\|AF324172.1AF324172 *Dictyophora indusiata* strain ASI 32001 internal transcribed spacer 1, partial sequence; 5.8S ribo | 1.1E−142 |
| 23388 | DTT00171014.1 | AB050477 | gi\|11034759\|dbj\|AB050477.1AB050477 *Homo sapiens* NIBAN mRNA, complete cds | 0 |
| 23389 | DTT00514029.1 | BC001978 | gi\|12805042\|gb\|BC001978.1BC001978 *Homo sapiens*, clone IMAGE: 3461487, mRNA, partial cds | 6E−284 |
| 23390 | DTT00740010.1 | AF216292 | gi\|7229461\|gb\|AF216292.1AF216292 *Homo sapiens* endoplasmic reticulum lumenal Ca2+ binding protein grp78 mRNA, complete cds | 9.5E−229 |
| 23391 | DTT00945030.1 | AL117237 | gi\|5834563\|emb\|AL117237.1HS328E191 Novel human gene mapping to chromosome 1 | 0 |
| 23394 | DTT01315010.1 | X16983 | gi\|33945\|emb\|X16983.1HSINTAL4 Human mRNA for integrin alpha-4 subunit | 0 |
| 23395 | DTT01503016.1 | AK025473 | gi\|10437996\|dbj\|AK025473.1AK025473 *Homo sapiens* cDNA: FLJ21820 fis, clone HEP01232 | 0 |
| 23396 | DTT01555018.1 | AE007613 | gi\|15023874\|gb\|AE007613.1AE007613 *Clostridium acetobutylicum* ATCC824 section 101 of 356 of the complete genome | 0 |
| 23397 | DTT01685047.1 | M54985 | gi\|177005\|gb\|M54985.1GIBBGLOETAH. lar psi-eta beta-like globin pseudogene, exon 1, 2, 3 | 6.8E−107 |
| 23398 | DTT01764019.1 | AF307053 | gi\|12018057\|gb\|AF307053.1AF307053 *Thermococcus litoralis* sugar kinase, trehalose/maltose binding protein (malE), trehalose/maltose | 0 |
| 23401 | DTT02367007.1 | AK001580 | gi\|7022920\|dbj\|AK001580.1AK001580 *Homo sapiens* cDNA FLJ10718 fis, clone NT2RP3001096, weakly similar to *Rattus norvegicus* leprecan | 0 |
| 23402 | DTT02671007.1 | AF384048 | gi\|14488027\|gb\|AF384048.1AF384048 *Homo sapiens* interferon kappa precursor gene, complete cds | 1.8E−170 |

TABLE 148-continued

| SEQ ID | SEQ NAME | ACCESSION | GENBANK DESCRIPTION | GENBANK SCORE |
|---|---|---|---|---|
| 23403 | DTT02737017.1 | AF182418 | gi\|10197635\|gb\|AF182418.1AF182418 Homo sapiens MDS017 (MDS017) mRNA, complete cds | 9E−207 |
| 23404 | DTT02850005.1 | AK011295 | gi\|12847322\|dbj\|AK011295.1AK011295 Mus musculus 10 days embryo cDNA, RIKEN full-length enriched library, clone: 2610002L04, full ins | 2.5E−141 |
| 23406 | DTT03037029.1 | AE006916 | gi\|13879055\|gb\|AE006916.1AE006916 Mycobacterium tuberculosis CDC1551, section 2 of 280 of the complete genome | 2.1E−129 |
| 23407 | DTT03150008.1 | M83822 | gi\|1580780\|gb\|M83822.1HUMCDC4REL Human beige-like protein (BGL) mRNA, partial cds | 0 |
| 23408 | DTT03367008.1 | NM_012090.2 | gi\|15011903\|ref\|NM_012090.2 Homo sapiens actin cross-linking factor (ACF7), transcript variant 1, mRNA | 0 |
| 23411 | DTT03913023.1 | AK018110 | gi\|12857675\|dbj\|AK018110.1AK018110 Mus musculus adult male medulla oblongata cDNA, RIKEN full-length enriched library, clone: 633040 | 2E−214 |
| 23412 | DTT03978010.1 | BC015529 | gi\|15930193\|gb\|BC015529.1BC015529 Homo sapiens, Similar to ribose 5-phosphate isomerase A, clone MGC: 9441 IMAGE: 3904718, mRNA, comp | 0 |
| 23413 | DTT04070014.1 | L43411 | gi\|893273\|gb\|L43411.1HUM25DC1Z Homo sapiens (subclone 5_g5 from P1 H25) DNA sequence | 4E−102 |
| 23414 | DTT04084010.1 | AF259790 | gi\|12240019\|gb\|AF259790.1AF259790 Desulfitobacterium sp. PCE-1 o-chlorophenol reductive dehalogenase (cprA) gene, complete cds | 2.2E−288 |
| 23415 | DTT04160007.1 | AF338299 | gi\|12958808\|gb\|AF338299.1AF338299 Amazona ochrocephala auropalliata mitochondrial control region 1, partial sequence | 1.4E−181 |
| 23417 | DTT04378009.1 | AF102129 | gi\|5922722\|gb\|AF102129.1AF102129 Rattus norvegicus KPL2 (Kpl2) mRNA, complete cds | 4.7E−146 |
| 23418 | DTT04403013.1 | AE007580 | gi\|15023517\|gb\|AE007580.1AE007580 Clostridium acetobutylicum ATCC824 section 68 of 356 of the complete genome | 1.5E−199 |
| 23420 | DTT04660017.1 | NM_025079 | gi\|13376631\|ref\|NM_025079.1 Homo sapiens hypothetical protein FLJ23231 (FLJ23231), mRNA | 0 |
| 23421 | DTT04956054.1 | AF050179 | gi\|3319283\|gb\|AF050179.1AF050179 Homo sapiens CENP-C binding protein (DAXX) mRNA, complete cds | 0 |
| 23422 | DTT04970018.1 | AK015635 | gi\|12854041\|dbj\|AK015635.1AK015635 Mus musculus adult male testis cDNA, RIKEN full-length enriched library, clone: 4930486L24, full | 1.4E−84 |
| 23424 | DTT05571010.1 | AB014533 | gi\|3327079\|dbj\|AB014533.1AB014533 Homo sapiens mRNA for KIAA0633 protein, partial cds | 1.8E−53 |
| 23426 | DTT05742029.1 | AF344987 | gi\|13448249\|gb\|AF344987.1AF344987 Hepatitis C virus isolate RDpostSC1c2 polyprotein gene, partial cds | 0 |
| 23427 | DTT06137030.1 | AY049285 | gi\|15146287\|gb\|AY049285.1 Arabidopsis thaliana AT3g58570/F14P22_160 mRNA, complete cds | 2.2E−143 |
| 23428 | DTT06161014.1 | AJ330465 | gi\|15874883\|emb\|AJ330465.1HSA330465 Homo sapiens genomic sequence surrounding NotI site, clone NR1-IM15C | 2.5E−28 |
| 23429 | DTT06706019.1 | AF226787 | gi\|12407487\|gb\|AF226787.1AF226787 Syrrhopodon confertus ribulose-1,5-bisphosphate carboxylase large subunit (rbcL) gene, partial cd | 0 |
| 23430 | DTT06837021.1 | AK000658 | g\|7020892\|dbj\|AK000658.1AK000658 Homo sapiens cDNA FLJ20651 fis, clone KAT01814 | 0 |
| 23431 | DTT07040015.1 | AF047347 | gi\|3005557\|gb\|AF047347.1AF047347 Homo sapiens adaptor protein X11alpha mRNA, complete cds | 0 |
| 23432 | DTT07088009.1 | AF326517 | gi\|15080738\|gb\|AF326517.1AF326517 Abies grandis pinene synthase gene, partial cds | 0 |

TABLE 148-continued

| SEQ ID | SEQ NAME | ACCESSION | GENBANK DESCRIPTION | GENBANK SCORE |
|---|---|---|---|---|
| 23433 | DTT07182014.1 | AB035187 | gi\|9955412\|dbj\|AB035187.1AB035187 *Homo sapiens* RHD gene, intron 1, complete sequence | 3.1E−84 |
| 23434 | DTT07405044.1 | AP002946 | gi\|16267254\|dbj\|AP002946.1AP002946 *Mastacembelus favus* mitochondrial DNA, complete genome | 0 |
| 23435 | DTT07408020.1 | AE008061 | gi\|15156405\|gb\|AE008061.1AE008061 *Agrobacterium tumefaciens* strain C58 circular chromosome, section 119 of 254 of the complete sequ | 6.9E−245 |
| 23438 | DTT08005024.1 | U18270 | gi\|885679\|gb\|U18270.1HSTMPO4 Human thymopoietin (TMPO) gene, exons 4 and 5, and complete cds for thymopoietin alpha | 5.1E−108 |
| 23439 | DTT08098020.1 | AF387946 | gi\|15021617\|gb\|AF387946.1AF387946 *Homo sapiens* clone J102 melanocortin 1 receptor gene, promoter region | 0 |
| 23440 | DTT08167018.1 | NM_020642 | gi\|11034852\|ref\|NM_020642.1 *Homo sapiens* chromosome 11 open reading frame 17 (C11orf17), mRNA | 1E−183 |
| 23441 | DTT08249022.1 | M86752 | gi\|184564\|gb\|M86752.1HUMIEF Human transformation-sensitive protein (IEF SSP 3521) mRNA, complete cds | 0 |
| 23443 | DTT08514022.1 | AK001927 | gi\|7023494\|dbj\|AK001927.1AK001927 *Homo sapiens* cDNA FLJ11065 fis, clone PLACE1004868, weakly similar to MALE STERILITY PROTEIN 2 | 0 |
| 23444 | DTT08527013.1 | AF271388 | gi\|8515842\|gb\|AF271388.1AF271388 *Homo sapiens* CMP-N-acetylneuraminic acid synthase mRNA, complete cds | 0 |
| 23445 | DTT08595020.1 | L07758 | gi\|177764\|gb\|L07758.1HUM56KDAPR Human IEF SSP 9502 mRNA, complete cds | 0 |
| 23446 | DTT08711019.1 | D87930 | gi\|2443337\|dbj\|D87930.1D87930 *Homo sapiens* mRNA for myosin phosphatase target subunit 1 (MYPT1) | 0 |
| 23447 | DTT08773020.1 | X15187 | gi\|37260\|emb\|X15187.1HSTRA1 Human tra1 mRNA for human homologue of murine tumor rejection antigen gp96 | 6.8E−298 |
| 23448 | DTT08874012.1 | AK026442 | gi\|10439307\|dbj\|AK026442.1AK026442 *Homo sapiens* cDNA: FLJ22789 fis, clone KAIA2171 | 0 |
| 23449 | DTT09387018.1 | AF273672 | gi\|15186755\|gb\|AF273672.1AF273672 *Mus musculus* RANBP9 isoform 1 (Ranbp9) mRNA, complete cds | 0 |
| 23450 | DTT09396022.1 | AK000913 | gi\|7021874\|dbj\|AK000913.1AK000913 *Homo sapiens* cDNA FLJ10051 fis, clone HEMBA1001281 | 0 |
| 23452 | DTT09604016.1 | AK022722 | gi\|10434285\|dbj\|AK022722.1AK022722 *Homo sapiens* cDNA FLJ12660 fis, clone NT2RM4002174, moderately similar to MRP PROTEIN | 2.2E−198 |
| 23454 | DTT09742009.1 | AF025409 | gi\|2582414\|gb\|AF025409.1AF025409 *Homo sapiens* zinc transporter 4 (ZNT4) mRNA, complete cds | 0 |
| 23455 | DTT09753017.1 | L03532 | gi\|187280\|gb\|L03532.1HUMM4PRO Human M4 protein mRNA, complete cds | 5.7E−58 |
| 23456 | DTT09793019.1 | AK025125 | gi\|10437578\|dbj\|AK025125.1AK025125 *Homo sapiens* cDNA: FLJ21472 fis, clone COL04936 | 0 |
| 23457 | DTT09796028.1 | AF272390 | gi\|8705239\|gb\|AF272390.1AF272390 *Homo sapiens* myosin 5c (MYO5C) mRNA, complete cds | 0 |
| 23459 | DTT10360040.1 | AJ133798 | gi\|6453351\|emb\|AJ133798.1HSA133798 *Homo sapiens* mRNA for copine VI protein | 0 |
| 23460 | DTT10539016.1 | AF152924 | gi\|5453323\|gb\|AF152924.1AF152924 *Mus musculus* syntaxin4-interacting protein synip mRNA, complete cds | 2.6E−70 |
| 23461 | DTT10564022.1 | AF322634 | gi\|12657820\|gb\|AF322634.1AF322634S1 Human herpesvirus 3 strain VZV-Iceland glycoprotein B gene, complete cds | 0 |
| 23462 | DTT10683041.1 | X69392 | gi\|36114\|emb\|X69392.1HSRP26AA *H. sapiens* mRNA for ribosomal protein L26 | 3E−250 |
| 23463 | DTT10819011.1 | U14568 | gi\|551537\|gb\|U14568.1HSU14568 ***ALU WARNING: Human Alu-Sb subfamily consensus sequence | 2.6E−93 |
| 23465 | DTT11479018.1 | AF309561 | gi\|10954043\|gb\|AF309561.1AF309561 *Homo sapiens* KRAB zinc finger protein ZFQR mRNA, complete cds | 0 |

TABLE 148-continued

| SEQ ID | SEQ NAME | ACCESSION | GENBANK DESCRIPTION | GENBANK SCORE |
|---|---|---|---|---|
| 23466 | DTT11483012.1 | U57053 | gi\|1616674\|gb\|U57053.1HSU57053 Human unconventional myosin-ID (MYO1F) gene, partial cds | 3.1E−245 |
| 23467 | DTT11548015.1 | X05332 | gi\|35740\|emb\|X05332.1HSPSAR Human mRNA for prostate specific antigen | 0 |
| 23468 | DTT11730017.1 | U14572 | gi\|551541\|gb\|U14572.1HSU14572 ***ALU WARNING: Human Alu-Sp subfamily consensus sequence | 4.7E−90 |
| 23471 | DTT11902028.1 | AK001915 | gi\|7023475\|dbj\|AK001915.1AK001915 Homo sapiens cDNA FLJ11053 fis, clone PLACE1004664 | 0 |
| 23472 | DTT11915017.1 | U66062 | gi\|1724068\|gb\|U66062.1HSU66062 Human glp-1 receptor gene, promoter region and partial cds | 5.9E−111 |
| 23475 | DTT12201062.1 | M73791 | gi\|189265\|gb\|M73791.1HUMNOVGENE Human novel gene mRNA, complete cds | 0 |
| 23476 | DTT12470020.1 | AK026618 | gi\|10439509\|dbj\|AK026618.1AK026618 Homo sapiens cDNA: FLJ22965 fis, clone KAT10418 | 0 |

Example 96

Members of Protein Families

SEQ ID NOS: 22001-23477 were used to conduct a profile search as described in the specification above. Several of the polynucleotides of the invention were found to encode polypeptides having characteristics of a polypeptide belonging to a known protein family (and thus represent members of these protein families) and/or comprising a known functional domain. Table 149 (inserted prior to claims) provides: 1) the SEQ ID NO ("SEQ ID") of the query polynucleotide sequence; 2) the sequence name ("SEQ NAME") used as an internal identifier of the query sequence; 3) the accession number ("PFAM ID") of the protein family profile hit; 4) a brief description of the profile hit ("PFAM DESCRIPTION"); 5) the score ("SCORE") of the profile hit; 6) the starting nucleotide of the profile hit ("START"); and 7) the ending nucleotide of the profile hit ("END").

TABLE 149

| SEQ ID | SEQ NAME | PFAM ID | PFAM DESCRIPTION | SCORE | START | END |
|---|---|---|---|---|---|---|
| 22007 | 2504.C11.GZ43_365848 | PF00179 | Ubiquitin-conjugating enzyme | 92.64 | 4 | 159 |
| 22010 | 2504.E23.GZ43_365908 | PF01260 | AP endonuclease family 1 | 88.28 | 222 | 481 |
| 22046 | 2505.G16.GZ43_366333 | PF02594 | Uncharacterized ACR, YggU family COG1872 | 77.64 | 263 | 495 |
| 22109 | 2510.N14.GZ43_369351 | PF02348 | Cytidylyltransferase | 187.84 | 357 | 675 |
| 22126 | 2365.D10.GZ43_345308 | PF01018 | GTP1/OBG family | 96.12 | 50 | 507 |
| 22134 | 2365.F24.GZ43_345370 | PF00160 | Cyclophilin type peptidyl-prolyl cis-trans isomerase | 120.2 | 251 | 522 |
| 22189 | 2366.L21.GZ43_345942 | PF00612 | IQ calmodulin-binding motif | 33.96 | 415 | 477 |
| 22189 | 2366.L21.GZ43_345942 | PF00063 | Myosin head (motor domain) | 207.12 | 8 | 369 |
| 22259 | 2368.O03.GZ43_346717 | PF00160 | Cyclophilin type peptidyl-prolyl cis-trans isomerase | 120.2 | 242 | 513 |
| 22267 | 2535.C23.GZ43_370158 | PF02114 | Phosducin | 32 | 152 | 589 |
| 22334 | 2537.D11.GZ43_370938 | PF00083 | Sugar (and other) transporter | 122.88 | 4 | 288 |
| 22335 | 2537.D20.GZ43_370947 | PF00131 | Metallothionein | 48.56 | 563 | 665 |
| 22349 | 2537.N12.GZ43_371179 | PF001352 | KRAB box | 123.24 | 313 | 498 |
| 22363 | 2538.B03.GZ43_371266 | PF00160 | Cyclophilin type peptidyl-prolyl cis-trans isomerase | 117.68 | 320 | 591 |
| 22391 | 2554.A06.GZ43_375853 | PF03015 | Male sterility protein | 44.96 | 605 | 749 |
| 22394 | 2554.A16.GZ43_375863 | PF02348 | Cytidylyltransferase | 195.48 | 397 | 650 |
| 22405 | 2554.I10.GZ43_376049 | PF03041 | lef-2 | 31.88 | 479 | 536 |
| 22419 | 2565.B15.GZ43_398171 | PF02271 | Ubiquinol-cytochrome C reductase complex 14 kD subunit | 70.76 | 29 | 188 |
| 22422 | 2565.C17.GZ43_398204 | PF00089 | Trypsin | 45.28 | 5 | 110 |
| 22482 | 2540.I17.GZ43_372216 | PF00023 | Ank repeat | 75.44 | 444 | 542 |
| 22507 | 2541.L08.GZ43_372663 | PF00499 | NADH-ubiquinone/plastoquinone oxidoreductase chain 6 | 54.72 | 89 | 237 |
| 22514 | 2506.C15.GZ43_366620 | PF00076 | RNA recognition motif. (a.k.a. RRM, RBD, or RNP domain) | 44.44 | 70 | 276 |
| 22521 | 2506.G24.GZ43_366725 | PF00096 | Zinc finger, C2H2 type | 46.68 | 156 | 224 |
| 22527 | 2506.J20.GZ43_366793 | PF00595 | PDZ Domain (Also known as DHR or GLGF). | 34.16 | 290 | 502 |
| 22543 | 2542.D19.GZ43_372866 | PF00098 | Zinc knuckle | 46.68 | 224 | 276 |

TABLE 149-continued

| SEQ ID | SEQ NAME | PFAM ID | PFAM DESCRIPTION | SCORE | START | END |
|---|---|---|---|---|---|---|
| 22563 | 2542.N21.GZ43_373108 | PF01545 | Cation efflux family | 42.24 | 191 | 325 |
| 22569 | 2555.F16.GZ43_373295 | PF02348 | Cytidylyltransferase | 215.04 | 357 | 713 |
| 22716 | 2560.H21.GZ43_375268 | PF00510 | Cytochrome c oxidase subunit III | 37.28 | 224 | 436 |
| 22721 | 2560.K10.GZ43_375329 | PF01018 | GTP1/OBG family | 104.56 | 50 | 573 |
| 22759 | 2561.O17.GZ43_37658 | PF00826 | Ribosomal L10 | 79.88 | 46 | 180 |
| 22766 | 2456.B12.GZ43_355864 | PF01545 | Cation efflux family | 34.16 | 102 | 236 |
| 22771 | 2456.D04.GZ43_355904 | PF02114 | Phosducin | 30.52 | 139 | 576 |
| 22813 | 2457.J23.GZ43_356451 | PF02594 | Uncharacterized ACR, YggU family COG1872 | 77.64 | 189 | 421 |
| 22818 | 2457.L21.GZ43_356497 | PF00023 | Ank repeat | 38 | 208 | 306 |
| 22910 | 2464.L02.GZ43_357946 | PF00076 | RNA recognition motif. a.k.a. RRM, RBD, or RNP domain) | 34.84 | 244 | 350 |
| 22914 | 2464.N05.GZ43_357997 | PF00023 | Ank repeat | 128.28 | 491 | 589 |
| 22935 | 2465.K20.GZ43_358324 | PF02594 | Uncharacterized ACR, YggU family COG1872 | 77.64 | 210 | 442 |
| 22952 | 2466.I08.GZ43_360281 | PF00012 | Hsp70 protein | 120.92 | 16 | 208 |
| 22967 | 2467.D10.GZ43_360547 | PF00008 | EGF-like domain | 31.04 | 63 | 113 |
| 23002 | 2472.P22.GZ43_361231 | PF00499 | NADH-ubiquinone/plastoquinone oxidoreductase chain 6 | 64.72 | 81 | 209 |
| 23011 | 2473.I08.GZ43_361433 | PF00895 | ATP synthase protein 8 | 66.88 | 5 | 148 |
| 23039 | 2475.N08.GZ43_362321 | PF00804 | Syntaxin | 53.08 | 226 | 601 |
| 23051 | 2480.D13.GZ43_358588 | PF03025 | Papillomavirus E5 | 33.56 | 583 | 749 |
| 23065 | 2481.B06.GZ43_358917 | PF00098 | Zinc knuckle | 35.88 | 79 | 133 |
| 23100 | 2483.J07.GZ43_359878 | PF00142 | 4Fe-4S iron sulfur cluster binding proteins, NifH/frxC family | 32.8 | 211 | 288 |
| 23101 | 2483.K02.GZ43_359897 | PF00160 | Cyclophilin type peptidyl-prolyl cis-trans isomerase | 117.52 | 244 | 516 |
| 23107 | 2488.B07.GZ43_362475 | PF01260 | AP endonuclease family 1 | 79.88 | 251 | 614 |
| 23128 | 2489.F09.GZ43_362957 | PF02348 | Cytidylyltransferase | 174.36 | 347 | 591 |
| 23183 | 2496.I06.GZ43_364281 | PF02790 | Cytochrome C oxidase subunit II, transmembrane domain | 45.8 | 131 | 242 |
| 23207 | 2562.B09.GZ43_375496 | PF00826 | Ribosomal L10 | 106.28 | 49 | 341 |
| 23216 | 2562.E14.GZ43_375573 | PF00023 | Ank repeat | 87.04 | 230 | 328 |
| 23225 | 2562.H18.GZ43_375649 | PF02594 | Uncharacterized ACR, YggU family COG1872 | 65.44 | 206 | 437 |
| 23244 | 2507.C03.GZ43_366992 | PF00083 | Sugar (and other) transporter | 95.52 | 107 | 355 |
| 23267 | 2499.I09.GZ43_365436 | PF00160 | Cyclophilin type peptidyl-prolyl cis-trans isomerase | 43.24 | 139 | 238 |

In addition, SEQ ID NOS:23478-23568 were also used to conduct a profile search as described above. Several of the polypeptides of the invention were found to have characteristics of a polypeptide belonging to a known protein family (and thus represent members of these protein families) and/or comprising a known functional domain. Table 150 (inserted prior to claims) provides: 1) the SEQ ID NO ("SEQ ID") of the query protein sequence; 2) the sequence name ("PROTEIN SEQ NAME") used as an internal identifier of the query sequence; 3) the accession number ("PFAM ID") of the protein family profile hit; 4) a brief description of the profile hit ("PFAM DESCRIPTION"); 5) the score ("SCORE") of the profile hit; 6) the starting residue of the profile hit ("START"); and 7) the ending residue of the profile hit ("END").

Some SEQ ID NOS exhibited multiple profile hits where the query sequence contains overlapping profile regions, and/or where the sequence contains two different functional domains. Each of the profile hits of Tables 8 and 9 is described in more detail below. The acronyms for the profiles (provided in parentheses) are those used to identify the profile in the Pfam, Prosite, and InterPro databases. The Pfam database can be accessed through web sites supported by Genome Sequencing Center at the Washington University School of Medicine or by the European Molecular Biology Laboratories in Heidelberg, Germany. The Prosite database can be accessed at the ExPASy Molecular Biology Server on the internet. The InterPro database can be accessed at a web site supported by the EMBL European Bioinformatics Institute. The public information available on the Pfam, Prosite, and InterPro databases regarding the various profiles, including but not limited to the activities, function, and consensus sequences of various proteins families and protein domains, is incorporated herein by reference.

TABLE 150

| SEQ ID | PROTEIN SEQ NAME | PFAM ID | PFAM DESCRIPTION | SCORE | START | END |
|---|---|---|---|---|---|---|
| 23481 | DTP00514038.1 | PF00587 | tRNA synthetase class II core domain (G, H, P, S and T) | 33.42 | 1 | 116 |
| 23482 | DTP00740019.1 | PF00012 | Hsp70 protein | 948.22 | 27 | 564 |
| 23484 | DTP01169031.1 | PF00023 | Ank repeat | 159.66 | 82 | 114 |

TABLE 150-continued

| SEQ ID | PROTEIN SEQ NAME | PFAM ID | PFAM DESCRIPTION | SCORE | START | END |
|---|---|---|---|---|---|---|
| 23484 | DTP01169031.1 | PF00023 | Ank repeat | 159.66 | 181 | 213 |
| 23484 | DTP01169031.1 | PF00023 | Ank repeat | 159.66 | 148 | 180 |
| 23484 | DTP01169031.1 | PF00023 | Ank repeat | 159.66 | 115 | 147 |
| 23484 | DTP01169031.1 | PF00023 | Ank repeat | 159.66 | 82 | 114 |
| 23484 | DTP01169031.1 | PF00023 | Ank repeat | 159.66 | 49 | 81 |
| 23484 | DTP01169031.1 | PF00023 | Ank repeat | 159.66 | 16 | 48 |
| 23484 | DTP01169031.1 | PF00023 | Ank repeat | 159.66 | 181 | 213 |
| 23484 | DTP01169031.1 | PF00023 | Ank repeat | 159.66 | 115 | 147 |
| 23484 | DTP01169031.1 | PF00023 | Ank repeat | 159.66 | 49 | 81 |
| 23484 | DTP01169031.1 | PF00023 | Ank repeat | 159.66 | 16 | 48 |
| 23484 | DTP01169031.1 | PF00023 | Ank repeat | 159.66 | 148 | 180 |
| 23486 | DTP01315019.1 | PF01839 | FG-GAP repeat | 255.09 | 427 | 479 |
| 23486 | DTP01315019.1 | PF01839 | FG-GAP repeat | 255.09 | 49 | 111 |
| 23486 | DTP01315019.1 | PF01839 | FG-GAP repeat | 255.09 | 248 | 300 |
| 23486 | DTP01315019.1 | PF01839 | FG-GAP repeat | 255.09 | 303 | 362 |
| 23486 | DTP01315019.1 | PF01839 | FG-GAP repeat | 255.09 | 365 | 424 |
| 23495 | DTP02737026.1 | PF01423 | Sm protein | 31.6 | 19 | 66 |
| 23496 | DTP02850014.1 | PF00804 | Syntaxin | 156.59 | 1 | 292 |
| 23496 | DTP02850014.1 | PF00804 | Syntaxin | 156.59 | 1 | 292 |
| 23496 | DTP02850014.1 | PF00804 | Syntaxin | 156.59 | 1 | 292 |
| 23510 | DTP04403022.1 | PF00400 | WD domain, G-beta repeat | 35.93 | 80 | 116 |
| 23510 | DTP04403022.1 | PF00400 | WD domain, G-beta repeat | 35.93 | 38 | 74 |
| 23510 | DTP04403022.1 | PF00400 | WD domain, G-beta repeat | 35.93 | 1 | 33 |
| 23512 | DTP04660026.1 | PF00083 | Sugar (and other) transporter | 234.43 | 1 | 484 |
| 23512 | DTP04660026.1 | PF00083 | Sugar (and other) transporter | 234.43 | 1 | 484 |
| 23518 | DTP05742038.1 | PF01018 | GTP1/OBG family | 133.76 | 105 | 208 |
| 23518 | DTP05742038.1 | PF01018 | GTP1/OBG family | 133.76 | 7 | 97 |
| 23518 | DTP05742038.1 | PF01018 | GTP1/OBG family | 133.76 | 105 | 208 |
| 23518 | DTP05742038.1 | PF01018 | GTP1/OBG family | 133.76 | 7 | 97 |
| 23518 | DTP05742038.1 | PF01018 | GTP1/OBG family | 133.76 | 105 | 208 |
| 23518 | DTP05742038.1 | PF01018 | GTP1/OBG family | 133.76 | 7 | 97 |
| 23519 | DTP06137039.1 | PF02271 | Ubiquinol-cytochrome C reductase complex 14 kD subunit | 141.38 | 4 | 154 |
| 23521 | DTP06706028.1 | PF00054 | Laminin G domain | 63.34 | 56 | 178 |
| 23521 | DTP06706028.1 | PF00054 | Laminin G domain | 63.34 | 281 | 292 |
| 23523 | DTP07040024.1 | PF00640 | Phosphotyrosine interaction domain (PTB/PID). | 233.89 | 461 | 618 |
| 23523 | DTP07040024.1 | PF00595 | PDZ domain (Also known as DHR or GLGF). | 85.47 | 656 | 742 |
| 23532 | DTP08249031.1 | PF00515 | TPR Domain | 115 | 4 | 37 |
| 23532 | DTP08249031.1 | PF00515 | TPR Domain | 115 | 72 | 105 |
| 23532 | DTP08249031.1 | PF00515 | TPR Domain | 115 | 38 | 71 |
| 23532 | DTP08249031.1 | PF00515 | TPR Domain | 115 | 259 | 292 |
| 23532 | DTP08249031.1 | PF00515 | TPR Domain | 115 | 300 | 333 |
| 23532 | DTP08249031.1 | PF00515 | TPR Domain | 115 | 225 | 258 |
| 23535 | DTP08527022.1 | PF02348 | Cytidylyltransferase | 48.59 | 1 | 166 |
| 23535 | DTP08527022.1 | PF02348 | Cytidylyltransferase | 48.59 | 1 | 166 |
| 23535 | DTP08527022.1 | PF02348 | Cytidylyltransferase | 48.59 | 1 | 166 |
| 23535 | DTP08527022.1 | PF02348 | Cytidylyltransferase | 48.59 | 1 | 166 |
| 23536 | DTP08595029.1 | PF00400 | WD domain, G-beta repeat | 80.04 | 183 | 221 |
| 23536 | DTP08595029.1 | PF00400 | WD domain, G-beta repeat | 80.04 | 236 | 273 |
| 23536 | DTP08595029.1 | PF00400 | WD domain, G-beta repeat | 80.04 | 365 | 402 |
| 23536 | DTP08595029.1 | PF00400 | WD domain, G-beta repeat | 80.04 | 279 | 316 |
| 23536 | DTP08595029.1 | PF00400 | WD domain, G-beta repeat | 80.04 | 325 | 357 |
| 23537 | DTP08711028.1 | PF00023 | Ank repeat | 81.96 | 22 | 54 |
| 23537 | DTP08711028.1 | PF00023 | Ank repeat | 81.96 | 55 | 87 |
| 23538 | DTP08773029.1 | PF00183 | Hsp90 protein | 100.71 | 104 | 173 |
| 23540 | DTP09387027.1 | PF00069 | Protein kinase domain | 224.56 | 76 | 342 |
| 23545 | DTP09742018.1 | PF01545 | Cation efflux family | 368.71 | 114 | 418 |
| 23545 | DTP09742018.1 | PF01545 | Cation efflux family | 368.71 | 114 | 418 |
| 23548 | DTP09796037.1 | PF00612 | IQ calmodulin-binding motif | 87.63 | 879 | 899 |
| 23548 | DTP09796037.1 | PF00612 | IQ calmodulin-binding motif | 87.63 | 856 | 876 |
| 23548 | DTP09796037.1 | PF00612 | IQ calmodulin-binding motif | 87.63 | 831 | 851 |
| 23548 | DTP09796037.1 | PF00612 | IQ calmodulin-binding motif | 87.63 | 808 | 828 |
| 23548 | DTP09796037.1 | PF00612 | IQ calmodulin-binding motif | 87.63 | 780 | 800 |
| 23548 | DTP09796037.1 | PF00612 | IQ calmodulin-binding motif | 87.63 | 757 | 777 |
| 23548 | DTP09796037.1 | PF01843 | DIL domain | 125.23 | 1574 | 1679 |
| 23548 | DTP09796037.1 | PF00063 | Myosin head (motor domain) | 1228.24 | 69 | 741 |
| 23550 | DTP10360049.1 | PF00168 | C2 domain | 50.07 | 26 | 114 |
| 23550 | DTP10360049.1 | PF00168 | C2 domain | 50.07 | 228 | 315 |
| 23551 | DTP10539025.1 | PF00595 | PDZ domain (Also known as DHR or GLGF). | 32.34 | 5 | 84 |
| 23553 | DTP10683050.1 | PF00467 | KOW motif | 89.22 | 49 | 107 |
| 23556 | DTP11479027.1 | PF00096 | Zinc finger, C2H2 type | 209.31 | 402 | 424 |
| 23556 | DTP11479027.1 | PF01352 | KRAB box | 134.58 | 8 | 70 |
| 23556 | DTP11479027.1 | PF00096 | Zinc finger, C2H2 type | 209.31 | 374 | 396 |

TABLE 150-continued

| SEQ ID | PROTEIN SEQ NAME | PFAM ID | PFAM DESCRIPTION | SCORE | START | END |
|---|---|---|---|---|---|---|
| 23556 | DTP11479027.1 | PF00096 | Zinc finger, C2H2 type | 209.31 | 346 | 368 |
| 23556 | DTP11479027.1 | PF00096 | Zinc finger, C2H2 type | 209.31 | 318 | 340 |
| 23556 | DTP11479027.1 | PF00096 | Zinc finger, C2H2 type | 209.31 | 290 | 312 |
| 23556 | DTP11479027.1 | PF00096 | Zinc finger, C2H2 type | 209.31 | 262 | 284 |
| 23556 | DTP11479027.1 | PF00096 | Zinc finger, C2H2 type | 209.31 | 234 | 256 |
| 23556 | DTP11479027.1 | PF00096 | Zinc finger, C2H2 type | 209.31 | 206 | 228 |
| 23557 | DTP11483021.1 | PF00063 | Myosin head (motor domain) | 339.24 | 117 | 271 |
| 23557 | DTP11483021.1 | PF00063 | Myosin head (motor domain) | 339.24 | 34 | 115 |
| 23558 | DTP11548024.1 | PF00089 | Trypsin | 272.53 | 25 | 253 |
| 23564 | DTP11966049.1 | PF00023 | Ank repeat | 165.68 | 49 | 81 |
| 23564 | DTP11966049.1 | PF00023 | Ank repeat | 165.68 | 148 | 180 |
| 23564 | DTP11966049.1 | PF00023 | Ank repeat | 165.68 | 181 | 214 |
| 23564 | DTP11966049.1 | PF00023 | Ank repeat | 165.68 | 148 | 180 |
| 23564 | DTP11966049.1 | PF00023 | Ank repeat | 165.68 | 115 | 147 |
| 23564 | DTP11966049.1 | PF00023 | Ank repeat | 165.68 | 82 | 114 |
| 23564 | DTP11966049.1 | PF00023 | Ank repeat | 165.68 | 49 | 81 |
| 23564 | DTP11966049.1 | PF00023 | Ank repeat | 165.68 | 181 | 214 |
| 23564 | DTP11966049.1 | PF00023 | Ank repeat | 165.68 | 181 | 214 |
| 23564 | DTP11966049.1 | PF00023 | Ank repeat | 165.68 | 16 | 48 |
| 23564 | DTP11966049.1 | PF00023 | Ank repeat | 165.68 | 115 | 147 |
| 23564 | DTP11966049.1 | PF00023 | Ank repeat | 165.68 | 82 | 114 |
| 23564 | DTP11966049.1 | PF00023 | Ank repeat | 165.68 | 16 | 48 |
| 23564 | DTP11966049.1 | PF00023 | Ank repeat | 165.68 | 148 | 180 |
| 23564 | DTP11966049.1 | PF00023 | Ank repeat | 165.68 | 115 | 147 |
| 23564 | DTP11966049.1 | PF00023 | Ank repeat | 165.68 | 82 | 114 |
| 23564 | DTP11966049.1 | PF00023 | Ank repeat | 165.68 | 49 | 81 |
| 23564 | DTP11966049.1 | PF00023 | Ank repeat | 165.68 | 16 | 48 |
| 23566 | DTP12201071.1 | PF00826 | Ribosomal L10 | 467.36 | 1 | 176 |
| 23566 | DTP12201071.1 | PF00826 | Ribosomal L10 | 467.36 | 1 | 176 |

Example 97

Detection of Differential Expression Using Arrays and Source of Patient Tissue Samples mRNA isolated from samples of cancerous and normal breast, colon, and prostate tissue obtained from patients were analyzed to identify genes differentially expressed in cancerous and normal cells. Normal and cancerous tissues were collected from patients using laser capture microdissection (LCM) techniques, which techniques are well known in the art (see, e.g., Ohyama et al. (2000) Biotechniques 29:530-6; Curran et al. (2000) Mol. Pathol. 53:64-8; Suarez-Quian et al. (1999) Biotechniques 26:328-35; Simone et al. (1998) Trends Genet 14:272-6; Conia et al. (1997) J. Clin. Lab. Anal. 11:28-38; Emmert-Buck et al. (1996) Science 274:998-1001).

Table 151 (inserted prior to claims) provides information about each patient from which colon tissue samples were isolated, including: the Patient ID ("PT ID") and Path ReportID ("Path ID"), which are numbers assigned to the patient and the pathology reports for identification purposes; the group ("Grp") to which the patients have been assigned; the anatomical location of the tumor ("Anatom Loc"); the primary tumor size ("Size"); the primary tumor grade ("Grade"); the identification of the histopathological grade ("Histo Grade"); a description of local sites to which the tumor had invaded ("Local Invasion"); the presence of lymph node metastases ("Lymph Met"); the incidence of lymph node metastases (provided as a number of lymph nodes positive for metastasis over the number of lymph nodes examined) ("Lymph Met Incid"); the regional lymphnode grade ("Reg Lymph Grade"); the identification or detection of metastases to sites distant to the tumor and their location ("Dist Met & Loc"); the grade of distant metastasis ("Dist Met Grade"); and general comments about the patient or the tumor ("Comments"). Histophatology of all primary tumors indicated the tumor was adenocarcinmoa except for Patient ID Nos. 130 (for which no information was provided), 392 (in which greater than 50% of the cells were mucinous carcinoma), and 784 (adenosquamous carcinoma). Extranodal extensions were described in three patients, Patient ID Nos. 784, 789, and 791. Lymphovascular invasion was described in Patient ID Nos. 128, 278, 517, 534, 784, 786, 789, 791, 890, and 892. Crohn's-like infiltrates were described in seven patients, Patient ID Nos. 52, 264, 268, 392, 393, 784, and 791.

Table 152 below provides information about each patient from which the prostate tissue samples were isolated, including: 1) the "Patient ID", which is a number assigned to the patient for identification purposes; 2) the "Tissue Type"; and 3) the "Gleason Grade" of the tumor. Histopathology of all primary tumors indicated the tumor was adenocarcinoma.

TABLE 152

Prostate patient data.

| Patient ID | Tissue Type | Gleason Grade |
|---|---|---|
| 93 | Prostate Cancer | 3 + 4 |
| 94 | Prostate Cancer | 3 + 3 |
| 95 | Prostate Cancer | 3 + 3 |
| 96 | Prostate Cancer | 3 + 3 |
| 97 | Prostate Cancer | 3 + 2 |
| 100 | Prostate Cancer | 3 + 3 |
| 101 | Prostate Cancer | 3 + 3 |
| 104 | Prostate Cancer | 3 + 3 |
| 105 | Prostate Cancer | 3 + 4 |
| 106 | Prostate Cancer | 3 + 3 |
| 138 | Prostate Cancer | 3 + 3 |
| 151 | Prostate Cancer | 3 + 3 |
| 153 | Prostate Cancer | 3 + 3 |
| 155 | Prostate Cancer | 4 + 3 |
| 171 | Prostate Cancer | 3 + 4 |
| 173 | Prostate Cancer | 3 + 4 |
| 231 | Prostate Cancer | 3 + 4 |
| 232 | Prostate Cancer | 3 + 3 |
| 251 | Prostate Cancer | 3 + 4 |

TABLE 152-continued

Prostate patient data.

| Patient ID | Tissue Type | Gleason Grade |
|---|---|---|
| 282 | Prostate Cancer | 4 + 3 |
| 286 | Prostate Cancer | 3 + 3 |
| 294 | Prostate Cancer | 3 + 4 |
| 351 | Prostate Cancer | 5 + 4 |
| 361 | Prostate Cancer | 3 + 3 |
| 362 | Prostate Cancer | 3 + 3 |
| 365 | Prostate Cancer | 3 + 2 |
| 368 | Prostate Cancer | 3 + 3 |
| 379 | Prostate Cancer | 3 + 4 |
| 388 | Prostate Cancer | 5 + 3 |
| 391 | Prostate Cancer | 3 + 3 |
| 420 | Prostate Cancer | 3 + 3 |
| 425 | Prostate Cancer | 3 + 3 |
| 428 | Prostate Cancer | 4 + 3 |
| 431 | Prostate Cancer | 3 + 4 |
| 492 | Prostate Cancer | 3 + 3 |
| 493 | Prostate Cancer | 3 + 4 |
| 496 | Prostate Cancer | 3 + 3 |
| 510 | Prostate Cancer | 3 + 3 |
| 511 | Prostate Cancer | 4 + 3 |
| 514 | Prostate Cancer | 3 + 3 |
| 549 | Prostate Cancer | 3 + 3 |
| 552 | Prostate Cancer | 3 + 3 |
| 858 | Prostate Cancer | 3 + 4 |
| 859 | Prostate Cancer | 3 + 4 |
| 864 | Prostate Cancer | 3 + 4 |
| 883 | Prostate Cancer | 4 + 4 |
| 895 | Prostate Cancer | 3 + 3 |
| 901 | Prostate Cancer | 3 + 3 |
| 909 | Prostate Cancer | 3 + 3 |
| 921 | Prostate Cancer | 3 + 3 |
| 923 | Prostate Cancer | 4 + 3 |
| 934 | Prostate Cancer | 3 + 3 |
| 1134 | Prostate Cancer | 3 + 4 |
| 1135 | Prostate Cancer | 3 + 3 |
| 1136 | Prostate Cancer | 3 + 4 |
| 1137 | Prostate Cancer | 3 + 3 |
| 1138 | Prostate Cancer | 4 + 3 |

Table 153 provides information about each patient from which the breast tissue samples were isolated, including: 1) the "Pat Num", a number assigned to the patient for identification purposes; 2) the "Histology", which indicates whether the tumor was characterized as an intraductal carcinoma (IDC) or ductal carcinoma in situ (DCIS); 3) the incidence of lymph node metastases (LMF), represented as the number of lymph nodes positive to metastases out of the total number examined in the patient; 4) the "Tumor Size"; 5) "TNM Stage", which provides the tumor grade (T#), where the number indicates the grade and "p" indicates that the tumor grade is a pathological classification; regional lymph node metastasis (N#), where "0" indicates no lymph node metastases were found, "1" indicates lymph node metastases were found, and "X" means information not available and; the identification or detection of metastases to sites distant to the tumor and their location (M#), with "X" indicating that no distant mesatses were reported; and the stage of the tumor ("Stage Grouping"). "nr" indicates "no reported".

TABLE 153

Breast cancer patient data

| Pat Num | Histology | LMF | Tumor Size | TNM Stage | Stage Grouping |
|---|---|---|---|---|---|
| 280 | IDC, DCIS + D2 | nr | 2 cm | T2NXMX | probable Stage II |
| 284 | IDC, DCIS | 0/16 | 2 cm | T2pN0MX | Stage II |

TABLE 153-continued

Breast cancer patient data

| Pat Num | Histology | LMF | Tumor Size | TNM Stage | Stage Grouping |
|---|---|---|---|---|---|
| 285 | IDC, DCIS | nr | 4.5 cm | T2NXMX | probable Stage II |
| 291 | IDC, DCIS | 0/24 | 4.5 cm | T2pN0MX | Stage II |
| 302 | IDC, DCIS | nr | 2.2 cm | T2NXMX | probable Stage II |
| 375 | IDC, DCIS | nr | 1.5 cm | T1NXMX | probable Stage I |
| 408 | IDC | 0/23 | 3.0 cm | T2pN0MX | Stage II |
| 416 | IDC | 0/6 | 3.3 cm | T2pN0MX | Stage II |
| 421 | IDC, DCIS | nr | 3.5 cm | T2NXMX | probable Stage II |
| 459 | IDC | 2/5 | 4.9 cm | T2pN1MX | Stage II |
| 465 | IDC | 0/10 | 6.5 cm | T3pN0MX | Stage II |
| 470 | IDC, DCIS | 0/6 | 2.5 cm | T2pN0MX | Stage II |
| 472 | IDC, DCIS | 6/45 | 5.0+ cm | T3pN1MX | Stage III |
| 474 | IDC | 0/18 | 6.0 cm | T3pN0MX | Stage II |
| 476 | IDC | 0/16 | 3.4 cm | T2pN0MX | Stage II |
| 605 | IDC, DCIS | 1/25 | 5.0 cm | T2pN1MX | Stage II |
| 649 | IDC, DCIS | 1/29 | 4.5 cm | T2pN1MX | Stage II |

Identification of Differentially Expressed Genes cDNA probes were prepared from total RNA isolated from the patient cells described above. Since LCM provides for the isolation of specific cell types to provide a substantially homogeneous cell sample, this provided for a similarly pure RNA sample.

Total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) Nature Med 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling.

Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from normal cell RNA sample. For example, the cDNA probes from the normal cells were labeled with Cy3 fluorescent dye (green) and the cDNA probes prepared from the tumor cells were labeled with Cy5 fluorescent dye (red), and vice versa.

Each array used had an identical spatial layout and control spot set. Each microarray was divided into two areas, each area having an array with, on each half, twelve groupings of 32×12 spots, for a total of about 9,216 spots on each array. The two areas are spotted identically which provide for at least two duplicates of each clone per array.

Polynucleotides for use on the arrays were obtained from both publicly available sources and from cDNA libraries generated from selected cell lines and patient tissues. PCR products of from about 0.5 kb to 2.0 kb amplified from these sources were spotted onto the array using a Molecular Dynamics Gen III spotter according to the manufacturer's recommendations. The first row of each of the 24 regions on the array had about 32 control spots, including 4 negative control spots and 8 test polynucleotides. The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about four duplicate measurements for each clone, two of one color and two of the other, for each sample.

The differential expression assay was performed by mixing equal amounts of probes from tumor cells and normal cells of the same patient. The arrays were prehybridized by incubation for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal. Data from the microarray experiments was analyzed according to the algorithms described in U.S. application Ser. No. 60/252,358, filed Nov. 20, 2000, by E. J. Moler, M. A. Boyle, and F. M. Randazzo, and entitled "Precision and accuracy in cDNA microarray data," which application is specifically incorporated herein by reference.

The experiment was repeated, this time labeling the two probes with the opposite color in order to perform the assay in both "color directions." Each experiment was sometimes repeated with two more slides (one in each color direction). The level fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. During initial analysis of the microarrays, the hypothesis was accepted if $p>10^{-3}$, and the differential ratio was set to 1.000 for those spots. All other spots have a significant difference in expression between the tumor and normal sample. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level ($p>0.05$).

Table 154 (inserted prior to claims) provides the results for gene products expressed by at least 2-fold or greater in cancerous prostate, colon, or breast tissue samples relative to normal tissue samples in at least 20% of the patients tested. Table 154 includes: 1) the SEQ ID NO ("SEQ ID") assigned to each sequence for use in the present specification; 2) the Cluster Identification No. ("CLUSTER"); 3) the percentage of patients tested in which expression levels (e.g., as message level) of the gene was at least 2-fold greater in cancerous breast tissue than in matched normal tissue ("BREAST PATIENTS>=2×"); 4) the percentage of patients tested in which expression levels (e.g., as message level) of the gene was less than or equal to ½ of the expression level in matched normal breast cells ("BREAST PATIENTS<=halfx"); 5) the percentage of patients tested in which expression levels (e.g., as message level) of the gene was at least 2-fold greater in cancerous colon tissue than in matched normal tissue ("COLON PATIENTS>=2×"); 6) the percentage of patients tested in which expression levels (e.g., as message level) of the gene was less than or equal to ½ of the expression level in matched normal colon cells ("COLON PATIENTS<=halfx"); 7) the percentage of patients tested in which expression levels (e.g., as message level) of the gene was at least 2-fold greater in cancerous prostate tissue than in matched normal tissue ("PROSTATE PATIENTS>=2×"); and 8) the percentage of patients tested in which expression levels (e.g., as message level) of the gene was less than or equal to ½ of the expression level in matched normal prostate cells ("PROSTATE PATIENTS<=halfx").

These data provide evidence that the genes represented by the polynucleotides having the indicated sequences are differentially expressed in breast cancer as compared to normal non-cancerous breast tissue, are differentially expressed in colon cancer as compared to normal non-cancerous colon tissue, and are differentially expressed in prostate cancer as compared to normal non-cancerous prostate tissue.

TABLE 154

| SEQ ID | CLONE ID | BREAST PATIENTS >= 2x | BREAST PATIENTS <= halfx | COLON PATIENTS >= 2x | COLON PATIENTS <= halfx | PROSTATE PATIENTS >= 2x | PROSTATE PATIENTS <= halfx |
|---|---|---|---|---|---|---|---|
| 22004 | M00072944A:C07 | | | | 35 | | |
| 22008 | M00072947B:G04 | | | | 32.5 | | |
| 22009 | M00072947D:G05 | | | | 27.5 | | |
| 22015 | M00072963B:G11 | | | | 40 | | |
| 22016 | M00072967A:G07 | | | | 25 | | |
| 22018 | M00072968A:F08 | | | | 22.5 | | |
| 22020 | M00072968D:E05 | | | | 32.5 | | |
| 22021 | M00072970C:B07 | | | | 25 | | |
| 22024 | M00072971C:B07 | | | | 22.5 | | |
| 22028 | M00072975A:D11 | 23.5 | | | | | |
| 22034 | M00073001A:F07 | | | | 27.5 | | |
| 22038 | M00073003A:E06 | | | | 42.5 | | |
| 22039 | M00073003B:E10 | | | | 27.5 | | |

TABLE 154-continued

| SEQ ID | CLONE ID | BREAST PATIENTS >= 2x | BREAST PATIENTS <= halfx | COLON PATIENTS >= 2x | COLON PATIENTS <= halfx | PROSTATE PATIENTS >= 2x | PROSTATE PATIENTS <= halfx |
|---|---|---|---|---|---|---|---|
| 22042 | M00073006A:H08 | 23.5 | | | | | |
| 22043 | M00073006C:D07 | | | | 27.5 | | |
| 22045 | M00073009B:C08 | | | | 32.5 | | 52.4 |
| 22048 | M00073013A:D10 | | | | 32.5 | | |
| 22049 | M00073013A:F10 | | | | 20 | | |
| 22050 | M00073013C:B10 | | | | 32.5 | | |
| 22052 | M00073014D:F01 | | | | 40 | | |
| 22054 | M00073015A:H06 | | | | 47.5 | | |
| 22061 | M00073020C:F07 | | | | 32.5 | | |
| 22062 | M00073020D:C06 | | | 37.5 | | | |
| 22063 | M00073021C:E04 | | | | 30 | | |
| 22071 | M00073030B:C02 | | | | 22.5 | | |
| 22072 | M00073030C:A02 | | | | 20 | | |
| 22073 | M00073036C:H10 | | | | 25 | | |
| 22086 | M00073043D:H09 | | | | 32.5 | | |
| 22090 | M00073044C:G12 | | | | 32.5 | | |
| 22094 | M00073045C:E06 | | | | 22.5 | | |
| 22096 | M00073045D:B04 | | | | 30 | | |
| 22105 | M00073048C:B01 | | | | 20 | | |
| 22107 | M00073049A:H04 | | | | 27.5 | | 49.2 |
| 22108 | M00073049B:B03 | | 23.5 | | 40 | | 31.7 |
| 22109 | M00073049B:B06 | | | | 20 | | |
| 22110 | M00073049C:C09 | | | | 20 | | |
| 22136 | M00073066C:D02 | | | | 27.5 | | |
| 22142 | M00073070B:B06 | | | | 32.5 | | |
| 22146 | M00073074D:A04 | | | | 20 | | |
| 22153 | M00073086D:B05 | | | | 30 | | |
| 22156 | M00073091B:C04 | | | | 20 | | |
| 22163 | M00073424D:C03 | 52.9 | | | | | |
| 22171 | M00073403C:C10 | | | | 30 | | |
| 22173 | M00073403C:E11 | 29.4 | | | 52.5 | | |
| 22176 | M00073412C:E07 | | | | 30 | | |
| 22177 | M00073435C:E06 | | | | 27.5 | | |
| 22178 | M00073412D:B07 | | 35.3 | 42.5 | | | |
| 22189 | M00073430C:B02 | | | | 32.5 | | |
| 22196 | M00073442A:F07 | | | | 25 | | |
| 22197 | M00073442B:D12 | | | | 27.5 | | 20.6 |
| 22199 | M00073446C:A03 | | | | 22.5 | | |
| 22201 | M00073447D:F01 | | | | 45 | | 38.1 |
| 22204 | M00073453C:C09 | 41.2 | | | | | |
| 22212 | M00073469B:A09 | | | | 27.5 | | 36.5 |
| 22216 | M00073474C:F08 | | | | 30 | | 22.2 |
| 22220 | M00073484B:A05 | | 23.5 | | 30 | | 22.2 |
| 22228 | M00073497C:D03 | | 29.4 | 30 | | | |
| 22233 | M00073513A:G07 | 23.5 | | | | 25.4 | |
| 22236 | M00073517A:A06 | | | | 32.5 | | |
| 22241 | M00073529A:F03 | | | | 20 | | |
| 22242 | M00073530B:A02 | | | | 20 | | 54.0 |
| 22243 | M00073531B:H02 | | | | | | 50.8 |
| 22246 | M00073539C:H05 | | | | 27.5 | | |
| 22247 | M00073541B:C10 | | | | 30 | | |
| 22248 | M00073547B:F04 | | | | 22.5 | | |
| 22249 | M00073547C:D02 | | | | 35 | | |
| 22256 | M00073554B:D11 | | | | 37.5 | | |
| 22264 | M00073568A:G06 | | | | 32.5 | | |
| 22265 | M00073568C:G07 | | | | 25 | | |
| 22269 | M00073576B:E03 | | | | 22.5 | | |
| 22270 | M00073576C:C11 | | | | 20 | | |
| 22273 | M00073580A:D08 | | | | 32.5 | | |
| 22280 | M00073598D:E11 | | | | 40 | | |
| 22284 | M00073601D:D08 | | | | 32.5 | | |
| 22286 | M00073603B:C03 | | | 30 | | | |
| 22288 | M00073603C:C02 | | 76.5 | | 67.5 | | |
| 22290 | M00073604B:B07 | | | | 30 | | |
| 22294 | M00073605B:F11 | | 58.8 | | | | |
| 22299 | M00073614C:F06 | | | 60 | | | |
| 22300 | M00073615D:E03 | | | | 82.5 | | |
| 22301 | M00073616A:F06 | | | | 32.5 | | 28.6 |
| 22304 | M00073621D:A04 | | | | 27.5 | | |
| 22316 | M00073633D:A04 | | 23.5 | 52.5 | | | |
| 22318 | M00073634C:H08 | 23.5 | | | 85 | 39.7 | |
| 22319 | M00073635D:C10 | | 35.3 | | | | |
| 22323 | M00073638A:A12 | | | 47.5 | | | |
| 22325 | M00073639A:G08 | | | | 27.5 | | |
| 22340 | M00073651C:F06 | 29.4 | | | 27.5 | | 36.5 |
| 22342 | M00073652D:B11 | | 64.7 | | 70 | | |

TABLE 154-continued

| SEQ ID | CLONE ID | BREAST PATIENTS >= 2x | BREAST PATIENTS <= halfx | COLON PATIENTS >= 2x | COLON PATIENTS <= halfx | PROSTATE PATIENTS >= 2x | PROSTATE PATIENTS <= halfx |
|---|---|---|---|---|---|---|---|
| 22343 | M00073655B:A04 | | | 37.5 | | | |
| 22353 | M00073669A:F04 | | | | 20 | | |
| 22354 | M00073669B:E12 | 23.5 | | 27.5 | | | |
| 22357 | M00073687A:D11 | | | 50 | | 22.2 | |
| 22361 | M00073672D:E09 | | | | 35 | | 42.9 |
| 22367 | M00073677B:F01 | | | | 32.5 | | |
| 22369 | M00073678B:H02 | | | 35 | | | |
| 22372 | M00073681A:F12 | | 29.4 | | | | 25.4 |
| 22377 | M00073689C:C09 | | | | | | 41.3 |
| 22382 | M00073696C:D11 | | 35.3 | | | | |
| 22384 | M00073697C:F11 | | 29.4 | | | | 34.9 |
| 22388 | M00073700B:D12 | | | | 30 | | |
| 22390 | M00073708D:E10 | | | | | | 23.8 |
| 22392 | M00073709B:F01 | | | | 25 | | |
| 22394 | M00073709C:A02 | | | | 22.5 | | |
| 22398 | M00073713D:E07 | | | | 27.5 | | |
| 22399 | M00073715A:F05 | | | | 20 | | 31.7 |
| 22400 | M00073715B:B06 | | | | 37.5 | | 27.0 |
| 22401 | M00073717C:A12 | | | | 37.5 | | |
| 22403 | M00073720D:H11 | | | | 27.5 | | 20.6 |
| 22408 | M00073735C:E04 | | | | | | 23.8 |
| 22413 | M00073743C:F03 | | | | 25 | | |
| 22417 | M00073748B:F07 | | | | 35 | | |
| 22424 | M00073754B:D05 | | | | 37.5 | | |
| 22436 | M00073765A:E02 | | | | 32.5 | | |
| 22439 | M00073766B:B07 | | | | 22.5 | | |
| 22442 | M00073772B:E07 | | | | | | 22.2 |
| 22450 | M00073779B:B11 | | | | 32.5 | | |
| 22462 | M00073798A:H03 | | | | 35 | | |
| 22464 | M00073801B:A10 | | | | 35 | | |
| 22467 | M00073809C:E09 | | 23.5 | 45 | | 25.4 | |
| 22469 | M00073813D:B06 | | | | | | 27.0 |
| 22470 | M00073814C:B04 | | | | | | 71.4 |
| 22473 | M00073790A:A12 | | | | | | 36.5 |
| 22480 | M00073799A:G02 | | | | 37.5 | | |
| 22481 | M00073799D:G04 | | | | 30 | | |
| 22486 | M00073813A:E06 | | | | 32.5 | | |
| 22487 | M00073813B:A01 | | | | 30 | | |
| 22493 | M00073822C:E02 | | | | 35 | | |
| 22494 | M00073824A:C04 | | | | | | 38.1 |
| 22497 | M00073832A:A06 | | | | 20 | | 20.6 |
| 22500 | M00073834A:H10 | | | | 35 | | |
| 22502 | M00073834D:H06 | | | | 25 | | 31.7 |
| 22503 | M00073836D:E05 | | | | | 23.8 | |
| 22506 | M00073838B:F09 | | | | 25 | | |
| 22509 | M00073839A:D05 | | 23.5 | | 47.5 | | 41.3 |
| 22513 | M00073850A:H09 | | | | | | 54.0 |
| 22532 | M00073867D:F10 | | | | | | 36.5 |
| 22533 | M00073871B:C12 | | | | 32.5 | | |
| 22534 | M00073872C:B09 | | | | 22.5 | | |
| 22535 | M00073872D:B01 | | | | 32.5 | | |
| 22536 | M00073872D:E10 | | | | 22.5 | | |
| 22544 | M00073883B:D03 | | | | 22.5 | | |
| 22550 | M00073892B:F12 | | | | 32.5 | | |
| 22555 | M00073905B:A03 | | | | | | 55.6 |
| 22562 | M00073897B:B11 | | | | 30 | | |
| 22564 | M00073899A:D06 | | | | 32.5 | | |
| 22565 | M00073911B:G10 | | | | | | 23.8 |
| 22567 | M00073916A:B07 | | | | 42.5 | | 23.8 |
| 22572 | M00073923C:A04 | 29.4 | | | 22.5 | | |
| 22575 | M00073931D:E02 | | | | 27.5 | | |
| 22577 | M00073936D:E05 | | | | 25 | | |
| 22579 | M00073908C:D09 | | | | 40 | | 27.0 |
| 22599 | M00073944D:A07 | | | | 27.5 | | |
| 22620 | M00073968B:B06 | | | | 27.5 | | 57.1 |
| 22625 | M00073979C:G07 | | | | 37.5 | | 44.4 |
| 22634 | M00073988D:F09 | | | | | | 38.1 |
| 22641 | M00073979B:B05 | | | | 27.5 | | 66.7 |
| 22645 | M00073988C:G08 | | | | 40 | | |
| 22654 | M00074011D:C05 | | | | 42.5 | | |
| 22656 | M00074013C:C09 | | | | 20 | | |
| 22659 | M00074015A:C03 | | | | 22.5 | | |
| 22665 | M00074020D:G10 | | | | 40 | | |
| 22669 | M00074025A:F06 | | | | 25 | | 36.5 |
| 22670 | M00074025B:A12 | | | | | | 20.6 |
| 22671 | M00074026C:H09 | | | | 32.5 | | |

TABLE 154-continued

| SEQ ID | CLONE ID | BREAST PATIENTS >= 2x | BREAST PATIENTS <= halfx | COLON PATIENTS >= 2x | COLON PATIENTS <= halfx | PROSTATE PATIENTS >= 2x | PROSTATE PATIENTS <= halfx |
|---|---|---|---|---|---|---|---|
| 22687 | M00074053C:E05 | 25.0 | | 30 | | | |
| 22695 | M00074059B:G10 | | | | 27.5 | | |
| 22703 | M00074075B:A09 | | | 27.5 | | | |
| 22706 | M00074079A:E07 | | | | 42.5 | | 31.7 |
| 22708 | M00074084D:B04 | | | | | | 33.3 |
| 22710 | M00074085B:E06 | | | | | | 23.8 |
| 22712 | M00074087B:C09 | | | | | | 28.6 |
| 22713 | M00074087C:G05 | | | | | | 23.8 |
| 22717 | M00074089D:E03 | | | | 20 | | 54.0 |
| 22720 | M00074093B:A03 | | 23.5 | 27.5 | | | |
| 22722 | M00074094B:F10 | | | | | | 52.4 |
| 22723 | M00074096D:G12 | | | | | | 25.4 |
| 22726 | M00074098C:B09 | | | | | | 23.8 |
| 22727 | M00074099C:B09 | | | | 20 | | |
| 22729 | M00074101D:D07 | | | 35 | | | |
| 22730 | M00074102A:C04 | | | | 37.5 | | |
| 22733 | M00074107C:C08 | | | 35 | | | |
| 22741 | M00074131A:H09 | | | | 37.5 | | 27.0 |
| 22742 | M00074132C:F10 | | | | 32.5 | | 22.2 |
| 22747 | M00074138D:A08 | | | | 45 | | 22.2 |
| 22749 | M00074142B:C11 | | | | 32.5 | | |
| 22750 | M00074142D:A10 | | | | 22.5 | | |
| 22753 | M00074122A:B02 | | | | 37.5 | | |
| 22756 | M00074132A:E11 | | | 22.5 | | | |
| 22757 | M00074132B:B07 | | | | 35 | | 20.6 |
| 22758 | M00074134A:G11 | | | | 27.5 | | |
| 22759 | M00074149A:B10 | | 41.2 | 47.5 | | | |
| 22762 | M00074153D:A05 | | | | 37.5 | | |
| 22765 | M00074157C:G08 | | | | 25 | | |
| 22767 | M00074158C:F12 | | | | 37.5 | | |
| 22769 | M00074159C:A05 | | | | 25 | | |
| 22777 | M00074174A:C02 | | | | 27.5 | | 27.0 |
| 22782 | M00074177B:H08 | | | | 35 | | |
| 22785 | M00074179C:B01 | | | | 27.5 | | 28.6 |
| 22787 | M00074184D:B01 | | | | 37.5 | | 28.6 |
| 22789 | M00074191C:D08 | | | | | | 57.1 |
| 22790 | M00074192C:C10 | | | | | | 33.3 |
| 22793 | M00074198C:A12 | 29.4 | | | 45 | | 31.7 |
| 22794 | M00074198D:D10 | | | | | | 36.5 |
| 22800 | M00074203D:F01 | | | | 40 | | |
| 22802 | M00074206A:H12 | | | | 40 | | 22.2 |
| 22806 | M00074208B:F09 | | | | 22.5 | | 41.3 |
| 22811 | M00074215A:F09 | | | | 42.5 | | |
| 22813 | M00074216D:H03 | | | | 35 | | |
| 22819 | M00074223B:D12 | | | | 30 | | |
| 22821 | M00074225A:H12 | | | | 25 | | |
| 22827 | M00074234A:C05 | | | | 30 | | |
| 22830 | M00074234D:F12 | | | | 37.5 | | |
| 22834 | M00074242D:F09 | | | | 25 | | |
| 22837 | M00074247B:G11 | | | | 27.5 | | |
| 22839 | M00074248C:E12 | | | | | 25.4 | |
| 22840 | M00074249C:B11 | | | | 27.5 | | |
| 22846 | M00074251C:E03 | | | | 35 | | |
| 22849 | M00074253C:F03 | | | | 32.5 | | |
| 22850 | M00074255B:A01 | | | | 20 | | |
| 22851 | M00074258A:H12 | | | | 32.5 | | |
| 22861 | M00074271B:E11 | | | | 25 | | |
| 22869 | M00074280D:H03 | | | | 20 | | 31.7 |
| 22870 | M00074284B:B03 | | | | 27.5 | | 25.4 |
| 22873 | M00074288A:F11 | | | | 45 | | 20.6 |
| 22874 | M00074290A:G10 | | | | 37.5 | | |
| 22875 | M00074290C:B05 | | | | | | 20.6 |
| 22877 | M00074293D:B05 | | | | 20 | | |
| 22878 | M00074293D:H07 | | | | 32.5 | | |
| 22882 | M00074304B:C09 | | | | 22.5 | | 39.7 |
| 22883 | M00074304D:D07 | | | | | | 36.5 |
| 22884 | M00074306A:B09 | | | | 27.5 | | |
| 22886 | M00074310D:D02 | | | | 35 | | 25.4 |
| 22888 | M00074315B:A03 | | | | 22.5 | | |
| 22892 | M00074835A:H10 | | | | 40 | | |
| 22893 | M00074835B:F12 | | | | 22.5 | | |
| 22895 | M00074837A:E01 | | | | 35 | | |
| 22899 | M00074843D:D02 | | | | 25 | | 65.1 |
| 22900 | M00074844B:B02 | | 58.8 | 20 | | | |
| 22901 | M00074844D:F09 | | | | 30 | | 20.6 |
| 22905 | M00074847B:G03 | | | | 30 | | |

TABLE 154-continued

| SEQ ID | CLONE ID | BREAST PATIENTS >= 2x | BREAST PATIENTS <= halfx | COLON PATIENTS >= 2x | COLON PATIENTS <= halfx | PROSTATE PATIENTS >= 2x | PROSTATE PATIENTS <= halfx |
|---|---|---|---|---|---|---|---|
| 22909 | M00074852B:A02 | | | 37.5 | | | |
| 22912 | M00074854A:C11 | | | | 40 | | |
| 22913 | M00074855B:A05 | | | | 27.5 | | |
| 22917 | M00074863D:F07 | | | | 27.5 | | |
| 22919 | M00074317D:B08 | | | | | | 20.6 |
| 22920 | M00074320C:A06 | | | | | | 54.0 |
| 22921 | M00074865A:F05 | | | | 20 | | 50.8 |
| 22923 | M00074871C:G05 | | | | 20 | | |
| 22926 | M00074879A:A02 | | | | 35 | | 22.2 |
| 22930 | M00074890A:E03 | | | | 20 | | 20.6 |
| 22931 | M00074895D:H12 | | | | | | 20.6 |
| 22934 | M00074901C:E05 | | | | 27.5 | | |
| 22938 | M00074905D:A01 | | | | 35 | | 30.2 |
| 22941 | M00074912B:A10 | | | | | | 65.1 |
| 22943 | M00074916A:H03 | | | | 30 | | |
| 22949 | M00074927D:G09 | | | | 22.5 | | |
| 22954 | M00074936B:E10 | | | | 37.5 | | |
| 22955 | M00074939B:A06 | | | | 32.5 | | |
| 22959 | M00074966D:E08 | | | | | | 34.9 |
| 22962 | M00074974C:E11 | | | | | | 22.2 |
| 22964 | M00074954A:H06 | | | | 20 | | |
| 22975 | M00072985A:C12 | | | | 20 | | |
| 22981 | M00072996B:A10 | | | | 27.5 | | 20.6 |
| 22984 | M00072997D:H06 | | | | 40 | | 20.6 |
| 22986 | M00074333D:A11 | | 41.2 | 47.5 | | | |
| 22990 | M00074343C:A03 | | | | 30 | | |
| 22998 | M00074366A:H07 | | | | 27.5 | | 42.9 |
| 23004 | M00074392C:D02 | | | | 32.5 | | |
| 23006 | M00074417D:F07 | | 23.5 | 67.5 | | | |
| 23008 | M00074406B:F10 | | | | 27.5 | | |
| 23012 | M00074391B:D02 | | | 27.5 | | | |
| 23019 | M00074461D:E04 | | | | 47.5 | | 25.4 |
| 23025 | M00074488C:C08 | | | | 32.5 | | |
| 23027 | M00074501A:G07 | | | | | | 49.2 |
| 23029 | M00074515A:E02 | | | | | 25.4 | |
| 23030 | M00074515C:A11 | | | | 32.5 | | |
| 23031 | M00074516B:H03 | | | | | | 23.8 |
| 23032 | M00074525A:B05 | | | | | | 20.6 |
| 23039 | M00074561D:D12 | | | | 30 | 28.6 | |
| 23040 | M00074566B:A04 | | | | 35 | | |
| 23044 | M00074555A:E10 | | | | 27.5 | | |
| 23045 | M00074561A:B09 | | | | 40 | | |
| 23052 | M00074582D:B09 | | | | | | 25.4 |
| 23057 | M00074596D:B12 | | | | 20 | | 22.2 |
| 23058 | M00074606C:G02 | 29.4 | | | | | |
| 23064 | M00074628C:D03 | | | | 37.5 | | |
| 23067 | M00074637A:C02 | | | | 20 | | |
| 23068 | M00074638D:C12 | 29.4 | | | 35 | | |
| 23069 | M00074639A:C08 | | | | 30 | | |
| 23073 | M00074662B:A05 | | 35.3 | | | | |
| 23078 | M00074676D:H07 | | | | 22.5 | | |
| 23080 | M00074681D:A02 | | | | 32.5 | | |
| 23082 | M00074699B:C03 | | | | 32.5 | | |
| 23083 | M00074701D:H09 | | | | 25 | | |
| 23086 | M00074713B:F02 | | | | 20 | | 39.7 |
| 23089 | M00074723D:D05 | | | | 27.5 | | |
| 23092 | M00074740B:F06 | | | | 27.5 | | |
| 23095 | M00074752A:D08 | | | | 32.5 | | 20.6 |
| 23099 | M00074765D:F06 | | | | 40 | | |
| 23102 | M00074773C:G03 | | | | 20 | | |
| 23103 | M00074774A:D03 | | | | | | 31.7 |
| 23105 | M00074780C:C02 | | | | 20 | | |
| 23110 | M00075000A:D06 | | | | 32.5 | | |
| 23117 | M00074800B:H01 | | | | 35 | | |
| 23120 | M00074825C:E06 | | | | 30 | | |
| 23122 | M00075018A:G04 | | | | 30 | | |
| 23134 | M00075035C:C09 | | | | 32.5 | | |
| 23135 | M00075045D:H03 | | | | 25 | | |
| 23145 | M00075153C:C11 | | | | 22.5 | | |
| 23146 | M00075161A:E05 | | | | 30 | | |
| 23152 | M00075152D:C06 | | | | 30 | | |
| 23155 | M00075160A:E04 | | | | 42.5 | | |
| 23163 | M00075174D:D06 | | | | 27.5 | | |
| 23167 | M00075199D:D11 | | 29.4 | | | | 36.5 |
| 23168 | M00075201D:A05 | | | | 30 | | |
| 23169 | M00075203A:G06 | | | | 35 | | 20.6 |

TABLE 154-continued

| SEQ ID | CLONE ID | BREAST PATIENTS >= 2x | BREAST PATIENTS <= halfx | COLON PATIENTS >= 2x | COLON PATIENTS <= halfx | PROSTATE PATIENTS >= 2x | PROSTATE PATIENTS <= halfx |
|---|---|---|---|---|---|---|---|
| 23179 | M00075245A:A06 |  | 41.2 | 37.5 |  | 28.6 |  |
| 23189 | M00075283A:F04 |  |  |  |  | 34.9 |  |
| 23198 | M00075329B:E10 |  | 25.0 | 62.5 |  |  |  |
| 23203 | M00075344D:A08 |  |  |  | 22.5 |  |  |
| 23224 | M00075379A:E07 |  |  |  | 27.5 |  |  |
| 23225 | M00075383A:B11 |  |  |  | 25 |  |  |
| 23227 | M00075409A:E04 |  |  |  | 25 |  |  |
| 23235 | M00075448B:G11 |  |  |  | 35 |  | 20.6 |
| 23239 | M00075460C:B06 |  | 35.3 | 62.5 |  | 20.6 |  |
| 23245 | M00075504B:A10 |  |  |  | 32.5 |  |  |
| 23250 | M00075514A:G12 |  |  |  | 32.5 |  |  |
| 23266 | M00075621A:F06 |  |  |  | 20 |  | 20.6 |
| 23386 |  | 23.5 |  |  |  |  |  |
| 23387 |  |  |  | 34.3 |  |  |  |
| 23388 |  |  | 23.5 | 67.5 |  |  |  |
| 23390 |  | 35.3 |  | 26.1 |  |  |  |
| 23400 |  |  |  |  | 32.5 |  |  |
| 23402 |  |  |  |  |  |  | 41.3 |
| 23403 |  |  |  |  |  |  |  |
| 23404 |  |  |  |  | 30.0 | 28.6 |  |
| 23426 |  |  |  | 36.6 |  |  |  |
| 23427 |  |  |  |  | 42.9 |  | 38.2 |
| 23429 |  |  |  |  | 31.6 |  |  |
| 23434 |  |  |  | 55.0 |  |  |  |
| 23438 |  |  |  |  | 21.3 |  | 21.5 |
| 23439 |  |  |  |  | 30.0 |  |  |
| 23444 |  |  |  |  |  |  |  |
| 23445 |  |  |  | 27.5 |  |  |  |
| 23447 |  | 29.4 |  | 32.6 |  |  |  |
| 23449 |  | 35.3 |  | 60.9 |  |  |  |
| 23461 |  |  | 29.4 |  |  |  |  |
| 23462 |  |  | 41.2 | 36.2 |  |  |  |
| 23463 |  |  |  |  | 27.5 |  |  |
| 23472 |  |  |  |  | 23.4 |  |  |
| 23474 |  |  |  |  | 37.5 |  |  |
| 23475 |  |  | 35.3 | 54.3 |  |  |  |

Example 98

Antisense Regulation of Gene Expression

The expression of the differentially expressed genes represented by the polynucleotides in the cancerous cells can be further analyzed using antisense knockout technology to confirm the role and function of the gene product in tumorigenesis, e.g., in promoting a metastatic phenotype.

Methods for analysis using antisense technology are well known in the art. For example, a number of different oligonucleotides complementary to the mRNA generated by the differentially expressed genes identified herein can be designed as antisense oligonucleotides, and tested for their ability to suppress expression of the genes. Sets of antisense oligomers specific to each candidate target are designed using the sequences of the polynucleotides corresponding to a differentially expressed gene and the software program HYBsimulator Version 4 (available for Windows 95/Windows NT or for Power Macintosh, RNAture, Inc. 1003 Health Sciences Road, West, Irvine, Calif. 92612 USA). Factors considered when designing antisense oligonucleotides include: 1) the expression of the differentially expressed genes represented by the polynucleotides in the cancerous cells can be analyzed using antisense knockout technology to confirm the role and function of the gene product in tumorigenesis, e.g., in promoting a metastatic phenotype.

A number of different oligonucleotides complementary to the mRNA generated by the differentially expressed genes identified herein can be designed as potential antisense oligonucleotides, and tested for their ability to suppress expression of the genes. Sets of antisense oligomers specific to each candidate target are designed using the sequences of the polynucleotides corresponding to a differentially expressed gene and the software program HYBsimulator Version 4 (available for Windows 95/Windows NT or for Power Macintosh, RNAture, Inc. 1003 Health Sciences Road, West, Irvine, Calif. 92612 USA). Factors that are considered when designing antisense oligonucleotides include: 1) the secondary structure of oligonucleotides; 2) the secondary structure of the target gene; 3) the specificity with no or minimum cross-hybridization to other expressed genes; 4) stability; 5) length and 6) terminal GC content. The antisense oligonucleotide is designed so that it will hybridize to its target sequence under conditions of high stringency at physiological temperatures (e.g., an optimal temperature for the cells in culture to provide for hybridization in the cell, e.g., about 37° C.), but with minimal formation of homodimers.

Using the sets of oligomers and the HYBsimulator program, three to ten antisense oligonucleotides and their reverse controls are designed and synthesized for each candidate mRNA transcript, which transcript is obtained from the gene corresponding to the target polynucleotide sequence of interest. Once synthesized and quantitated, the oligomers are screened for efficiency of a transcript knock-out in a panel of cancer cell lines. The efficiency of the knock-out is determined by analyzing mRNA levels using lightcycler quantification. The oligomers that resulted in the highest level of transcript knock-out, wherein the level was at least about 50%, preferably about 80-90%, up to 95% or more up to undetectable message, are selected for use in a cell-based proliferation assay, an anchorage independent growth assay, and an apoptosis assay.

The ability of each designed antisense oligonucleotide to inhibit gene expression is tested through transfection into LNCaP, PC3, 22Rv1, MDA-PCA-2b, or DU145 prostate carcinoma cells. For each transfection mixture, a carrier molecule (such as a lipid, lipid derivative, lipid-like molecule, cholesterol, cholesterol derivative, or cholesterol-like molecule) is prepared to a working concentration of 0.5 mM in water, sonicated to yield a uniform solution, and filtered through a 0.45 µm PVDF membrane. The antisense or control oligonucleotide is then prepared to a working concentration of 100 µM in sterile Millipore water. The oligonucleotide is further diluted in OptiMEM™ (Gibco/BRL), in a microfuge tube, to 2 µM, or approximately 20 µg oligo/ml of OptiMEM™. In a separate microfuge tube, the carrier molecule, typically in the amount of about 1.5-2 nmol carrier/µg antisense oligonucleotide, is diluted into the same volume of OptiMEM™ used to dilute the oligonucleotide. The diluted antisense oligonucleotide is immediately added to the diluted carrier and mixed by pipetting up and down. Oligonucleotide is added to the cells to a final concentration of 30 nM.

The level of target mRNA that corresponds to a target gene of interest in the transfected cells is quantitated in the cancer cell lines using the Roche LightCycler™ real-time PCR machine. Values for the target mRNA are normalized versus an internal control (e.g., beta-actin). For each 20 µl reaction, extracted RNA (generally 0.2-1 µg total) is placed into a sterile 0.5 or 1.5 ml microcentrifuge tube, and water is added to a total volume of 12.5 µl. To each tube is added 7.5 µl of a buffer/enzyme mixture, prepared by mixing (in the order listed) 2.5 µl $H_2O$, 2.0 µl 10× reaction buffer, 10 µl oligo dT (20 pmol), 1.0 µl dNTP mix (10 mM each), 0.5 µl RNAsin® (20 u) (Ambion, Inc., Hialeah, Fla.), and 0.5 µl MMLV reverse transcriptase (50 u) (Ambion, Inc.). The contents are mixed by pipetting up and down, and the reaction mixture is incubated at 42° C. for 1 hour. The contents of each tube are centrifuged prior to amplification.

An amplification mixture is prepared by mixing in the following order: 1×PCR buffer II, 3 mM $MgCl_2$, 140 µM each dNTP, 0.175 pmol each oligo, 1:50,000 dil of SYBR® Green, 0.25 mg/ml BSA, 1 unit Taq polymerase, and $H_2O$ to 20 µl. (PCR buffer II is available in 10× concentration from Perkin-Elmer, Norwalk, Conn.). In 1× concentration it contains 10 mM Tris pH 8.3 and 50 mM KCl. SYBR® Green (Molecular Probes, Eugene, Oreg.) is a dye which fluoresces when bound to double stranded DNA. As double stranded PCR product is produced during amplification, the fluorescence from SYBR® Green increases. To each 20 µl aliquot of amplification mixture, 2 µl of template RT is added, and amplification is carried out according to standard protocols. The results are expressed as the percent decrease in expression of the corresponding gene product relative to non-transfected cells, vehicle-only transfected (mock-transfected) cells, or cells transfected with reverse control oligonucleotides.

Example 99

Effect of Expression on Proliferation

The effect of gene expression on the inhibition of cell proliferation can be assessed in metastatic breast cancer cell lines (MDA-MB-231 ("231")); SW620 colon colorectal carcinoma cells; SKOV3 cells (a human ovarian carcinoma cell line); or LNCaP, PC3, 22Rv1, MDA-PCA-2b, or DU145 prostate cancer cells.

Cells are plated to approximately 60-80% confluency in 96-well dishes. Antisense or reverse control oligonucleotide is diluted to 2 µM in OptiMEM™. The oligonucleotide-OptiMEM™ can then be added to a delivery vehicle, which delivery vehicle can be selected so as to be optimized for the particular cell type to be used in the assay. The oligo/delivery vehicle mixture is then further diluted into medium with serum on the cells. The final concentration of oligonucleotide for all experiments can be about 300 nM.

Antisense oligonucleotides are prepared as described above. Cells are transfected overnight at 37° C. and the transfection mixture is replaced with fresh medium the next morning. Transfection is carried out as described above 8.

Those antisense oligonucleotides that result in inhibition of proliferation of SW620 cells indicate that the corresponding gene plays a role in production or maintenance of the cancerous phenotype in cancerous colon cells. Those antisense oligonucleotides that inhibit proliferation in SKOV3 cells represent genes that play a role in production or maintenance of the cancerous phenotype in cancerous breast cells. Those antisense oligonucleotides that result in inhibition of proliferation of MDA-MB-231 cells indicate that the corresponding gene plays a role in production or maintenance of the cancerous phenotype in cancerous ovarian cells. Those antisense oligonucleotides that inhibit proliferation in LNCaP, PC3, 22Rv1, MDA-PCA-2b, or DU145 cells represent genes that play a role in production or maintenance of the cancerous phenotype in cancerous prostate cells.

Example 100

Effect of Gene Expression on Cell Migration

The effect of gene expression on the inhibition of cell migration can be assessed in LNCaP, PC3, 22Rv1, MDA-PCA-2b, or DU145 prostate cancer cells using static endothelial cell binding assays, non-static endothelial cell binding assays, and transmigration assays.

For the static endothelial cell binding assay, antisense oligonucleotides are prepared as described above. Two days prior to use, prostate cancer cells (CaP) are plated and transfected with antisense oligonucleotide as described above On the day before use, the medium is replaced with fresh medium, and on the day of use, the medium is replaced with fresh medium containing 2 µM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in DMEM/1% BSA/10 mM HEPES pH 7.0. Finally, CaP cells are counted and resuspended at a concentration of $1 \times 10^6$ cells/ml.

Endothelial cells (EC) are plated onto 96-well plates at 40-50% confluence 3 days prior to use. On the day of use, EC are washed 1× with PBS and 50λ DMDM/1% BSA/10 mM HEPES pH 7 is added to each well. To each well is then added 50K (50λ) CaP cells in DMEM/1% BSA/10 mM HEPES pH 7. The plates are incubated for an additional 30 min and washed 5× with PBS containing $Ca^{++}$ and $Mg^{++}$. After the final wash, 100 µL PBS is added to each well and fluorescence is read on a fluorescent plate reader (Ab492/Em 516 nm).

For the non-static endothelial cell binding assay, CaP are prepared as described above. EC are plated onto 24-well plates at 30-40% confluence 3 days prior to use. On the day of use, a subset of EC are treated with cytokine for 6 hours then washed 2× with PBS. To each well is then added 150-200K CaP cells in DMEM/1% BSA/10 mM HEPES pH 7. Plates are placed on a rotating shaker (70 RPM) for 30 min and then washed 3× with PBS containing $Ca^{++}$ and $Mg^{++}$. After the final wash, 500 μL PBS is added to each well and fluorescence is read on a fluorescent plate reader (Ab492/Em 516 nm).

For the transmigration assay, CaP are prepared as described above with the following changes. On the day of use, CaP medium is replaced with fresh medium containing 5 μM CellTracker green CMFDA (Molecular Probes, Inc.) and cells are incubated for 30 min. Following incubation, CaP medium is replaced with fresh medium (no CMFDA) and cells are incubated for an additional 30-60 min. CaP cells are detached using CMF PBS/2.5 mM EDTA or trypsin, spun and resuspended in EGM-2-MV medium. Finally, CaP cells are counted and resuspended at a concentration of $1\times10^6$ cells/ml.

EC are plated onto FluorBlok transwells (BD Biosciences) at 30-40% confluence 5-7 days before use. Medium is replaced with fresh medium 3 days before use and on the day of use. To each transwell is then added 50K labeled CaP. 30 min prior to the first fluorescence reading, 10 μg of FITC-dextran (10K MW) is added to the EC plated filter. Fluorescence is then read at multiple time points on a fluorescent plate reader (Ab492/Em 516 nm).

Those antisense oligonucleotides that result in inhibition of binding of LNCaP, PC3, 22Rv1, MDA-PCA-2b, or DU145 prostate cancer cells to endothelial cells indicate that the corresponding gene plays a role in the production or maintenance of the cancerous phenotype in cancerous prostate cells. Those antisense oligonucleotides that result in inhibition of endothelial cell transmigration by LNCaP, PC3, 22Rv1, MDA-PCA-2b, or DU145 prostate cancer cells indicate that the corresponding gene plays a role in the production or maintenance of the cancerous phenotype in cancerous prostate cells.

Example 101

Effect of Gene Expression on Colony Formation

The effect of gene expression upon colony formation of SW620 cells, SKOV3 cells, MD-MBA-231 cells, LNCaP cells, PC3 cells, 22Rv1 cells, MDA-PCA-2b cells, and DU145 cells can be tested in a soft agar assay. Soft agar assays are conducted by first establishing a bottom layer of 2 ml of 0.6% agar in media plated fresh within a few hours of layering on the cells. The cell layer is formed on the bottom layer by removing cells transfected as described above from plates using 9.05% trypsin and washing twice in media. The cells are counted in a Coulter counter, and resuspended to $10^6$ per ml in media. 10 μl aliquots are placed with media in 96-well plates (to check counting with WST1), or diluted further for the soft agar assay. 2000 cells are plated in 800 μl 0.4% agar in duplicate wells above 0.6% agar bottom layer. After the cell layer agar solidifies, 2 ml of media is dribbled on top and antisense or reverse control oligo (produced as described above) is added without delivery vehicles. Fresh media and oligos are added every 3-4 days. Colonies form in 10 days to 3 weeks. Fields of colonies are counted by eye. Wst-1 metabolism values can be used to compensate for small differences in starting cell number. Larger fields can be scanned for visual record of differences.

Those antisense oligonucleotides that result in inhibition of colony formation of SW620 cells indicate that the corresponding gene plays a role in production or maintenance of the cancerous phenotype in cancerous colon cells. Those antisense oligonucleotides that inhibit colony formation in SKOV3 cells represent genes that play a role in production or maintenance of the cancerous phenotype in cancerous breast cells. Those antisense oligonucleotides that result in inhibition of colony formation of MDA-MB-231 cells indicate that the corresponding gene plays a role in production or maintenance of the cancerous phenotype in cancerous ovarian cells. Those antisense oligonucleotides that inhibit colony formation in LNCaP, PC3, 22Rv1, MDA-PCA-2b, or DU145 cells represent genes that play a role in production or maintenance of the cancerous phenotype in cancerous prostate cells.

Example 102

Induction of Cell Death Upon Depletion of Polypeptides by Depletion of mRNA ("Antisense Knockout")

In order to assess the effect of depletion of a target message upon cell death, LNCaP, PC3, 22Rv1, MDA-PCA-2b, or DU145 cells, or other cells derived from a cancer of interest, can be transfected for proliferation assays. For cytotoxic effect in the presence of cisplatin (cis), the same protocol is followed but cells are left in the presence of 2 μM drug. Each day, cytotoxicity is monitored by measuring the amount of LDH enzyme released in the medium due to membrane damage. The activity of LDH is measured using the Cytotoxicity Detection Kit from Roche Molecular Biochemicals. The data is provided as a ratio of LDH released in the medium vs. the total LDH present in the well at the same time point and treatment (rLDH/tLDH). A positive control using antisense and reverse control oligonucleotides for BCL2 (a known anti-apoptotic gene) is included; loss of message for BCL2 leads to an increase in cell death compared with treatment with the control oligonucleotide (background cytotoxicity due to transfection).

Example 103

Functional Analysis of Gene Products Differentially Expressed in Cancer

The gene products of sequences of a gene differentially expressed in cancerous cells can be further analyzed to confirm the role and function of the gene product in tumorigenesis, e.g., in promoting or inhibiting development of a metastatic phenotype. For example, the function of gene products corresponding to genes identified herein can be assessed by blocking function of the gene products in the cell. For example, where the gene product is secreted or associated with a cell surface membrane, blocking antibodies can be generated and added to cells to examine the effect upon the cell phenotype in the context of, for example, the transformation of the cell to a cancerous, particularly a metastatic, phenotype. In order to generate antibodies, a clone corresponding to a selected gene product is selected, and a sequence that represents a partial or complete coding sequence is obtained. The resulting clone is expressed, the polypeptide produced isolated, and antibodies generated. The antibodies are then combined with cells and the effect upon tumorigenesis assessed.

Where the gene product of the differentially expressed genes identified herein exhibits sequence homology to a protein of known function (e.g., to a specific kinase or protease) and/or to a protein family of known function (e.g., contains a domain or other consensus sequence present in a protease family or in a kinase family), then the role of the gene product in tumorigenesis, as well as the activity of the gene product, can be examined using small molecules that inhibit or enhance function of the corresponding protein or protein family.

Additional functional assays include, but are not necessarily limited to, those that analyze the effect of expression of the corresponding gene upon cell cycle and cell migration. Methods for performing such assays are well known in the art.

Example 104

Deposit Information

A deposit of the biological materials in the tables referenced below was made with the American Type Culture Collection, 10801 University Blvd., Manasas, Va. 20110-2209, under the provisions of the Budapest Treaty, on or before the filing date of the present application. The accession number indicated is assigned after successful viability testing, and the requisite fees were paid. Access to said cultures will be available during pendency of the patent application to one determined by the Commissioner to be entitled to such under 37 C.F.R. §1.14 and 35 U.S.C. §122. All restriction on availability of said cultures to the public will be irrevocably removed upon the granting of a patent based upon the application. Moreover, the designated deposits will be maintained for a period of thirty (30) years from the date of deposit, or for five (5) years after the last request for the deposit; or for the enforceable life of the U.S. patent, whichever is longer. Should a culture become nonviable or be inadvertently destroyed, or, in the case of plasmid-containing strains, lose its plasmid, it will be replaced with a viable culture(s) of the same taxonomic description.

These deposits are provided merely as a convenience to those of skill in the art, and are not an admission that a deposit is required. A license may be required to make, use, or sell the deposited materials, and no such license is hereby granted. The deposit below was received by the ATCC on or before the filing date of the present application.

TABLE 155

Cell Lines Deposited with ATCC

| Cell Line | Deposit Date | ATCC Accession No. | CMCC Accession No. |
|---|---|---|---|
| KM12L4-A | Mar. 19, 1998 | CRL-12496 | 11606 |
| Km12C | May 15, 1998 | CRL-12533 | 11611 |
| MDA-MB-231 | May 15, 1998 | CRL-12532 | 10583 |
| MCF-7 | Oct. 9, 1998 | CRL-12584 | 10377 |

In addition, pools of selected clones, as well as libraries containing specific clones, were assigned an "ES" number (internal reference) and deposited with the ATCC. Table 156 below provides the ATCC Accession Nos. of the clones deposited as a library named ES217. The deposit was made on Jan. 18, 2001. Table 157 (inserted before the claims) provides the ATCC Accession Nos. of the clones deposited as libraries named ES210-ES216 on Jul. 25, 2000.

TABLE 156

Clones Deposited as Library No. ES217 with ATCC on or before Jan. 18, 2001.

| CloneID | CMCC# | ATCC# | CloneID | CMCC# | ATCC# |
|---|---|---|---|---|---|
| M00073094B:A01 | 5418 | PTA-2918 | M00073425A:H12 | 5418 | PTA-2918 |
| M00073096B:A12 | 5418 | PTA-2918 | M00073427B:E04 | 5418 | PTA-2918 |
| M00073412C:E07 | 5418 | PTA-2918 | M00073408A:D06 | 5418 | PTA-2918 |
| M00073408C:F06 | 5418 | PTA-2918 | M00073428D:H03 | 5418 | PTA-2918 |
| M00073435C:E06 | 5418 | PTA-2918 | M00073435B:E11 | 5418 | PTA-2918 |
| M00073403B:F06 | 5418 | PTA-2918 | M00074323D:F09 | 5418 | PTA-2918 |
| M00073412D:B07 | 5418 | PTA-2918 | M00074333D:A11 | 5418 | PTA-2918 |
| M00073421C:B07 | 5418 | PTA-2918 | M00074335A:H08 | 5418 | PTA-2918 |
| M00073429B:H10 | 5418 | PTA-2918 | M00074337A:G08 | 5418 | PTA-2918 |
| M00073412D:E02 | 5418 | PTA-2918 | M00074340B:D06 | 5418 | PTA-2918 |
| M00073097C:A03 | 5418 | PTA-2918 | M00074343C:A03 | 5418 | PTA-2918 |
| M00073403C:C10 | 5418 | PTA-2918 | M00074346A:H09 | 5418 | PTA-2918 |
| M00073425D:F08 | 5418 | PTA-2918 | M00074347B:F11 | 5418 | PTA-2918 |
| M00073403C:E11 | 5418 | PTA-2918 | M00074349A:E08 | 5418 | PTA-2918 |
| M00073431A:G02 | 5418 | PTA-2918 | M00074355D:H06 | 5418 | PTA-2918 |
| M00073412A:C03 | 5418 | PTA-2918 | M00074361C:B01 | 5418 | PTA-2918 |
| M00073424D:C03 | 5418 | PTA-2918 | M00074365A:E09 | 5418 | PTA-2918 |
| M00073430C:A01 | 5418 | PTA-2918 | M00074366A:D07 | 5418 | PTA-2918 |
| M00073407A:E12 | 5418 | PTA-2918 | M00074366A:H07 | 5418 | PTA-2918 |
| M00073412A:H09 | 5418 | PTA-2918 | M00074370D:G09 | 5418 | PTA-2918 |
| M00073418B:B09 | 5418 | PTA-2918 | M00074375D:E05 | 5418 | PTA-2918 |
| M00073403C:H09 | 5418 | PTA-2918 | M00074382D:F04 | 5418 | PTA-2918 |
| M00073416B:F01 | 5418 | PTA-2918 | M00074384D:G07 | 5418 | PTA-2918 |
| M00073425A:G10 | 5418 | PTA-2918 | M00074388B:E07 | 5418 | PTA-2918 |
| M00073427B:C08 | 5418 | PTA-2918 | M00074392C:D02 | 5418 | PTA-2918 |
| M00073430C:B02 | 5418 | PTA-2918 | M00074405B:A04 | 5418 | PTA-2918 |
| M00073418B:H09 | 5418 | PTA-2918 | M00074417D:F07 | 5418 | PTA-2918 |
| M00073423C:E01 | 5418 | PTA-2918 | M00074392D:D01 | 5418 | PTA-2918 |
| M00074391B:D02 | 5418 | PTA-2918 | M00074406B:F10 | 5418 | PTA-2918 |
| M00074390C:E04 | 5418 | PTA-2918 | M00074430D:G09 | 5418 | PTA-2918 |
| M00074411B:G07 | 5418 | PTA-2918 | M00074395A:B11 | 5418 | PTA-2918 |
| M00074415B:A01 | 5418 | PTA-2918 | M00074404B:H01 | 5418 | PTA-2918 |

TABLE 157

| ES No. | CLONE ID | ATCC# |
|---|---|---|
| ES 210 | M00073054A:A06 | PTA-2376 |
| ES 210 | M00073054A:C10 | PTA-2376 |
| ES 210 | M00073054B:E07 | PTA-2376 |
| ES 210 | M00073054C:E02 | PTA-2376 |
| ES 210 | M00073055D:E11 | PTA-2376 |
| ES 210 | M00073056C:A09 | PTA-2376 |
| ES 210 | M00073056C:C12 | PTA-2376 |
| ES 210 | M00073057A:F09 | PTA-2376 |
| ES 210 | M00073057D:A12 | PTA-2376 |
| ES 210 | M00073060B:C06 | PTA-2376 |
| ES 210 | M00073061B:F10 | PTA-2376 |
| ES 210 | M00073061C:G08 | PTA-2376 |
| ES 210 | M00073062B:D09 | PTA-2376 |
| ES 210 | M00073062C:D09 | PTA-2376 |
| ES 210 | M00073064C:A11 | PTA-2376 |
| ES 210 | M00073064C:H09 | PTA-2376 |
| ES 210 | M00073064D:B11 | PTA-2376 |
| ES 210 | M00073065D:D11 | PTA-2376 |
| ES 210 | M00073066B:G03 | PTA-2376 |
| ES 210 | M00073066C:D02 | PTA-2376 |
| ES 210 | M00073067A:E09 | PTA-2376 |
| ES 210 | M00073067B:D04 | PTA-2376 |
| ES 210 | M00073067D:B02 | PTA-2376 |
| ES 210 | M00073069D:G03 | PTA-2376 |
| ES 210 | M00073070A:B12 | PTA-2376 |
| ES 210 | M00073070B:B06 | PTA-2376 |
| ES 210 | M00073071D:D02 | PTA-2376 |
| ES 210 | M00073072A:A10 | PTA-2376 |
| ES 210 | M00073074B:G04 | PTA-2376 |
| ES 210 | M00073074D:A04 | PTA-2376 |
| ES 210 | M00073078B:F08 | PTA-2376 |
| ES 210 | M00073080B:A07 | PTA-2376 |
| ES 210 | M00073081A:F08 | PTA-2376 |
| ES 210 | M00073081D:C07 | PTA-2376 |
| ES 210 | M00073084C:E02 | PTA-2376 |
| ES 210 | M00073085D:B01 | PTA-2376 |
| ES 210 | M00073086D:B05 | PTA-2376 |
| ES 210 | M00073088C:B04 | PTA-2376 |
| ES 210 | M00073088D:F07 | PTA-2376 |
| ES 210 | M00073091B:C04 | PTA-2376 |
| ES 210 | M00073091D:B06 | PTA-2376 |
| ES 210 | M00073092A:D03 | PTA-2376 |
| ES 210 | M00073092D:B03 | PTA-2376 |
| ES 210 | M00073094B:A01 | PTA-2376 |
| ES 210 | M00073412A:C03 | PTA-2376 |
| ES 210 | M00073408C:F06 | PTA-2376 |
| ES 210 | M00073424D:C03 | PTA-2376 |
| ES 210 | M00073403B:F06 | PTA-2376 |
| ES 210 | M00073407A:E12 | PTA-2376 |
| ES 210 | M00073412A:H09 | PTA-2376 |
| ES 210 | M00073421C:B07 | PTA-2376 |
| ES 210 | M00073416B:F01 | PTA-2376 |
| ES 210 | M00073425A:G10 | PTA-2376 |
| ES 210 | M00073425A:H12 | PTA-2376 |
| ES 210 | M00073403C:C10 | PTA-2376 |
| ES 210 | M00073428D:H03 | PTA-2376 |
| ES 210 | M00073403C:E11 | PTA-2376 |
| ES 210 | M00073435B:E11 | PTA-2376 |
| ES 210 | M00073431A:G02 | PTA-2376 |
| ES 210 | M00073412C:E07 | PTA-2376 |
| ES 210 | M00073435C:E06 | PTA-2376 |
| ES 210 | M00073412D:B07 | PTA-2376 |
| ES 210 | M00073429B:H10 | PTA-2376 |
| ES 210 | M00073403C:H09 | PTA-2376 |
| ES 210 | M00073412D:E02 | PTA-2376 |
| ES 210 | M00073427B:C08 | PTA-2376 |
| ES 210 | M00073423C:E01 | PTA-2376 |
| ES 210 | M00073427B:E04 | PTA-2376 |
| ES 210 | M00073425D:F08 | PTA-2376 |
| ES 210 | M00073096B:A12 | PTA-2376 |
| ES 210 | M00073430C:A01 | PTA-2376 |
| ES 210 | M00073418B:B09 | PTA-2376 |
| ES 210 | M00073430C:B02 | PTA-2376 |
| ES 210 | M00073097C:A03 | PTA-2376 |
| ES 210 | M00073418B:H09 | PTA-2376 |
| ES 210 | M00073408A:D06 | PTA-2376 |
| ES 210 | M00073438A:A08 | PTA-2376 |
| ES 210 | M00073438A:B02 | PTA-2376 |
| ES 210 | M00073438D:G05 | PTA-2376 |
| ES 210 | M00073442A:F07 | PTA-2376 |
| ES 210 | M00073442B:D12 | PTA-2376 |
| ES 210 | M00073442D:E11 | PTA-2376 |
| ES 210 | M00073446C:A03 | PTA-2376 |
| ES 210 | M00073447B:A03 | PTA-2376 |
| ES 210 | M00073447D:F01 | PTA-2376 |
| ES 210 | M00073448B:F11 | PTA-2376 |
| ES 210 | M00073448B:F07 | PTA-2376 |
| ES 210 | M00073453C:C09 | PTA-2376 |
| ES 210 | M00073455C:G09 | PTA-2376 |
| ES 210 | M00073457A:G09 | PTA-2376 |
| ES 210 | M00073462C:H12 | PTA-2376 |
| ES 210 | M00073462D:D12 | PTA-2376 |
| ES 210 | M00073464B:E01 | PTA-2376 |
| ES 210 | M00073464D:G12 | PTA-2376 |
| ES 210 | M00073465A:H08 | PTA-2376 |
| ES 210 | M00073469B:A09 | PTA-2376 |
| ES 210 | M00073469D:A06 | PTA-2376 |
| ES 210 | M00073470D:A01 | PTA-2376 |
| ES 210 | M00073474A:G11 | PTA-2376 |
| ES 210 | M00073474C:F08 | PTA-2376 |
| ES 210 | M00073475D:E05 | PTA-2376 |
| ES 210 | M00073478C:A07 | PTA-2376 |
| ES 210 | M00073483B:C07 | PTA-2376 |
| ES 210 | M00073484B:A05 | PTA-2376 |
| ES 210 | M00073484C:B04 | PTA-2376 |
| ES 210 | M00073486A:A12 | PTA-2376 |
| ES 210 | M00073487A:C07 | PTA-2376 |
| ES 210 | M00073489B:A07 | PTA-2376 |
| ES 210 | M00073493A:E12 | PTA-2376 |
| ES 210 | M00073493D:F05 | PTA-2376 |
| ES 210 | M00073495B:G11 | PTA-2376 |
| ES 210 | M00073497C:D03 | PTA-2376 |
| ES 210 | M00073504D:F03 | PTA-2376 |
| ES 210 | M00073505D:F01 | PTA-2376 |
| ES 210 | M00073509B:B11 | PTA-2376 |
| ES 210 | M00073509B:E03 | PTA-2376 |
| ES 210 | M00073513A:G07 | PTA-2376 |
| ES 210 | M00073513D:A11 | PTA-2376 |
| ES 210 | M00073515A:F09 | PTA-2376 |
| ES 210 | M00073517A:A06 | PTA-2376 |
| ES 210 | M00073517D:F11 | PTA-2376 |
| ES 210 | M00073520D:A04 | PTA-2376 |
| ES 210 | M00073524A:A03 | PTA-2376 |
| ES 210 | M00073524A:G05 | PTA-2376 |
| ES 210 | M00073529A:F03 | PTA-2376 |
| ES 210 | M00073530B:A02 | PTA-2376 |
| ES 210 | M00073531B:H02 | PTA-2376 |
| ES 210 | M00073531C:F12 | PTA-2376 |
| ES 210 | M00073537B:A12 | PTA-2376 |
| ES 210 | M00073539C:H05 | PTA-2376 |
| ES 210 | M00073541B:C10 | PTA-2376 |
| ES 210 | M00073547B:F04 | PTA-2376 |
| ES 210 | M00073547C:D02 | PTA-2376 |
| ES 210 | M00073549B:B03 | PTA-2376 |
| ES 210 | M00073551B:E10 | PTA-2376 |
| ES 210 | M00073552A:F06 | PTA-2376 |
| ES 210 | M00073554A:C01 | PTA-2376 |
| ES 210 | M00073554A:G04 | PTA-2376 |
| ES 210 | M00073554B:A08 | PTA-2376 |
| ES 210 | M00073554B:D11 | PTA-2376 |
| ES 210 | M00073555A:B09 | PTA-2376 |
| ES 210 | M00073555D:B04 | PTA-2376 |
| ES 210 | M00073557A:A05 | PTA-2376 |
| ES 210 | M00073558A:A02 | PTA-2376 |
| ES 210 | M00073561C:A04 | PTA-2376 |
| ES 210 | M00073565D:E05 | PTA-2376 |
| ES 210 | M00073566A:G01 | PTA-2376 |
| ES 210 | M00073568A:G06 | PTA-2376 |
| ES 210 | M00073568C:G07 | PTA-2376 |
| ES 210 | M00073569A:H02 | PTA-2376 |
| ES 210 | M00073571A:F12 | PTA-2376 |
| ES 210 | M00073575B:H12 | PTA-2376 |
| ES 210 | M00073576B:E03 | PTA-2376 |
| ES 210 | M00073576C:C11 | PTA-2376 |
| ES 210 | M00073577B:D12 | PTA-2376 |
| ES 210 | M00073579B:A04 | PTA-2376 |

TABLE 157-continued

| ES No. | CLONE ID | ATCC# |
|---|---|---|
| ES 210 | M00073580A:D08 | PTA-2376 |
| ES 210 | M00073587D:E12 | PTA-2376 |
| ES 210 | M00073588B:H07 | PTA-2376 |
| ES 210 | M00073590C:F07 | PTA-2376 |
| ES 210 | M00073592B:D09 | PTA-2376 |
| ES 210 | M00073594B:B11 | PTA-2376 |
| ES 210 | M00073595D:A11 | PTA-2376 |
| ES 210 | M00073598D:E11 | PTA-2376 |
| ES 210 | M00073599C:E08 | PTA-2376 |
| ES 210 | M00073601A:B06 | PTA-2376 |
| ES 210 | M00073601A:F07 | PTA-2376 |
| ES 210 | M00073601D:D08 | PTA-2376 |
| ES 210 | M00073603A:F04 | PTA-2376 |
| ES 210 | M00073603B:C03 | PTA-2376 |
| ES 210 | M00073603C:A11 | PTA-2376 |
| ES 210 | M00073603C:C02 | PTA-2376 |
| ES 210 | M00073603D:E07 | PTA-2376 |
| ES 210 | M00073604B:B07 | PTA-2376 |
| ES 210 | M00073604B:H06 | PTA-2376 |
| ES 210 | M00073604C:H09 | PTA-2376 |
| ES 210 | M00073605B:F10 | PTA-2376 |
| ES 210 | M00073605B:F11 | PTA-2376 |
| ES 210 | M00073606D:F12 | PTA-2376 |
| ES 210 | M00073610A:F06 | PTA-2376 |
| ES 210 | M00073614B:A12 | PTA-2376 |
| ES 210 | M00073614B:G09 | PTA-2376 |
| ES 210 | M00073614C:F06 | PTA-2376 |
| ES 210 | M00073615D:E03 | PTA-2376 |
| ES 210 | M00073616A:F06 | PTA-2376 |
| ES 210 | M00073617A:H04 | PTA-2376 |
| ES 210 | M00073620A:G05 | PTA-2376 |
| ES 210 | M00073621D:A04 | PTA-2376 |
| ES 210 | M00073621D:D02 | PTA-2376 |
| ES 210 | M00073621D:H05 | PTA-2376 |
| ES 210 | M00073623D:H10 | PTA-2376 |
| ES 210 | M00073625C:D09 | PTA-2376 |
| ES 211 | M00073626D:A01 | PTA-2377 |
| ES 211 | M00073628A:E03 | PTA-2377 |
| ES 211 | M00073630A:C03 | PTA-2377 |
| ES 211 | M00073630B:E09 | PTA-2377 |
| ES 211 | M00073630C:D02 | PTA-2377 |
| ES 211 | M00073632A:B12 | PTA-2377 |
| ES 211 | M00073632C:A03 | PTA-2377 |
| ES 211 | M00073633D:A04 | PTA-2377 |
| ES 211 | M00073633D:G04 | PTA-2377 |
| ES 211 | M00073634C:H08 | PTA-2377 |
| ES 211 | M00073635D:C10 | PTA-2377 |
| ES 211 | M00073636C:F03 | PTA-2377 |
| ES 211 | M00073637C:B01 | PTA-2377 |
| ES 211 | M00073637C:E04 | PTA-2377 |
| ES 211 | M00073638A:A12 | PTA-2377 |
| ES 211 | M00073638D:D10 | PTA-2377 |
| ES 211 | M00073639A:G08 | PTA-2377 |
| ES 211 | M00073639B:F02 | PTA-2377 |
| ES 211 | M00073634B:C12 | PTA-2377 |
| ES 211 | M00073640B:G08 | PTA-2377 |
| ES 211 | M00073640C:A03 | PTA-2377 |
| ES 211 | M00073640D:A11 | PTA-2377 |
| ES 211 | M00073640D:G07 | PTA-2377 |
| ES 211 | M00073641B:G07 | PTA-2377 |
| ES 211 | M00073641C:E04 | PTA-2377 |
| ES 211 | M00073643B:E11 | PTA-2377 |
| ES 211 | M00073644A:G12 | PTA-2377 |
| ES 211 | M00073646A:C01 | PTA-2377 |
| ES 211 | M00073647B:H07 | PTA-2377 |
| ES 211 | M00073649A:A03 | PTA-2377 |
| ES 211 | M00073649A:G08 | PTA-2377 |
| ES 211 | M00073651C:F06 | PTA-2377 |
| ES 211 | M00073651C:H07 | PTA-2377 |
| ES 211 | M00073652D:B11 | PTA-2377 |
| ES 211 | M00073655B:A04 | PTA-2377 |
| ES 211 | M00073657B:D05 | PTA-2377 |
| ES 211 | M00073659C:D03 | PTA-2377 |
| ES 211 | M00073663A:E02 | PTA-2377 |
| ES 211 | M00073663D:G06 | PTA-2377 |
| ES 211 | M00073664A:E03 | PTA-2377 |
| ES 211 | M00073666B:B01 | PTA-2377 |
| ES 211 | M00073668A:H03 | PTA-2377 |
| ES 211 | M00073668B:A08 | PTA-2377 |
| ES 211 | M00073668D:D10 | PTA-2377 |
| ES 211 | M00073669A:F04 | PTA-2377 |
| ES 211 | M00073669B:E12 | PTA-2377 |
| ES 211 | M00073669D:G10 | PTA-2377 |
| ES 211 | M00073671B:D09 | PTA-2377 |
| ES 211 | M00073687A:D11 | PTA-2377 |
| ES 211 | M00073699C:E02 | PTA-2377 |
| ES 211 | M00073701D:G10 | PTA-2377 |
| ES 211 | M00073672D:B07 | PTA-2377 |
| ES 211 | M00073672D:E09 | PTA-2377 |
| ES 211 | M00073673A:D11 | PTA-2377 |
| ES 211 | M00073673D:H03 | PTA-2377 |
| ES 211 | M00073674D:F10 | PTA-2377 |
| ES 211 | M00073676A:G08 | PTA-2377 |
| ES 211 | M00073676D:H04 | PTA-2377 |
| ES 211 | M00073677B:F01 | PTA-2377 |
| ES 211 | M00073678B:E08 | PTA-2377 |
| ES 211 | M00073678B:H02 | PTA-2377 |
| ES 211 | M00073679A:D06 | PTA-2377 |
| ES 211 | M00073680D:F11 | PTA-2377 |
| ES 211 | M00073681A:F12 | PTA-2377 |
| ES 211 | M00073684B:F10 | PTA-2377 |
| ES 211 | M00073685A:F07 | PTA-2377 |
| ES 211 | M00073688C:A12 | PTA-2377 |
| ES 211 | M00073688D:C11 | PTA-2377 |
| ES 211 | M00073689C:C09 | PTA-2377 |
| ES 211 | M00073690B:G04 | PTA-2377 |
| ES 211 | M00073691A:G02 | PTA-2377 |
| ES 211 | M00073692D:H02 | PTA-2377 |
| ES 211 | M00073695C:D11 | PTA-2377 |
| ES 211 | M00073696C:D11 | PTA-2377 |
| ES 211 | M00073696D:A08 | PTA-2377 |
| ES 211 | M00073697C:F11 | PTA-2377 |
| ES 211 | M00073699B:D02 | PTA-2377 |
| ES 211 | M00073699B:D09 | PTA-2377 |
| ES 211 | M00073700A:C09 | PTA-2377 |
| ES 211 | M00073700B:D12 | PTA-2377 |
| ES 211 | M00073707B:G08 | PTA-2377 |
| ES 211 | M00073708D:E10 | PTA-2377 |
| ES 211 | M00073708D:F03 | PTA-2377 |
| ES 211 | M00073709B:F01 | PTA-2377 |
| ES 211 | M00073709C:A01 | PTA-2377 |
| ES 211 | M00073709C:A02 | PTA-2377 |
| ES 211 | M00073710B:A09 | PTA-2377 |
| ES 211 | M00073710D:G06 | PTA-2377 |
| ES 211 | M00073711C:E12 | PTA-2377 |
| ES 211 | M00073713D:E07 | PTA-2377 |
| ES 211 | M00073715A:F05 | PTA-2377 |
| ES 211 | M00073715B:B06 | PTA-2377 |
| ES 211 | M00073717C:A12 | PTA-2377 |
| ES 211 | M00073718A:F11 | PTA-2377 |
| ES 211 | M00073720D:H11 | PTA-2377 |
| ES 211 | M00073724D:F04 | PTA-2377 |
| ES 211 | M00073732C:B09 | PTA-2377 |
| ES 211 | M00073733A:A05 | PTA-2377 |
| ES 211 | M00073733A:E03 | PTA-2377 |
| ES 211 | M00073735C:E04 | PTA-2377 |
| ES 211 | M00073737A:C12 | PTA-2377 |
| ES 211 | M00073739D:B04 | PTA-2377 |
| ES 211 | M00073740B:F08 | PTA-2377 |
| ES 211 | M00073741A:B01 | PTA-2377 |
| ES 211 | M00073741C:D05 | PTA-2377 |
| ES 211 | M00073743C:F03 | PTA-2377 |
| ES 211 | M00073746A:H03 | PTA-2377 |
| ES 211 | M00073748A:F09 | PTA-2377 |
| ES 211 | M00073748B:A12 | PTA-2377 |
| ES 211 | M00073748B:F07 | PTA-2377 |
| ES 211 | M00073750A:E08 | PTA-2377 |
| ES 211 | M00073750A:H08 | PTA-2377 |
| ES 211 | M00073750B:D05 | PTA-2377 |
| ES 211 | M00073750C:G06 | PTA-2377 |
| ES 211 | M00073751D:A06 | PTA-2377 |
| ES 211 | M00073753B:B05 | PTA-2377 |
| ES 211 | M00073754B:D05 | PTA-2377 |
| ES 211 | M00073754B:H02 | PTA-2377 |
| ES 211 | M00073754C:C01 | PTA-2377 |
| ES 211 | M00073758C:G03 | PTA-2377 |

TABLE 157-continued

| ES No. | CLONE ID | ATCC# |
|---|---|---|
| ES 211 | M00073760B:B11 | PTA-2377 |
| ES 211 | M00073760D:F04 | PTA-2377 |
| ES 211 | M00073762A:B09 | PTA-2377 |
| ES 211 | M00073762D:C02 | PTA-2377 |
| ES 211 | M00073763A:D06 | PTA-2377 |
| ES 211 | M00073764B:B09 | PTA-2377 |
| ES 211 | M00073764D:A07 | PTA-2377 |
| ES 211 | M00073764D:B12 | PTA-2377 |
| ES 211 | M00073765A:E02 | PTA-2377 |
| ES 211 | M00073765C:B01 | PTA-2377 |
| ES 211 | M00073766A:B07 | PTA-2377 |
| ES 211 | M00073766B:B07 | PTA-2377 |
| ES 211 | M00073766B:C04 | PTA-2377 |
| ES 211 | M00073769D:G10 | PTA-2377 |
| ES 211 | M00073772B:E07 | PTA-2377 |
| ES 211 | M00073773A:F05 | PTA-2377 |
| ES 211 | M00073773A:G04 | PTA-2377 |
| ES 211 | M00073773B:A09 | PTA-2377 |
| ES 211 | M00073774C:G12 | PTA-2377 |
| ES 211 | M00073776C:F11 | PTA-2377 |
| ES 211 | M00073777A:A01 | PTA-2377 |
| ES 211 | M00073777A:H03 | PTA-2377 |
| ES 211 | M00073779B:B11 | PTA-2377 |
| ES 211 | M00073784A:A12 | PTA-2377 |
| ES 211 | M00073785C:A05 | PTA-2377 |
| ES 211 | M00073785D:D01 | PTA-2377 |
| ES 211 | M00073787D:H12 | PTA-2377 |
| ES 211 | M00073788C:A10 | PTA-2377 |
| ES 211 | M00073790C:E07 | PTA-2377 |
| ES 211 | M00073793C:E09 | PTA-2377 |
| ES 211 | M00073795A:F03 | PTA-2377 |
| ES 211 | M00073795B:B05 | PTA-2377 |
| ES 211 | M00073795B:B09 | PTA-2377 |
| ES 211 | M00073796A:C03 | PTA-2377 |
| ES 211 | M00073798A:H03 | PTA-2377 |
| ES 211 | M00073800D:F08 | PTA-2377 |
| ES 211 | M00073801B:A10 | PTA-2377 |
| ES 211 | M00073802D:B11 | PTA-2377 |
| ES 211 | M00073806D:C09 | PTA-2377 |
| ES 211 | M00073809C:E09 | PTA-2377 |
| ES 211 | M00073810C:F05 | PTA-2377 |
| ES 211 | M00073813D:B06 | PTA-2377 |
| ES 211 | M00073814C:B04 | PTA-2377 |
| ES 211 | M00073786D:B03 | PTA-2377 |
| ES 211 | M00073789C:B06 | PTA-2377 |
| ES 211 | M00073790A:A12 | PTA-2377 |
| ES 211 | M00073792B:A03 | PTA-2377 |
| ES 211 | M00073794B:G09 | PTA-2377 |
| ES 211 | M00073794D:G07 | PTA-2377 |
| ES 211 | M00073796A:D08 | PTA-2377 |
| ES 211 | M00073796B:A03 | PTA-2377 |
| ES 211 | M00073799A:A09 | PTA-2377 |
| ES 211 | M00073799A:G02 | PTA-2377 |
| ES 211 | M00073799D:G04 | PTA-2377 |
| ES 211 | M00073803B:B03 | PTA-2377 |
| ES 211 | M00073803B:C06 | PTA-2377 |
| ES 211 | M00073810B:G10 | PTA-2377 |
| ES 211 | M00073810C:A06 | PTA-2377 |
| ES 211 | M00073813A:E06 | PTA-2377 |
| ES 211 | M00073813B:A01 | PTA-2377 |
| ES 211 | M00073815D:E02 | PTA-2377 |
| ES 211 | M00073818A:A06 | PTA-2377 |
| ES 211 | M00073819D:C11 | PTA-2377 |
| ES 211 | M00073821A:B10 | PTA-2377 |
| ES 211 | M00073821B:H03 | PTA-2377 |
| ES 211 | M00073822C:E02 | PTA-2377 |
| ES 211 | M00073824A:C04 | PTA-2377 |
| ES 211 | M00073826B:C01 | PTA-2377 |
| ES 211 | M00073831B:H09 | PTA-2377 |
| ES 211 | M00073832A:A06 | PTA-2377 |
| ES 211 | M00073832A:G01 | PTA-2377 |
| ES 211 | M00073832B:B05 | PTA-2377 |
| ES 212 | M00073834A:H10 | PTA-2378 |
| ES 212 | M00073834D:E07 | PTA-2378 |
| ES 212 | M00073834D:H06 | PTA-2378 |
| ES 212 | M00073836D:E05 | PTA-2378 |
| ES 212 | M00073837B:D12 | PTA-2378 |
| ES 212 | M00073838A:H07 | PTA-2378 |
| ES 212 | M00073838B:F09 | PTA-2378 |
| ES 212 | M00073838B:H06 | PTA-2378 |
| ES 212 | M00073838D:E01 | PTA-2378 |
| ES 212 | M00073839A:D05 | PTA-2378 |
| ES 212 | M00073840D:C08 | PTA-2378 |
| ES 212 | M00073841A:A03 | PTA-2378 |
| ES 212 | M00073845D:F05 | PTA-2378 |
| ES 212 | M00073850A:H09 | PTA-2378 |
| ES 212 | M00073850D:G04 | PTA-2378 |
| ES 212 | M00073851A:C05 | PTA-2378 |
| ES 212 | M00073851A:E04 | PTA-2378 |
| ES 212 | M00073853C:A01 | PTA-2378 |
| ES 212 | M00073854B:B04 | PTA-2378 |
| ES 212 | M00073854C:F08 | PTA-2378 |
| ES 212 | M00073857A:B12 | PTA-2378 |
| ES 212 | M00073859A:C09 | PTA-2378 |
| ES 212 | M00073860B:F12 | PTA-2378 |
| ES 212 | M00073861D:A09 | PTA-2378 |
| ES 212 | M00073861D:D08 | PTA-2378 |
| ES 212 | M00073862B:D11 | PTA-2378 |
| ES 212 | M00073862D:F06 | PTA-2378 |
| ES 212 | M00073863B:G09 | PTA-2378 |
| ES 212 | M00073863C:D04 | PTA-2378 |
| ES 212 | M00073865B:G04 | PTA-2378 |
| ES 212 | M00073866A:G07 | PTA-2378 |
| ES 212 | M00073867B:E01 | PTA-2378 |
| ES 212 | M00073867D:F10 | PTA-2378 |
| ES 212 | M00073871B:C12 | PTA-2378 |
| ES 212 | M00073872C:B09 | PTA-2378 |
| ES 212 | M00073872D:B01 | PTA-2378 |
| ES 212 | M00073872D:E10 | PTA-2378 |
| ES 212 | M00073873C:A06 | PTA-2378 |
| ES 212 | M00073875A:B03 | PTA-2378 |
| ES 212 | M00073875C:G02 | PTA-2378 |
| ES 212 | M00073878C:A03 | PTA-2378 |
| ES 212 | M00073879D:B08 | PTA-2378 |
| ES 212 | M00073880B:B02 | PTA-2378 |
| ES 212 | M00073880B:B09 | PTA-2378 |
| ES 212 | M00073883B:D03 | PTA-2378 |
| ES 212 | M00073883B:H03 | PTA-2378 |
| ES 212 | M00073886C:C12 | PTA-2378 |
| ES 212 | M00073889B:G08 | PTA-2378 |
| ES 212 | M00073891A:A06 | PTA-2378 |
| ES 212 | M00073892A:E02 | PTA-2378 |
| ES 212 | M00073892B:F12 | PTA-2378 |
| ES 212 | M00073893D:A04 | PTA-2378 |
| ES 212 | M00073895C:F02 | PTA-2378 |
| ES 212 | M00073896A:F07 | PTA-2378 |
| ES 212 | M00073899C:E12 | PTA-2378 |
| ES 212 | M00073905B:A03 | PTA-2378 |
| ES 212 | M00073905D:C11 | PTA-2378 |
| ES 212 | M00073907B:B06 | PTA-2378 |
| ES 212 | M00073884D:B06 | PTA-2378 |
| ES 212 | M00073888C:C10 | PTA-2378 |
| ES 212 | M00073891C:A12 | PTA-2378 |
| ES 212 | M00073893B:C08 | PTA-2378 |
| ES 212 | M00073897B:B11 | PTA-2378 |
| ES 212 | M00073899A:C02 | PTA-2378 |
| ES 212 | M00073899A:D06 | PTA-2378 |
| ES 212 | M00073911B:G10 | PTA-2378 |
| ES 212 | M00073912B:C04 | PTA-2378 |
| ES 212 | M00073916A:B07 | PTA-2378 |
| ES 212 | M00073917B:B07 | PTA-2378 |
| ES 212 | M00073918C:B03 | PTA-2378 |
| ES 212 | M00073921B:H12 | PTA-2378 |
| ES 212 | M00073922C:E02 | PTA-2378 |
| ES 212 | M00073923C:A04 | PTA-2378 |
| ES 212 | M00073924B:H03 | PTA-2378 |
| ES 212 | M00073927D:E09 | PTA-2378 |
| ES 212 | M00073931D:E02 | PTA-2378 |
| ES 212 | M00073932D:G05 | PTA-2378 |
| ES 212 | M00073936D:E05 | PTA-2378 |
| ES 212 | M00073938B:D11 | PTA-2378 |
| ES 212 | M00073908C:D09 | PTA-2378 |
| ES 212 | M00073916C:H11 | PTA-2378 |
| ES 212 | M00073918A:F07 | PTA-2378 |
| ES 212 | M00073918A:G12 | PTA-2378 |
| ES 212 | M00073919C:B04 | PTA-2378 |

TABLE 157-continued

| ES No. | CLONE ID | ATCC# |
|---|---|---|
| ES 212 | M00073920D:F08 | PTA-2378 |
| ES 212 | M00073922D:G04 | PTA-2378 |
| ES 212 | M00073924C:G05 | PTA-2378 |
| ES 212 | M00073927C:B07 | PTA-2378 |
| ES 212 | M00073933B:B12 | PTA-2378 |
| ES 212 | M00073938B:F09 | PTA-2378 |
| ES 212 | M00073941B:A06 | PTA-2378 |
| ES 212 | M00073941D:H09 | PTA-2378 |
| ES 212 | M00073942B:C01 | PTA-2378 |
| ES 212 | M00073942C:E04 | PTA-2378 |
| ES 212 | M00073942D:D09 | PTA-2378 |
| ES 212 | M00073942D:G05 | PTA-2378 |
| ES 212 | M00073944A:E10 | PTA-2378 |
| ES 212 | M00073944A:H05 | PTA-2378 |
| ES 212 | M00073944C:H07 | PTA-2378 |
| ES 212 | M00073944D:A07 | PTA-2378 |
| ES 212 | M00073944D:E12 | PTA-2378 |
| ES 212 | M00073946D:F07 | PTA-2378 |
| ES 212 | M00073947C:B01 | PTA-2378 |
| ES 212 | M00073947C:E09 | PTA-2378 |
| ES 212 | M00073948A:G05 | PTA-2378 |
| ES 212 | M00073949A:C09 | PTA-2378 |
| ES 212 | M00073949D:C11 | PTA-2378 |
| ES 212 | M00073950C:A05 | PTA-2378 |
| ES 212 | M00073950D:H12 | PTA-2378 |
| ES 212 | M00073952A:G04 | PTA-2378 |
| ES 212 | M00073956D:F02 | PTA-2378 |
| ES 212 | M00073960A:B12 | PTA-2378 |
| ES 212 | M00073960B:A09 | PTA-2378 |
| ES 212 | M00073961B:G01 | PTA-2378 |
| ES 212 | M00073962D:E04 | PTA-2378 |
| ES 212 | M00073963A:G08 | PTA-2378 |
| ES 212 | M00073963B:F04 | PTA-2378 |
| ES 212 | M00073964B:H07 | PTA-2378 |
| ES 212 | M00073967A:A10 | PTA-2378 |
| ES 212 | M00073967C:A01 | PTA-2378 |
| ES 212 | M00073968B:B06 | PTA-2378 |
| ES 212 | M00073968D:F11 | PTA-2378 |
| ES 212 | M00073970B:G01 | PTA-2378 |
| ES 212 | M00073977D:B10 | PTA-2378 |
| ES 212 | M00073978D:A02 | PTA-2378 |
| ES 212 | M00073979C:G07 | PTA-2378 |
| ES 212 | M00073981C:F08 | PTA-2378 |
| ES 212 | M00073983B:D03 | PTA-2378 |
| ES 212 | M00073983C:C07 | PTA-2378 |
| ES 212 | M00073984B:D04 | PTA-2378 |
| ES 212 | M00073984B:E01 | PTA-2378 |
| ES 212 | M00073985C:A05 | PTA-2378 |
| ES 212 | M00073987B:A09 | PTA-2378 |
| ES 212 | M00073988B:C08 | PTA-2378 |
| ES 212 | M00073988D:F09 | PTA-2378 |
| ES 212 | M00073993A:A05 | PTA-2378 |
| ES 212 | M00073965D:A12 | PTA-2378 |
| ES 212 | M00073966C:F08 | PTA-2378 |
| ES 212 | M00073968C:C09 | PTA-2378 |
| ES 212 | M00073968C:F02 | PTA-2378 |
| ES 212 | M00073975A:A12 | PTA-2378 |
| ES 212 | M00073979B:B05 | PTA-2378 |
| ES 212 | M00073979C:B01 | PTA-2378 |
| ES 212 | M00073982B:H01 | PTA-2378 |
| ES 212 | M00073986C:D07 | PTA-2378 |
| ES 212 | M00073988C:G08 | PTA-2378 |
| ES 212 | M00074000C:D06 | PTA-2378 |
| ES 212 | M00074003C:H06 | PTA-2378 |
| ES 212 | M00074004A:H01 | PTA-2378 |
| ES 212 | M00074004C:F03 | PTA-2378 |
| ES 212 | M00074006C:B12 | PTA-2378 |
| ES 212 | M00074007B:A02 | PTA-2378 |
| ES 212 | M00074010B:D07 | PTA-2378 |
| ES 212 | M00074011A:F08 | PTA-2378 |
| ES 212 | M00074011D:C05 | PTA-2378 |
| ES 212 | M00074013B:F07 | PTA-2378 |
| ES 212 | M00074013C:C09 | PTA-2378 |
| ES 212 | M00074014A:G03 | PTA-2378 |
| ES 212 | M00074014D:F04 | PTA-2378 |
| ES 212 | M00074015A:C03 | PTA-2378 |
| ES 212 | M00074017B:G10 | PTA-2378 |
| ES 212 | M00074017D:C01 | PTA-2378 |
| ES 212 | M00074019D:H05 | PTA-2378 |
| ES 212 | M00074020B:G11 | PTA-2378 |
| ES 212 | M00074020C:A05 | PTA-2378 |
| ES 212 | M00074020D:G10 | PTA-2378 |
| ES 212 | M00074021C:H07 | PTA-2378 |
| ES 212 | M00074022A:C06 | PTA-2378 |
| ES 212 | M00074024B:G07 | PTA-2378 |
| ES 212 | M00074025A:F06 | PTA-2378 |
| ES 212 | M00074025B:A12 | PTA-2378 |
| ES 212 | M00074026C:H09 | PTA-2378 |
| ES 212 | M00074027D:B03 | PTA-2378 |
| ES 212 | M00074030D:A12 | PTA-2378 |
| ES 212 | M00074032B:H08 | PTA-2378 |
| ES 212 | M00074032C:E02 | PTA-2378 |
| ES 212 | M00074032C:H07 | PTA-2378 |
| ES 212 | M00074036B:C08 | PTA-2378 |
| ES 212 | M00074036D:B05 | PTA-2378 |
| ES 212 | M00074037A:B03 | PTA-2378 |
| ES 212 | M00074038A:G08 | PTA-2378 |
| ES 212 | M00074038C:B08 | PTA-2378 |
| ES 212 | M00074040A:B06 | PTA-2378 |
| ES 212 | M00074043C:A05 | PTA-2378 |
| ES 212 | M00074050B:H07 | PTA-2378 |
| ES 212 | M00074051C:F05 | PTA-2378 |
| ES 212 | M00074052C:E03 | PTA-2378 |
| ES 212 | M00074053C:E05 | PTA-2378 |
| ES 212 | M00074053C:G11 | PTA-2378 |
| ES 212 | M00074053D:D05 | PTA-2378 |
| ES 212 | M00074054C:B04 | PTA-2378 |
| ES 212 | M00074055A:G08 | PTA-2378 |
| ES 213 | M00072942B:E02 | PTA-2379 |
| ES 213 | M00072942D:F07 | PTA-2379 |
| ES 213 | M00072943B:E04 | PTA-2379 |
| ES 213 | M00072944A:C07 | PTA-2379 |
| ES 213 | M00072944A:E06 | PTA-2379 |
| ES 213 | M00072944C:C02 | PTA-2379 |
| ES 213 | M00072944D:C08 | PTA-2379 |
| ES 213 | M00072947B:G04 | PTA-2379 |
| ES 213 | M00072947D:G05 | PTA-2379 |
| ES 213 | M00072950A:A06 | PTA-2379 |
| ES 213 | M00072961A:G04 | PTA-2379 |
| ES 213 | M00072961B:G10 | PTA-2379 |
| ES 213 | M00072961C:B06 | PTA-2379 |
| ES 213 | M00072962A:B05 | PTA-2379 |
| ES 213 | M00072963B:G11 | PTA-2379 |
| ES 213 | M00072967A:G07 | PTA-2379 |
| ES 213 | M00072967B:G06 | PTA-2379 |
| ES 213 | M00072968A:F08 | PTA-2379 |
| ES 213 | M00072968D:A06 | PTA-2379 |
| ES 213 | M00072968D:E05 | PTA-2379 |
| ES 213 | M00072970C:B07 | PTA-2379 |
| ES 213 | M00074057A:B12 | PTA-2379 |
| ES 213 | M00074058A:H02 | PTA-2379 |
| ES 213 | M00074058B:A10 | PTA-2379 |
| ES 213 | M00074059B:G10 | PTA-2379 |
| ES 213 | M00074060D:A10 | PTA-2379 |
| ES 213 | M00074061B:E01 | PTA-2379 |
| ES 213 | M00074063A:B03 | PTA-2379 |
| ES 213 | M00074063A:D09 | PTA-2379 |
| ES 213 | M00074063B:B12 | PTA-2379 |
| ES 213 | M00074069D:C11 | PTA-2379 |
| ES 213 | M00074070D:G05 | PTA-2379 |
| ES 213 | M00074075B:A09 | PTA-2379 |
| ES 213 | M00074075C:H04 | PTA-2379 |
| ES 213 | M00074076B:F04 | PTA-2379 |
| ES 213 | M00074079A:E07 | PTA-2379 |
| ES 213 | M00074084C:E01 | PTA-2379 |
| ES 213 | M00074084D:B04 | PTA-2379 |
| ES 213 | M00074085A:H10 | PTA-2379 |
| ES 213 | M00074085B:E06 | PTA-2379 |
| ES 213 | M00074085D:E08 | PTA-2379 |
| ES 213 | M00074087B:C09 | PTA-2379 |
| ES 213 | M00074087C:G05 | PTA-2379 |
| ES 213 | M00074088B:A03 | PTA-2379 |
| ES 213 | M00074088C:E07 | PTA-2379 |
| ES 213 | M00074089A:B09 | PTA-2379 |
| ES 213 | M00074089D:E03 | PTA-2379 |
| ES 213 | M00074090A:E09 | PTA-2379 |

TABLE 157-continued

| ES No. | CLONE ID | ATCC# |
|---|---|---|
| ES 213 | M00074093A:A06 | PTA-2379 |
| ES 213 | M00074093B:A03 | PTA-2379 |
| ES 213 | M00074093B:C07 | PTA-2379 |
| ES 213 | M00074094B:F10 | PTA-2379 |
| ES 213 | M00074096D:G12 | PTA-2379 |
| ES 213 | M00074097A:F10 | PTA-2379 |
| ES 213 | M00074097C:B09 | PTA-2379 |
| ES 213 | M00074098C:B09 | PTA-2379 |
| ES 213 | M00074099C:B09 | PTA-2379 |
| ES 213 | M00074100B:E01 | PTA-2379 |
| ES 213 | M00074101D:D07 | PTA-2379 |
| ES 213 | M00074102A:C04 | PTA-2379 |
| ES 213 | M00074105A:D02 | PTA-2379 |
| ES 213 | M00074106C:E03 | PTA-2379 |
| ES 213 | M00074107C:C08 | PTA-2379 |
| ES 213 | M00074111C:B02 | PTA-2379 |
| ES 213 | M00074111C:G11 | PTA-2379 |
| ES 213 | M00074116C:A03 | PTA-2379 |
| ES 213 | M00074120A:A12 | PTA-2379 |
| ES 213 | M00074123B:A03 | PTA-2379 |
| ES 213 | M00074123B:G07 | PTA-2379 |
| ES 213 | M00074130B:F06 | PTA-2379 |
| ES 213 | M00074131A:H09 | PTA-2379 |
| ES 213 | M00074132C:F10 | PTA-2379 |
| ES 213 | M00074135A:G09 | PTA-2379 |
| ES 213 | M00074135C:E09 | PTA-2379 |
| ES 213 | M00074137C:E05 | PTA-2379 |
| ES 213 | M00074138D:A01 | PTA-2379 |
| ES 213 | M00074138D:A08 | PTA-2379 |
| ES 213 | M00074138D:B07 | PTA-2379 |
| ES 213 | M00074142B:C11 | PTA-2379 |
| ES 213 | M00074142D:A10 | PTA-2379 |
| ES 213 | M00074148B:D09 | PTA-2379 |
| ES 213 | M00074108B:C04 | PTA-2379 |
| ES 213 | M00074122A:B02 | PTA-2379 |
| ES 213 | M00074126B:E12 | PTA-2379 |
| ES 213 | M00074128D:C09 | PTA-2379 |
| ES 213 | M00074132A:E11 | PTA-2379 |
| ES 213 | M00074132B:B07 | PTA-2379 |
| ES 213 | M00074134A:G11 | PTA-2379 |
| ES 213 | M00074149A:B10 | PTA-2379 |
| ES 213 | M00074149A:F12 | PTA-2379 |
| ES 213 | M00074153A:E07 | PTA-2379 |
| ES 213 | M00074153D:A05 | PTA-2379 |
| ES 213 | M00074154A:D03 | PTA-2379 |
| ES 213 | M00074155B:G09 | PTA-2379 |
| ES 213 | M00074157C:G08 | PTA-2379 |
| ES 213 | M00074157D:G05 | PTA-2379 |
| ES 213 | M00074158C:F12 | PTA-2379 |
| ES 213 | M00074158C:H10 | PTA-2379 |
| ES 213 | M00074159C:A05 | PTA-2379 |
| ES 213 | M00074160A:D12 | PTA-2379 |
| ES 213 | M00074161C:F04 | PTA-2379 |
| ES 213 | M00074162A:B03 | PTA-2379 |
| ES 213 | M00074165D:A11 | PTA-2379 |
| ES 213 | M00074170A:D09 | PTA-2379 |
| ES 213 | M00074170D:F05 | PTA-2379 |
| ES 213 | M00074172B:D12 | PTA-2379 |
| ES 213 | M00074174A:C02 | PTA-2379 |
| ES 213 | M00074174C:C03 | PTA-2379 |
| ES 213 | M00074175D:E04 | PTA-2379 |
| ES 213 | M00074176A:A06 | PTA-2379 |
| ES 213 | M00074176A:B10 | PTA-2379 |
| ES 213 | M00074177B:H08 | PTA-2379 |
| ES 213 | M00074178B:G07 | PTA-2379 |
| ES 213 | M00074179A:A01 | PTA-2379 |
| ES 213 | M00074179C:B01 | PTA-2379 |
| ES 213 | M00074184D:A04 | PTA-2379 |
| ES 213 | M00074184D:B01 | PTA-2379 |
| ES 213 | M00074190B:F09 | PTA-2379 |
| ES 213 | M00074191C:D08 | PTA-2379 |
| ES 213 | M00074192C:C10 | PTA-2379 |
| ES 213 | M00074195D:B09 | PTA-2379 |
| ES 213 | M00074197C:A12 | PTA-2379 |
| ES 213 | M00074198C:A12 | PTA-2379 |
| ES 213 | M00074198D:D10 | PTA-2379 |
| ES 213 | M00074199A:C10 | PTA-2379 |
| ES 213 | M00074201A:F03 | PTA-2379 |
| ES 213 | M00074201C:E12 | PTA-2379 |
| ES 213 | M00074202A:A05 | PTA-2379 |
| ES 213 | M00074202B:D03 | PTA-2379 |
| ES 213 | M00074203D:F01 | PTA-2379 |
| ES 213 | M00074206A:G02 | PTA-2379 |
| ES 213 | M00074206A:H12 | PTA-2379 |
| ES 213 | M00074206B:F04 | PTA-2379 |
| ES 213 | M00074207D:E07 | PTA-2379 |
| ES 213 | M00074208B:B05 | PTA-2379 |
| ES 213 | M00074208B:F09 | PTA-2379 |
| ES 213 | M00074208D:E08 | PTA-2379 |
| ES 213 | M00074209D:H11 | PTA-2379 |
| ES 213 | M00074210B:G12 | PTA-2379 |
| ES 213 | M00074213A:C06 | PTA-2379 |
| ES 213 | M00074215A:F09 | PTA-2379 |
| ES 213 | M00074216C:C11 | PTA-2379 |
| ES 213 | M00074216D:H03 | PTA-2379 |
| ES 213 | M00074217A:H01 | PTA-2379 |
| ES 213 | M00074217C:B04 | PTA-2379 |
| ES 213 | M00074217C:C09 | PTA-2379 |
| ES 213 | M00074219D:F03 | PTA-2379 |
| ES 213 | M00074221B:F12 | PTA-2379 |
| ES 213 | M00074223B:D12 | PTA-2379 |
| ES 213 | M00074224A:G06 | PTA-2379 |
| ES 213 | M00074225A:H12 | PTA-2379 |
| ES 213 | M00074226C:E06 | PTA-2379 |
| ES 213 | M00074230D:B05 | PTA-2379 |
| ES 213 | M00074231A:D10 | PTA-2379 |
| ES 213 | M00074231D:G11 | PTA-2379 |
| ES 213 | M00074232B:G06 | PTA-2379 |
| ES 213 | M00074234A:C05 | PTA-2379 |
| ES 213 | M00074234A:E07 | PTA-2379 |
| ES 213 | M00074234B:F07 | PTA-2379 |
| ES 213 | M00074234D:F12 | PTA-2379 |
| ES 213 | M00074235C:D06 | PTA-2379 |
| ES 213 | M00074236B:E06 | PTA-2379 |
| ES 213 | M00074236C:E11 | PTA-2379 |
| ES 213 | M00074242D:F09 | PTA-2379 |
| ES 213 | M00074243A:H08 | PTA-2379 |
| ES 213 | M00074243C:B06 | PTA-2379 |
| ES 213 | M00074244C:B11 | PTA-2379 |
| ES 213 | M00074247B:G11 | PTA-2379 |
| ES 213 | M00074247C:E02 | PTA-2379 |
| ES 213 | M00074248C:E12 | PTA-2379 |
| ES 213 | M00074249C:B11 | PTA-2379 |
| ES 213 | M00074249C:H08 | PTA-2379 |
| ES 213 | M00074250D:E06 | PTA-2379 |
| ES 213 | M00074250D:F06 | PTA-2379 |
| ES 213 | M00074251B:F08 | PTA-2379 |
| ES 213 | M00074251C:B06 | PTA-2379 |
| ES 213 | M00074251C:E03 | PTA-2379 |
| ES 213 | M00074251D:E03 | PTA-2379 |
| ES 213 | M00074252C:E02 | PTA-2379 |
| ES 213 | M00074253C:F03 | PTA-2379 |
| ES 213 | M00074255B:A01 | PTA-2379 |
| ES 213 | M00074258A:H12 | PTA-2379 |
| ES 213 | M00074258A:H09 | PTA-2379 |
| ES 213 | M00074259C:G08 | PTA-2379 |
| ES 213 | M00074260B:A11 | PTA-2379 |
| ES 213 | M00074265B:C07 | PTA-2379 |
| ES 213 | M00074266A:D01 | PTA-2379 |
| ES 213 | M00074267A:B04 | PTA-2379 |
| ES 213 | M00074268A:D08 | PTA-2379 |
| ES 213 | M00074268C:G03 | PTA-2379 |
| ES 213 | M00074270A:A01 | PTA-2379 |
| ES 213 | M00074271B:E11 | PTA-2379 |
| ES 214 | M00072971A:E04 | PTA-2380 |
| ES 214 | M00072971A:F11 | PTA-2380 |
| ES 214 | M00072971C:B07 | PTA-2380 |
| ES 214 | M00072972A:C03 | PTA-2380 |
| ES 214 | M00072974A:A11 | PTA-2380 |
| ES 214 | M00072974D:B04 | PTA-2380 |
| ES 214 | M00072975A:D11 | PTA-2380 |
| ES 214 | M00072975A:E02 | PTA-2380 |
| ES 214 | M00072977A:F06 | PTA-2380 |
| ES 214 | M00072977B:C05 | PTA-2380 |
| ES 214 | M00072980B:C05 | PTA-2380 |
| ES 214 | M00072980B:G01 | PTA-2380 |

TABLE 157-continued

| ES No. | CLONE ID | ATCC# |
|---|---|---|
| ES 214 | M00073001A:F07 | PTA-2380 |
| ES 214 | M00073001B:E07 | PTA-2380 |
| ES 214 | M00073002B:B12 | PTA-2380 |
| ES 214 | M00073002D:B08 | PTA-2380 |
| ES 214 | M00073003A:E06 | PTA-2380 |
| ES 214 | M00073003B:E10 | PTA-2380 |
| ES 214 | M00073003B:H01 | PTA-2380 |
| ES 214 | M00073003C:C05 | PTA-2380 |
| ES 214 | M00073006A:H08 | PTA-2380 |
| ES 214 | M00073006C:D07 | PTA-2380 |
| ES 214 | M00073007D:E05 | PTA-2380 |
| ES 214 | M00073009B:C08 | PTA-2380 |
| ES 214 | M00073009D:A02 | PTA-2380 |
| ES 214 | M00073012A:C11 | PTA-2380 |
| ES 214 | M00073013A:D10 | PTA-2380 |
| ES 214 | M00073013A:F10 | PTA-2380 |
| ES 214 | M00073013C:B10 | PTA-2380 |
| ES 214 | M00073013C:G05 | PTA-2380 |
| ES 214 | M00073014D:F01 | PTA-2380 |
| ES 214 | M00073015A:E12 | PTA-2380 |
| ES 214 | M00073015A:H06 | PTA-2380 |
| ES 214 | M00073015B:A05 | PTA-2380 |
| ES 214 | M00073015C:E10 | PTA-2380 |
| ES 214 | M00073017A:D06 | PTA-2380 |
| ES 214 | M00073017A:F03 | PTA-2380 |
| ES 214 | M00073019A:H12 | PTA-2380 |
| ES 214 | M00073019B:B12 | PTA-2380 |
| ES 214 | M00073020C:F07 | PTA-2380 |
| ES 214 | M00073020D:C06 | PTA-2380 |
| ES 214 | M00073021C:E04 | PTA-2380 |
| ES 214 | M00073021D:C03 | PTA-2380 |
| ES 214 | M00073023A:D10 | PTA-2380 |
| ES 214 | M00073025A:E11 | PTA-2380 |
| ES 214 | M00073026B:F01 | PTA-2380 |
| ES 214 | M00073026D:G04 | PTA-2380 |
| ES 214 | M00073027B:H12 | PTA-2380 |
| ES 214 | M00073030A:G05 | PTA-2380 |
| ES 214 | M00073030B:C02 | PTA-2380 |
| ES 214 | M00073030C:A02 | PTA-2380 |
| ES 214 | M00073036C:H10 | PTA-2380 |
| ES 214 | M00073037A:C06 | PTA-2380 |
| ES 214 | M00073037D:H02 | PTA-2380 |
| ES 214 | M00073038C:C07 | PTA-2380 |
| ES 214 | M00073038D:D12 | PTA-2380 |
| ES 214 | M00073038D:F10 | PTA-2380 |
| ES 214 | M00073039A:D09 | PTA-2380 |
| ES 214 | M00073039C:B10 | PTA-2380 |
| ES 214 | M00073040A:B02 | PTA-2380 |
| ES 214 | M00073040D:F05 | PTA-2380 |
| ES 214 | M00073043B:C10 | PTA-2380 |
| ES 214 | M00073043B:E08 | PTA-2380 |
| ES 214 | M00073043C:F04 | PTA-2380 |
| ES 214 | M00073043D:H09 | PTA-2380 |
| ES 214 | M00073044B:F08 | PTA-2380 |
| ES 214 | M00073044C:C12 | PTA-2380 |
| ES 214 | M00073044C:D08 | PTA-2380 |
| ES 214 | M00073044C:G12 | PTA-2380 |
| ES 214 | M00073044D:F08 | PTA-2380 |
| ES 214 | M00073045B:A03 | PTA-2380 |
| ES 214 | M00073045B:D06 | PTA-2380 |
| ES 214 | M00073045C:E06 | PTA-2380 |
| ES 214 | M00073045C:E07 | PTA-2380 |
| ES 214 | M00073045D:B04 | PTA-2380 |
| ES 214 | M00073046A:A05 | PTA-2380 |
| ES 214 | M00073046A:A06 | PTA-2380 |
| ES 214 | M00073046B:A12 | PTA-2380 |
| ES 214 | M00073046D:F04 | PTA-2380 |
| ES 214 | M00073047B:E10 | PTA-2380 |
| ES 214 | M00073047C:G01 | PTA-2380 |
| ES 214 | M00073048A:H05 | PTA-2380 |
| ES 214 | M00073048C:A11 | PTA-2380 |
| ES 214 | M00073048C:B01 | PTA-2380 |
| ES 214 | M00073048C:E11 | PTA-2380 |
| ES 214 | M00073049A:H04 | PTA-2380 |
| ES 214 | M00073049B:B03 | PTA-2380 |
| ES 214 | M00073049B:B06 | PTA-2380 |
| ES 214 | M00073049C:C09 | PTA-2380 |
| ES 214 | M00073049C:H07 | PTA-2380 |
| ES 214 | M00073050A:D09 | PTA-2380 |
| ES 214 | M00073051A:D07 | PTA-2380 |
| ES 214 | M00073051A:F12 | PTA-2380 |
| ES 214 | M00073051A:F07 | PTA-2380 |
| ES 214 | M00073052B:H12 | PTA-2380 |
| ES 214 | M00074273B:B03 | PTA-2380 |
| ES 214 | M00074275A:B04 | PTA-2380 |
| ES 214 | M00074276A:A12 | PTA-2380 |
| ES 214 | M00074276A:E02 | PTA-2380 |
| ES 214 | M00074278B:D07 | PTA-2380 |
| ES 214 | M00074278D:E07 | PTA-2380 |
| ES 214 | M00074279C:C11 | PTA-2380 |
| ES 214 | M00074280D:H03 | PTA-2380 |
| ES 214 | M00074284B:B03 | PTA-2380 |
| ES 214 | M00074284C:B06 | PTA-2380 |
| ES 214 | M00074284C:E12 | PTA-2380 |
| ES 214 | M00074288A:F11 | PTA-2380 |
| ES 214 | M00074290A:G10 | PTA-2380 |
| ES 214 | M00074290C:B05 | PTA-2380 |
| ES 214 | M00074292D:B04 | PTA-2380 |
| ES 214 | M00074293D:B05 | PTA-2380 |
| ES 214 | M00074293D:H07 | PTA-2380 |
| ES 214 | M00074296C:G09 | PTA-2380 |
| ES 214 | M00074299B:F01 | PTA-2380 |
| ES 214 | M00074302D:G10 | PTA-2380 |
| ES 214 | M00074304B:C09 | PTA-2380 |
| ES 214 | M00074304D:D07 | PTA-2380 |
| ES 214 | M00074306A:B09 | PTA-2380 |
| ES 214 | M00074306B:H01 | PTA-2380 |
| ES 214 | M00074310D:D02 | PTA-2380 |
| ES 214 | M00074314A:C06 | PTA-2380 |
| ES 214 | M00074315B:A03 | PTA-2380 |
| ES 214 | M00074317C:C01 | PTA-2380 |
| ES 214 | M00074319C:H03 | PTA-2380 |
| ES 214 | M00074320C:B07 | PTA-2380 |
| ES 214 | M00074832B:E05 | PTA-2380 |
| ES 214 | M00074835A:H10 | PTA-2380 |
| ES 214 | M00074835B:F12 | PTA-2380 |
| ES 214 | M00074837A:B06 | PTA-2380 |
| ES 214 | M00074837A:E01 | PTA-2380 |
| ES 214 | M00074838B:E11 | PTA-2380 |
| ES 214 | M00074838D:B06 | PTA-2380 |
| ES 214 | M00074843A:C06 | PTA-2380 |
| ES 214 | M00074843A:F11 | PTA-2380 |
| ES 214 | M00074843D:D02 | PTA-2380 |
| ES 214 | M00074844B:B02 | PTA-2380 |
| ES 214 | M00074844D:F09 | PTA-2380 |
| ES 214 | M00074845A:D12 | PTA-2380 |
| ES 214 | M00074845B:F07 | PTA-2380 |
| ES 214 | M00074845D:D07 | PTA-2380 |
| ES 214 | M00074847B:G03 | PTA-2380 |
| ES 214 | M00074847D:E07 | PTA-2380 |
| ES 214 | M00074849C:A04 | PTA-2380 |
| ES 214 | M00074852A:B01 | PTA-2380 |
| ES 214 | M00074852B:A02 | PTA-2380 |
| ES 214 | M00074852D:D08 | PTA-2380 |
| ES 214 | M00074853A:D05 | PTA-2380 |
| ES 214 | M00074854A:C11 | PTA-2380 |
| ES 214 | M00074855B:A05 | PTA-2380 |
| ES 214 | M00074857D:B02 | PTA-2380 |
| ES 214 | M00074858B:E05 | PTA-2380 |
| ES 214 | M00074861D:D01 | PTA-2380 |
| ES 214 | M00074863D:F07 | PTA-2380 |
| ES 214 | M00074864C:B09 | PTA-2380 |
| ES 214 | M00074317B:B08 | PTA-2380 |
| ES 214 | M00074320C:A06 | PTA-2380 |
| ES 214 | M00074865A:F05 | PTA-2380 |
| ES 214 | M00074869C:D04 | PTA-2380 |
| ES 214 | M00074871C:G05 | PTA-2380 |
| ES 214 | M00074874A:G07 | PTA-2380 |
| ES 214 | M00074875B:E08 | PTA-2380 |
| ES 214 | M00074879A:A02 | PTA-2380 |
| ES 214 | M00074879C:D02 | PTA-2380 |
| ES 214 | M00074884C:F10 | PTA-2380 |
| ES 214 | M00074887A:F03 | PTA-2380 |
| ES 214 | M00074890A:E03 | PTA-2380 |
| ES 214 | M00074895D:H12 | PTA-2380 |
| ES 214 | M00074898B:B01 | PTA-2380 |

TABLE 157-continued

| ES No. | CLONE ID | ATCC# |
|---|---|---|
| ES 214 | M00074900C:E10 | PTA-2380 |
| ES 214 | M00074901C:E05 | PTA-2380 |
| ES 214 | M00074903D:C04 | PTA-2380 |
| ES 214 | M00074904A:E11 | PTA-2380 |
| ES 214 | M00074904B:B07 | PTA-2380 |
| ES 214 | M00074905D:A01 | PTA-2380 |
| ES 214 | M00074906B:H12 | PTA-2380 |
| ES 214 | M00074906D:G02 | PTA-2380 |
| ES 214 | M00074912B:A10 | PTA-2380 |
| ES 214 | M00074912D:H08 | PTA-2380 |
| ES 214 | M00074916A:H03 | PTA-2380 |
| ES 214 | M00074919C:A08 | PTA-2380 |
| ES 214 | M00074921C:E05 | PTA-2380 |
| ES 214 | M00074922A:D06 | PTA-2380 |
| ES 214 | M00074927A:D02 | PTA-2380 |
| ES 214 | M00074927B:G08 | PTA-2380 |
| ES 214 | M00074927D:G09 | PTA-2380 |
| ES 214 | M00074929D:D04 | PTA-2380 |
| ES 214 | M00074930C:D11 | PTA-2380 |
| ES 214 | M00074933A:D04 | PTA-2380 |
| ES 214 | M00074935A:C01 | PTA-2380 |
| ES 214 | M00074936B:E10 | PTA-2380 |
| ES 214 | M00074939B:A06 | PTA-2380 |
| ES 214 | M00074940C:H08 | PTA-2380 |
| ES 215 | M00074950A:D01 | PTA-2381 |
| ES 215 | M00074958D:H10 | PTA-2381 |
| ES 215 | M00074966D:E08 | PTA-2381 |
| ES 215 | M00074967B:A11 | PTA-2381 |
| ES 215 | M00074968D:A02 | PTA-2381 |
| ES 215 | M00074974C:E11 | PTA-2381 |
| ES 215 | M00074980D:E07 | PTA-2381 |
| ES 215 | M00074954A:H06 | PTA-2381 |
| ES 215 | M00074954B:E03 | PTA-2381 |
| ES 215 | M00074957D:F11 | PTA-2381 |
| ES 215 | M00074962B:F08 | PTA-2381 |
| ES 215 | M00074968A:D09 | PTA-2381 |
| ES 215 | M00074973A:H03 | PTA-2381 |
| ES 215 | M00072987B:A03 | PTA-2381 |
| ES 215 | M00072997B:H03 | PTA-2381 |
| ES 215 | M00072951C:C11 | PTA-2381 |
| ES 215 | M00072953B:G03 | PTA-2381 |
| ES 215 | M00072982D:B03 | PTA-2381 |
| ES 215 | M00072985A:C12 | PTA-2381 |
| ES 215 | M00072985B:D03 | PTA-2381 |
| ES 215 | M00072986A:C03 | PTA-2381 |
| ES 215 | M00072993B:D06 | PTA-2381 |
| ES 215 | M00072995C:D07 | PTA-2381 |
| ES 215 | M00072995D:C09 | PTA-2381 |
| ES 215 | M00072996B:A10 | PTA-2381 |
| ES 215 | M00072996C:C04 | PTA-2381 |
| ES 215 | M00072997D:F08 | PTA-2381 |
| ES 215 | M00072997D:H06 | PTA-2381 |
| ES 215 | M00074323D:F09 | PTA-2381 |
| ES 215 | M00074333D:A11 | PTA-2381 |
| ES 215 | M00074335A:H08 | PTA-2381 |
| ES 215 | M00074337A:G08 | PTA-2381 |
| ES 215 | M00074340B:D06 | PTA-2381 |
| ES 215 | M00074343C:A03 | PTA-2381 |
| ES 215 | M00074346A:H09 | PTA-2381 |
| ES 215 | M00074347B:F11 | PTA-2381 |
| ES 215 | M00074349A:E08 | PTA-2381 |
| ES 215 | M00074355D:H06 | PTA-2381 |
| ES 215 | M00074361C:B01 | PTA-2381 |
| ES 215 | M00074365A:E09 | PTA-2381 |
| ES 215 | M00074366A:D07 | PTA-2381 |
| ES 215 | M00074366A:H07 | PTA-2381 |
| ES 215 | M00074370D:G09 | PTA-2381 |
| ES 215 | M00074375D:E05 | PTA-2381 |
| ES 215 | M00074382D:F04 | PTA-2381 |
| ES 215 | M00074384D:G07 | PTA-2381 |
| ES 215 | M00074388B:E07 | PTA-2381 |
| ES 215 | M00074392C:D02 | PTA-2381 |
| ES 215 | M00074405B:A04 | PTA-2381 |
| ES 215 | M00074417D:F07 | PTA-2381 |
| ES 215 | M00074392D:D01 | PTA-2381 |
| ES 215 | M00074406B:F10 | PTA-2381 |
| ES 215 | M00074430D:G09 | PTA-2381 |
| ES 215 | M00074395A:B11 | PTA-2381 |
| ES 215 | M00074404B:H01 | PTA-2381 |
| ES 215 | M00074391B:D02 | PTA-2381 |
| ES 215 | M00074390C:E04 | PTA-2381 |
| ES 215 | M00074411B:G07 | PTA-2381 |
| ES 215 | M00074415B:A01 | PTA-2381 |
| ES 215 | M00074453B:H03 | PTA-2381 |
| ES 215 | M00074453C:E09 | PTA-2381 |
| ES 215 | M00074454A:D08 | PTA-2381 |
| ES 215 | M00074461D:E04 | PTA-2381 |
| ES 215 | M00074463B:C03 | PTA-2381 |
| ES 215 | M00074468B:C03 | PTA-2381 |
| ES 215 | M00074473D:H09 | PTA-2381 |
| ES 215 | M00074474B:F02 | PTA-2381 |
| ES 215 | M00074488C:C10 | PTA-2381 |
| ES 215 | M00074488C:C08 | PTA-2381 |
| ES 215 | M00074492A:F11 | PTA-2381 |
| ES 215 | M00074501A:G07 | PTA-2381 |
| ES 215 | M00074502C:B08 | PTA-2381 |
| ES 215 | M00074515A:E02 | PTA-2381 |
| ES 215 | M00074515C:A11 | PTA-2381 |
| ES 215 | M00074516B:H03 | PTA-2381 |
| ES 215 | M00074525A:B05 | PTA-2381 |
| ES 215 | M00074533A:D07 | PTA-2381 |
| ES 215 | M00074539D:A10 | PTA-2381 |
| ES 215 | M00074540B:H07 | PTA-2381 |
| ES 215 | M00074541D:E07 | PTA-2381 |
| ES 215 | M00074549B:A06 | PTA-2381 |
| ES 215 | M00074557A:G08 | PTA-2381 |
| ES 215 | M00074561D:D12 | PTA-2381 |
| ES 215 | M00074566B:A04 | PTA-2381 |
| ES 215 | M00074569D:D04 | PTA-2381 |
| ES 215 | M00074521D:F01 | PTA-2381 |
| ES 215 | M00074549C:H08 | PTA-2381 |
| ES 215 | M00074555A:E10 | PTA-2381 |
| ES 215 | M00074561A:B09 | PTA-2381 |
| ES 215 | M00074565A:D08 | PTA-2381 |
| ES 215 | M00074571D:F02 | PTA-2381 |
| ES 215 | M00074573A:H02 | PTA-2381 |
| ES 215 | M00074577B:B12 | PTA-2381 |
| ES 215 | M00074577C:A05 | PTA-2381 |
| ES 215 | M00074582C:C02 | PTA-2381 |
| ES 215 | M00074582D:B09 | PTA-2381 |
| ES 215 | M00074584D:C01 | PTA-2381 |
| ES 215 | M00074588C:H06 | PTA-2381 |
| ES 215 | M00074589A:E10 | PTA-2381 |
| ES 215 | M00074593A:F05 | PTA-2381 |
| ES 215 | M00074596D:B12 | PTA-2381 |
| ES 215 | M00074606C:G02 | PTA-2381 |
| ES 215 | M00074607D:A12 | PTA-2381 |
| ES 215 | M00074613D:F01 | PTA-2381 |
| ES 215 | M00074614B:D10 | PTA-2381 |
| ES 215 | M00074625A:C12 | PTA-2381 |
| ES 215 | M00074628C:C11 | PTA-2381 |
| ES 215 | M00074628C:D03 | PTA-2381 |
| ES 215 | M00074633A:B09 | PTA-2381 |
| ES 215 | M00074636D:C01 | PTA-2381 |
| ES 215 | M00074637A:C02 | PTA-2381 |
| ES 215 | M00074638D:C12 | PTA-2381 |
| ES 215 | M00074639A:C08 | PTA-2381 |
| ES 215 | M00074640D:F07 | PTA-2381 |
| ES 215 | M00074645C:B07 | PTA-2381 |
| ES 215 | M00074654D:B05 | PTA-2381 |
| ES 215 | M00074662B:A05 | PTA-2381 |
| ES 215 | M00074662D:D01 | PTA-2381 |
| ES 215 | M00074664C:G09 | PTA-2381 |
| ES 215 | M00074668D:D04 | PTA-2381 |
| ES 215 | M00074674D:D02 | PTA-2381 |
| ES 215 | M00074676D:H07 | PTA-2381 |
| ES 215 | M00074681C:G11 | PTA-2381 |
| ES 215 | M00074681D:A02 | PTA-2381 |
| ES 215 | M00074687B:E01 | PTA-2381 |
| ES 215 | M00074699B:C03 | PTA-2381 |
| ES 215 | M00074701D:H09 | PTA-2381 |
| ES 215 | M00074702B:F12 | PTA-2381 |
| ES 215 | M00074702D:H05 | PTA-2381 |
| ES 215 | M00074713B:F02 | PTA-2381 |
| ES 215 | M00074716C:H07 | PTA-2381 |
| ES 215 | M00074723D:C06 | PTA-2381 |

TABLE 157-continued

| ES No. | CLONE ID | ATCC# |
|---|---|---|
| ES 215 | M00074723D:D05 | PTA-2381 |
| ES 215 | M00074728C:B08 | PTA-2381 |
| ES 215 | M00074730B:A04 | PTA-2381 |
| ES 215 | M00074740B:F06 | PTA-2381 |
| ES 215 | M00074744B:B12 | PTA-2381 |
| ES 215 | M00074748C:G02 | PTA-2381 |
| ES 215 | M00074752A:D08 | PTA-2381 |
| ES 215 | M00074753C:E10 | PTA-2381 |
| ES 215 | M00074755A:B10 | PTA-2381 |
| ES 215 | M00074755A:E07 | PTA-2381 |
| ES 215 | M00074765D:F06 | PTA-2381 |
| ES 215 | M00074766C:F12 | PTA-2381 |
| ES 215 | M00074768C:A05 | PTA-2381 |
| ES 215 | M00074773C:G03 | PTA-2381 |
| ES 215 | M00074774A:D03 | PTA-2381 |
| ES 215 | M00074777A:E01 | PTA-2381 |
| ES 215 | M00074780C:C02 | PTA-2381 |
| ES 215 | M00074782A:E04 | PTA-2381 |
| ES 215 | M00074808B:H02 | PTA-2381 |
| ES 215 | M00074996C:D07 | PTA-2381 |
| ES 215 | M00074981C:C09 | PTA-2381 |
| ES 215 | M00075000A:D06 | PTA-2381 |
| ES 215 | M00074805A:C12 | PTA-2381 |
| ES 215 | M00074981D:A03 | PTA-2381 |
| ES 215 | M00074794C:H02 | PTA-2381 |
| ES 215 | M00074801C:E06 | PTA-2381 |
| ES 215 | M00074821B:B03 | PTA-2381 |
| ES 215 | M00074823A:E03 | PTA-2381 |
| ES 215 | M00074800B:H01 | PTA-2381 |
| ES 215 | M00074800D:G09 | PTA-2381 |
| ES 215 | M00074812A:F03 | PTA-2381 |
| ES 215 | M00074825C:E06 | PTA-2381 |
| ES 215 | M00074794A:G10 | PTA-2381 |
| ES 215 | M00075018A:G04 | PTA-2381 |
| ES 215 | M00075020D:B04 | PTA-2381 |
| ES 215 | M00075049A:C09 | PTA-2381 |
| ES 215 | M00075032A:F02 | PTA-2381 |
| ES 215 | M00075029B:E03 | PTA-2381 |
| ES 215 | M00075069C:C01 | PTA-2381 |
| ES 215 | M00075039A:E01 | PTA-2381 |
| ES 215 | M00075024C:G05 | PTA-2381 |
| ES 215 | M00075074D:G11 | PTA-2381 |
| ES 215 | M00075011A:C11 | PTA-2381 |
| ES 215 | M00075061A:B03 | PTA-2381 |
| ES 215 | M00075043B:H05 | PTA-2381 |
| ES 215 | M00075035C:C09 | PTA-2381 |
| ES 215 | M00075045D:H03 | PTA-2381 |
| ES 215 | M00075078C:A07 | PTA-2381 |
| ES 215 | M00075075A:D12 | PTA-2381 |
| ES 215 | M00075077C:F09 | PTA-2381 |
| ES 215 | M00075026A:D11 | PTA-2381 |
| ES 215 | M00075044A:C10 | PTA-2381 |
| ES 215 | M00075075A:E09 | PTA-2381 |
| ES 215 | M00075020C:D12 | PTA-2381 |
| ES 215 | M00075117B:B06 | PTA-2381 |
| ES 215 | M00075114C:G11 | PTA-2381 |
| ES 215 | M00075153C:C11 | PTA-2381 |
| ES 215 | M00075161A:E05 | PTA-2381 |
| ES 215 | M00075126B:A06 | PTA-2381 |
| ES 215 | M00075126D:H07 | PTA-2381 |
| ES 216 | M00075092C:F04 | PTA-2382 |
| ES 216 | M00075110C:B03 | PTA-2382 |
| ES 216 | M00075132C:A03 | PTA-2382 |
| ES 216 | M00075152D:C06 | PTA-2382 |
| ES 216 | M00075125B:C07 | PTA-2382 |
| ES 216 | M00075132C:E07 | PTA-2382 |
| ES 216 | M00075160A:E04 | PTA-2382 |
| ES 216 | M00075149B:A01 | PTA-2382 |
| ES 216 | M00075120C:H04 | PTA-2382 |
| ES 216 | M00075093B:F10 | PTA-2382 |
| ES 216 | M00075102A:D02 | PTA-2382 |
| ES 216 | M00075090D:B07 | PTA-2382 |
| ES 216 | M00075161D:G06 | PTA-2382 |
| ES 216 | M00075165B:D04 | PTA-2382 |
| ES 216 | M00075174D:D06 | PTA-2382 |
| ES 216 | M00075180D:F05 | PTA-2382 |
| ES 216 | M00075181D:G10 | PTA-2382 |
| ES 216 | M00075189C:G05 | PTA-2382 |
| ES 216 | M00075199D:D11 | PTA-2382 |
| ES 216 | M00075201D:A05 | PTA-2382 |
| ES 216 | M00075203A:G06 | PTA-2382 |
| ES 216 | M00075211D:F09 | PTA-2382 |
| ES 216 | M00075221C:E02 | PTA-2382 |
| ES 216 | M00075228D:G09 | PTA-2382 |
| ES 216 | M00075232C:A06 | PTA-2382 |
| ES 216 | M00075232D:C06 | PTA-2382 |
| ES 216 | M00075234C:E06 | PTA-2382 |
| ES 216 | M00075239C:D06 | PTA-2382 |
| ES 216 | M00075242A:G04 | PTA-2382 |
| ES 216 | M00075243D:F04 | PTA-2382 |
| ES 216 | M00075245A:A06 | PTA-2382 |
| ES 216 | M00075249A:B08 | PTA-2382 |
| ES 216 | M00075252B:F10 | PTA-2382 |
| ES 216 | M00075255A:G11 | PTA-2382 |
| ES 216 | M00075259C:G02 | PTA-2382 |
| ES 216 | M00075270D:A02 | PTA-2382 |
| ES 216 | M00075273C:E01 | PTA-2382 |
| ES 216 | M00075274B:F06 | PTA-2382 |
| ES 216 | M00075275B:H07 | PTA-2382 |
| ES 216 | M00075279C:E08 | PTA-2382 |
| ES 216 | M00075283A:F04 | PTA-2382 |
| ES 216 | M00075302B:C07 | PTA-2382 |
| ES 216 | M00075305C:C07 | PTA-2382 |
| ES 216 | M00075309C:A06 | PTA-2382 |
| ES 216 | M00075323B:B12 | PTA-2382 |
| ES 216 | M00075324B:C10 | PTA-2382 |
| ES 216 | M00075324D:E02 | PTA-2382 |
| ES 216 | M00075326C:B01 | PTA-2382 |
| ES 216 | M00075326D:A09 | PTA-2382 |
| ES 216 | M00075329B:E10 | PTA-2382 |
| ES 216 | M00075330D:F11 | PTA-2382 |
| ES 216 | M00075333D:B07 | PTA-2382 |
| ES 216 | M00075333D:D10 | PTA-2382 |
| ES 216 | M00075336B:B04 | PTA-2382 |
| ES 216 | M00075344D:A08 | PTA-2382 |
| ES 216 | M00075347D:D01 | PTA-2382 |
| ES 216 | M00075354A:D11 | PTA-2382 |
| ES 216 | M00075354A:G12 | PTA-2382 |
| ES 216 | M00075354C:B12 | PTA-2382 |
| ES 216 | M00075360D:D04 | PTA-2382 |
| ES 216 | M00075365B:B06 | PTA-2382 |
| ES 216 | M00075384A:B03 | PTA-2382 |
| ES 216 | M00075389B:C06 | PTA-2382 |
| ES 216 | M00075391D:D07 | PTA-2382 |
| ES 216 | M00075402A:F01 | PTA-2382 |
| ES 216 | M00075405B:C07 | PTA-2382 |
| ES 216 | M00075405D:A10 | PTA-2382 |
| ES 216 | M00075365D:B08 | PTA-2382 |
| ES 216 | M00075380D:F06 | PTA-2382 |
| ES 216 | M00075356D:C03 | PTA-2382 |
| ES 216 | M00075352D:F09 | PTA-2382 |
| ES 216 | M00075359D:E09 | PTA-2382 |
| ES 216 | M00075365D:H01 | PTA-2382 |
| ES 216 | M00075373C:B09 | PTA-2382 |
| ES 216 | M00075378B:C07 | PTA-2382 |
| ES 216 | M00075379A:E07 | PTA-2382 |
| ES 216 | M00075383A:B11 | PTA-2382 |
| ES 216 | M00075407A:B05 | PTA-2382 |
| ES 216 | M00075409A:E04 | PTA-2382 |
| ES 216 | M00075409B:G12 | PTA-2382 |
| ES 216 | M00075416C:B02 | PTA-2382 |
| ES 216 | M00075458B:F09 | PTA-2382 |
| ES 216 | M00075464C:A07 | PTA-2382 |
| ES 216 | M00075458C:F01 | PTA-2382 |
| ES 216 | M00075463C:E07 | PTA-2382 |
| ES 216 | M00075464C:C04 | PTA-2382 |
| ES 216 | M00075448B:G11 | PTA-2382 |
| ES 216 | M00075434A:D06 | PTA-2382 |
| ES 216 | M00075457C:A06 | PTA-2382 |
| ES 216 | M00075454C:D06 | PTA-2382 |
| ES 216 | M00075460C:B06 | PTA-2382 |
| ES 216 | M00075459A:C02 | PTA-2382 |
| ES 216 | M00075414A:D10 | PTA-2382 |
| ES 216 | M00075433A:C06 | PTA-2382 |
| ES 216 | M00075505B:A04 | PTA-2382 |
| ES 216 | M00075474D:B07 | PTA-2382 |

TABLE 157-continued

| ES No. | CLONE ID | ATCC# |
|---|---|---|
| ES 216 | M00075504B:A10 | PTA-2382 |
| ES 216 | M00075473C:E08 | PTA-2382 |
| ES 216 | M00075499A:H02 | PTA-2382 |
| ES 216 | M00075495D:D11 | PTA-2382 |
| ES 216 | M00075496D:G05 | PTA-2382 |
| ES 216 | M00075514A:G12 | PTA-2382 |
| ES 216 | M00075495B:C12 | PTA-2382 |
| ES 216 | M00075497D:H03 | PTA-2382 |
| ES 216 | M00075529A:A02 | PTA-2382 |
| ES 216 | M00075538C:E03 | PTA-2382 |
| ES 216 | M00075544A:C03 | PTA-2382 |
| ES 216 | M00075598B:A09 | PTA-2382 |
| ES 216 | M00075521B:E11 | PTA-2382 |
| ES 216 | M00075597C:G01 | PTA-2382 |
| ES 216 | M00075584D:B05 | PTA-2382 |
| ES 216 | M00075590B:G04 | PTA-2382 |
| ES 216 | M00075603D:D09 | PTA-2382 |
| ES 216 | M00075607B:D05 | PTA-2382 |
| ES 216 | M00075609A:H06 | PTA-2382 |
| ES 216 | M00075613D:F01 | PTA-2382 |
| ES 216 | M00075619C:D08 | PTA-2382 |
| ES 216 | M00075621A:F06 | PTA-2382 |
| ES 216 | M00075639A:D12 | PTA-2382 |

Retrieval of Individual Clones from Deposit of Pooled Clones. Where the ATCC deposit is composed of a pool of cDNA clones or a library of cDNA clones, the deposit was prepared by first transfecting each of the clones into separate bacterial cells. The clones in the pool or library were then deposited as a pool of equal mixtures in the composite deposit. Particular clones can be obtained from the composite deposit using methods well known in the art. For example, a bacterial cell containing a particular clone can be identified by isolating single colonies, and identifying colonies containing the specific clone through standard colony hybridization techniques, using an oligonucleotide probe or probes designed to specifically hybridize to a sequence of the clone insert (e.g., a probe based upon unmasked sequence of the encoded polynucleotide having the indicated SEQ ID NO). The probe should be designed to have a $T_m$ of approximately 80° C. (assuming 2° C. for each A or T and 4° C. for each G or C). Positive colonies can then be picked, grown in culture, and the recombinant clone isolated. Alternatively, probes designed in this manner can be used to PCR to isolate a nucleic acid molecule from the pooled clones according to methods well known in the art, e.g., by purifying the cDNA from the deposited culture pool, and using the probes in PCR reactions to produce an amplified product having the corresponding desired polynucleotide sequence.

Example 105

Detection of Genes that are Differentially Expressed in Cancer Cells

Polynucleotides for use on the arrays were obtained from both publicly available sources and from cDNA libraries generated from selected cell lines and patient tissues. Table 158 (inserted prior to claims) provides information about the polynucleotides on the arrays including: (a) the "SEQ ID", corresponding to the sequences of the Sequence Listing provided herein; (b) the "SeqName", corresponding to a internal reference name for the sequence; (c) the "Clone Id", corresponding to the identifier of a clone from which the sequence is derived; (d) the "Seq Type", corresponding to the type of the sequence, either internal or consensus; (e) the "Lib. Name", corresponding to the library from which the clone was obtained; (f) the "Cluster Id", corresponding to an internal identifier for a set of sequences that have been grouped, i.e., clustered, based on their sequence identity, and (g) the "Length", corresponding to the length of the sequence.

Normal and cancerous tissues were collected from patients using laser capture microdissection (LCM) techniques, which techniques are well known in the art (see, e.g., Ohyama et al. (2000) Biotechniques 29:530-6; Curran et al. (2000) Mol. Pathol. 53:64-8; Suarez-Quian et al. (1999) Biotechniques 26:328-35; Simone et al. (1998) Trends Genet 14:272-6; Conia et al. (1997) J. Clin. Lab. Anal. 11:28-38; Emmert-Buck et al. (1996) Science 274:998-1001).

In general, patients (pats) had breast cancer (brst), prostate cancer (prst), colon cancer (cln). Patients with colon cancer had metastasized colon cancer (met or M), and/or primary tumors (T). Metastases of colon cancers may appear in any tissue, including bone, breast, lung, liver, brain, kidney skin, intestine, appendix, etc. In many patients, the colon cancer had metastasized to liver.

cDNA probes were prepared from total RNA isolated from the patient samples described above. Since LCM provides for the isolation of specific cell types to provide a substantially homogenous cell sample, this provided for a similarly pure RNA sample.

In most experiments, total RNA was first reverse transcribed into cDNA using a primer containing a T7 RNA polymerase promoter, followed by second strand DNA synthesis. cDNA was then transcribed in vitro to produce antisense RNA using the T7 promoter-mediated expression (see, e.g., Luo et al. (1999) Nature Med 5:117-122), and the antisense RNA was then converted into cDNA. The second set of cDNAs were again transcribed in vitro, using the T7 promoter, to provide antisense RNA. Optionally, the RNA was again converted into cDNA, allowing for up to a third round of T7-mediated amplification to produce more antisense RNA. Thus the procedure provided for two or three rounds of in vitro transcription to produce the final RNA used for fluorescent labeling.

Fluorescent probes were generated by first adding control RNA to the antisense RNA mix, and producing fluorescently labeled cDNA from the RNA starting material. Fluorescently labeled cDNAs prepared from the tumor RNA sample were compared to fluorescently labeled cDNAs prepared from a normal cell RNA sample. For example, the cDNA probes from the normal cells were labeled with Cy3 fluorescent dye (green) and the cDNA probes prepared from the tumor cells were labeled with Cy5 fluorescent dye (red), and vice versa.

In many experiments, each array used had an identical spatial layout and control spot set. Each microarray was divided into two areas, each area having an array with, on each half, twelve groupings of 32×12 spots, for a total of about 9,216 spots on each array. The two areas are spotted identically which provides for at least two duplicates of each clone per array.

Polynucleotides for use on the arrays were obtained from both publicly available sources and from cDNA libraries generated from selected cell lines and patient tissues as described. PCR products of from about 0.5 kb to 2.0 kb amplified from these sources were spotted onto the array using a Molecular Dynamics Gen III spotter according to the manufacturer's recommendations. The first row of each of the 24 regions on the array had about 32 control spots, including 4 negative control spots and 8 test polynucleotides. The test polynucleotides were spiked into each sample before the labeling reaction with a range of concentrations from 2-600 pg/slide and ratios of 1:1. For each array design, two slides were hybridized with the test samples reverse-labeled in the labeling reaction. This provided for about four duplicate measurements for each clone, two of one color and two of the other, for each sample. In some experiments Affymetrix oligonucleotide arrays were used.

The differential expression assay was performed by mixing equal amounts of probes from matched or unmatched samples. The arrays were pre-incubated for about 2 hrs at 60° C. in 5×SSC/0.2% SDS/1 mM EDTA, and then washed three times in water and twice in isopropanol. Following prehybridization of the array, the probe mixture was then hybridized to the array under conditions of high stringency (overnight at 42° C. in 50% formamide, 5×SSC, and 0.2% SDS. After hybridization, the array was washed at 55° C. three times as follows: 1) first wash in 1×SSC/0.2% SDS; 2) second wash in 0.1×SSC/0.2% SDS; and 3) third wash in 0.1×SSC.

The arrays were then scanned for green and red fluorescence using a Molecular Dynamics Generation III dual color laser-scanner/detector. The images were processed using BioDiscovery Autogene software, and the data from each scan set normalized to provide for a ratio of expression relative to normal.

The experiment was repeated, this time labeling the two probes with the opposite color in order to perform the assay in both "color directions." Each experiment was sometimes repeated with two more slides (one in each color direction). The level of fluorescence for each sequence on the array expressed as a ratio of the geometric mean of 8 replicate spots/genes from the four arrays or 4 replicate spots/gene from 2 arrays or some other permutation. The data were normalized using the spiked positive controls present in each duplicated area, and the precision of this normalization was included in the final determination of the significance of each differential. The fluorescent intensity of each spot was also compared to the negative controls in each duplicated area to determine which spots have detected significant expression levels in each sample.

A statistical analysis of the fluorescent intensities was applied to each set of duplicate spots to assess the precision and significance of each differential measurement, resulting in a p-value testing the null hypothesis that there is no differential in the expression level between the tumor and normal samples of each patient. During initial analysis of the microarrays, the hypothesis was accepted if $p>10^{-3}$, and the differential ratio was set to 1.000 for those spots. All other spots have a significant difference in expression between the matched or unmatched samples. If the tumor sample has detectable expression and the normal does not, the ratio is truncated at 1000 since the value for expression in the normal sample would be zero, and the ratio would not be a mathematically useful value (e.g., infinity). If the normal sample has detectable expression and the tumor does not, the ratio is truncated to 0.001, since the value for expression in the tumor sample would be zero and the ratio would not be a mathematically useful value. These latter two situations are referred to herein as "on/off." Database tables were populated using a 95% confidence level ($p>0.05$).

Results

Table 159 provides results obtained according to the methods set forth above. The results show data from several separate experiments using the same set of gene products, each identified by SEQ ID NO. The results for a particular SEQ ID are expressed as a percentage of the total number of patients in which that SEQ ID was over-expressed by at least two fold at a 95% confidence level. Accordingly, for example, SEQ ID NO:23576, the first entry, is expressed in tumor samples of 21.74% (% Brst Pats) of 23 patients (# Brst Pats) with breast cancer.

The six experiments were: 1) a comparison of the gene expression profile of cancerous breast cells to that of normal breast cells (results shown in column 3, entitled "% Brst Pats"), 2) a comparison of the gene expression profile of cancerous colon cells (primary tumor) to that of normal colon cells (results shown in column 5, entitled "% Cln Pats"), 3) a comparison of the gene expression profile of cancerous prostate cells to that of normal prostate cells (results shown in column 7, entitled "% Prst Pats"), 4) a comparison of the gene expression profile of metastasized cancerous colon cells to that of unmatched controls (i.e., a pooled sample of normal colon from many patients; results shown in column 9, entitled "% Cln Unm Met"), 5) a comparison of the gene expression profile of cancerous metastasized colon cells to that of matched (i.e. from the same patient) normal colon cells (results shown in column 11, entitled "% Cln Match met"), and 6) a comparison of the gene expression profile of cancerous metastasized colon cells to that of matched (i.e., from the same patient) colon cancer cells from a primary tumor (results shown in column 13, entitled "% Cln Match Met M/T"). Also shown in Table 159 are "SPOT ID" entries, which correspond to an internal reference identifier.

Table 160 also provides results obtained according to the methods set forth above. The results show data from several separate experiments using the same set of gene products, each identified by SEQ ID NO. Again, the results for a particular SEQ ID are expressed as a percentage of the total number of patients in which that SEQ ID was over-expressed by at least two fold at a 95% confidence level. Accordingly, for example, SEQ ID NO:23569, the first entry, is expressed in breast tumor samples of 24.44% (% Breast T/N>=2×) of 45 patients Breast T/N patients) with breast cancer.

The two experiments were: 1) a comparison of the gene expression profile of cancerous breast cells (primary tumor) to that of normal breast cells (results shown in column 3, entitled "% Breast T/N>=2×"), and 2) a comparison of the gene expression profile of cancerous colon cells (primary tumor) to that of normal colon cells (results shown in column 5, entitled "% Colon T/N>=2×"). The number of patients in the patient samples are shown in columns 4 and 6. Also known is a column entitled "PROBESET Id", which corresponds to an internal reference identifier.

These data show that the sequences set forth in the in the sequence listing may be used to detect cancerous cells, particularly, cancerous colon, prostate, breast, and metastasized colon cells.

TABLE 158

| Seq Id | SeqName | Clone Id | Seq Type | Lib Name | Cluster Id | Length |
|---|---|---|---|---|---|---|
| 23569 | 5059.K19.GZ43_643335 | M00079817D:G03 | internal | chiron(27) | 800071 | 519 |
| 23570 | 5060.E21.GZ43_643745 | M00079848A:B09 | internal | chiron(27) | 1089548 | 535 |
| 23571 | 5060.G17.GZ43_643683 | M00079856A:C12 | internal | chiron(27) | 381805 | 445 |
| 23572 | 5061.A19.gz43_646815 | M00079888C:C02 | internal | chiron(27) | 657028 | 619 |
| 23573 | 5061.C02.gz43_646545 | M00079891C:A07 | internal | chiron(27) | 1117586 | 637 |
| 23574 | 5061.E17.gz43_646787 | M00079902A:G08 | internal | chiron(27) | 1116829 | 499 |

TABLE 158-continued

| Seq Id | SeqName | Clone Id | Seq Type | Lib Name | Cluster Id | Length |
|---|---|---|---|---|---|---|
| 23575 | 5061.M03.gz43_646571 | M00079929D:E09 | internal | chiron(27) | 800071 | 557 |
| 23576 | 5061.N15.gz43_646764 | M00079935C:A07 | internal | chiron(27) | 398438 | 484 |
| 23577 | 5061.O18.gz43_646813 | M00079939B:G07 | internal | chiron(27) | 774843 | 635 |
| 23578 | 5061.P08.gz43_646654 | M00079940C:D02 | internal | chiron(27) | 431141 | 593 |
| 23579 | 5062.M21.GZ43_647243 | M00079986C:G03 | internal | chiron(27) | 42008 | 541 |
| 23580 | 5063.A16.GZ43_647535 | M00079998A:H03 | internal | chiron(27) | 42008 | 405 |
| 23581 | 5063.E24.GZ43_647667 | M00080010A:G05 | internal | chiron(27) | 583076 | 518 |
| 23582 | 5065.G16.GZ43_648309 | M00080110D:D02 | internal | chiron(27) | 1118029 | 590 |
| 23583 | 5065.P08.GZ43_648190 | M00080136D:A10 | internal | chiron(27) | 807607 | 274 |
| 23584 | 5184.G17.GZ43_667153 | M00082049D:B06 | internal | chiron(28) | 833900 | 472 |
| 23585 | 5185.K01.GZ43_667285 | M00082099D:D04 | internal | chiron(28) | 149149 | 376 |
| 23586 | 5185.L02.GZ43_667302 | M00082103C:H08 | internal | chiron(28) | 416674 | 329 |
| 23587 | 5185.L12.GZ43_667462 | M00082104C:A10 | internal | chiron(28) | 158514 | 385 |
| 23588 | 5186.J19.GZ43_667956 | M00082152A:B06 | internal | chiron(29) | 20806 | 562 |
| 23589 | 5186.J24.GZ43_668036 | M00082152B:H01 | internal | chiron(29) | 1110239 | 556 |
| 23590 | 5186.N17.GZ43_667928 | M00082164D:A10 | internal | chiron(29) | 410674 | 476 |
| 23591 | 5188.A08.GZ43_668539 | M00082232D:E02 | internal | chiron(29) | 1118027 | 546 |
| 23592 | 5188.G06.GZ43_668513 | M00082256A:E06 | internal | chiron(29) | 551209 | 610 |
| 23593 | 5188.H20.GZ43_668738 | M00082263A:F11 | internal | chiron(29) | 525660 | 636 |
| 23594 | 5189.O12.GZ43_669001 | M00082342A:A11 | internal | chiron(29) | 480233 | 606 |
| 23595 | 5189.P10.GZ43_668970 | M00082338A:C01 | internal | chiron(29) | 726873 | 441 |
| 23596 | 5190.E23.GZ43_669551 | M00082382D:C05 | internal | chiron(29) | 1067312 | 622 |
| 23597 | 5190.N13.GZ43_669400 | M00082417A:E03 | internal | chiron(29) | 410674 | 563 |
| 23598 | 5191.G05.GZ43_669649 | M00082457B:B05 | internal | chiron(29) | 25422 | 497 |
| 23599 | 5193.E14.GZ43_670943 | M00082591A:A11 | internal | chiron(29) | 967199 | 501 |
| 23600 | 5193.M09.GZ43_670871 | M00082618A:G07 | internal | chiron(29) | 1135172 | 662 |
| 23601 | 5193.O06.GZ43_670825 | M00082628B:F05 | internal | chiron(29) | 17174 | 524 |
| 23602 | 5195.C15.GZ43_671725 | M00082718D:E03 | internal | chiron(29) | 400889 | 613 |
| 23603 | 5195.E15.GZ43_671727 | M00082729C:C08 | internal | chiron(29) | 1193184 | 602 |
| 23604 | 5234.B09.GZ43_673764 | M00083298C:G12 | internal | chiron(29) | 1119238 | 497 |
| 23605 | 5234.H23.GZ43_673994 | M00083332C:D11 | internal | chiron(29) | 25422 | 644 |
| 23606 | 5234.O05.GZ43_673713 | M00083289D:G08 | internal | chiron(29) | 583076 | 624 |
| 23607 | 5236.J03.GZ43_674444 | M00083437D:E04 | internal | chiron(29) | 606382 | 426 |
| 23608 | 5236.O18.GZ43_674689 | M00083459D:B01 | internal | chiron(29) | 378206 | 580 |
| 23609 | 5238.A24.GZ43_675194 | M00083524A:G10 | internal | chiron(29) | 726873 | 473 |
| 23610 | Clu1052434.con_1 | | consensus | | 1052434 | 352 |
| 23611 | Clu1052615.con_1 | | consensus | | 1052615 | 439 |
| 23612 | Clu1053096.con_1 | | consensus | | 1053096 | 529 |
| 23613 | Clu1058283.con_1 | | consensus | | 1058283 | 824 |
| 23614 | Clu1067312.con_1 | | consensus | | 1067312 | 691 |
| 23615 | Clu1069553.con_2 | | consensus | | 1069553 | 576 |
| 23616 | Clu1080217.con_1 | | consensus | | 1080217 | 547 |
| 23617 | Clu1081611.con_1 | | consensus | | 1081611 | 399 |
| 23618 | Clu1082099.con_1 | | consensus | | 1082099 | 440 |
| 23619 | Clu1082189.con_1 | | consensus | | 1082189 | 470 |
| 23620 | Clu1082283.con_2 | | consensus | | 1082283 | 529 |
| 23621 | Clu1082399.con_1 | | consensus | | 1082399 | 534 |
| 23622 | Clu1082489.con_1 | | consensus | | 1082489 | 355 |
| 23623 | Clu1082628.con_1 | | consensus | | 1082628 | 554 |
| 23624 | Clu1082731.con_1 | | consensus | | 1082731 | 289 |
| 23625 | Clu1083148.con_1 | | consensus | | 1083148 | 757 |
| 23626 | Clu1083900.con_1 | | consensus | | 1083900 | 502 |
| 23627 | Clu1089548.con_1 | | consensus | | 1089548 | 667 |
| 23628 | Clu1116089.con_1 | | consensus | | 1116089 | 369 |
| 23629 | Clu1116829.con_1 | | consensus | | 1116829 | 586 |
| 23630 | Clu1116919.con_1 | | consensus | | 1116919 | 806 |
| 23631 | Clu1116945.con_1 | | consensus | | 1116945 | 566 |
| 23632 | Clu1117021.con_1 | | consensus | | 1117021 | 978 |
| 23633 | Clu1117079.con_1 | | consensus | | 1117079 | 543 |
| 23634 | Clu1117586.con_1 | | consensus | | 1117586 | 678 |
| 23635 | Clu1117625.con_1 | | consensus | | 1117625 | 277 |
| 23636 | Clu1118027.con_1 | | consensus | | 1118027 | 590 |
| 23637 | Clu1118511.con_1 | | consensus | | 1118511 | 815 |
| 23638 | Clu1119238.con_1 | | consensus | | 1119238 | 588 |
| 23639 | Clu1119896.con_1 | | consensus | | 1119896 | 386 |
| 23640 | Clu1126645.con_1 | | consensus | | 1126645 | 509 |
| 23641 | Clu1132147.con_1 | | consensus | | 1132147 | 583 |
| 23642 | Clu1139444.con_1 | | consensus | | 1139444 | 677 |
| 23643 | Clu1139499.con_1 | | consensus | | 1139499 | 498 |
| 23644 | Clu1140276.con_1 | | consensus | | 1140276 | 485 |
| 23645 | Clu1140367.con_2 | | consensus | | 1140367 | 424 |
| 23646 | Clu1140589.con_1 | | consensus | | 1140589 | 821 |
| 23647 | Clu1141931.con_1 | | consensus | | 1141931 | 565 |
| 23648 | Clu1193580.con_1 | | consensus | | 1193580 | 629 |
| 23649 | Clu1193799.con_1 | | consensus | | 1193799 | 733 |
| 23650 | Clu1193833.con_2 | | consensus | | 1193833 | 566 |
| 23651 | Clu149149.con_2 | | consensus | | 149149 | 564 |
| 23652 | Clu19522.con_1 | | consensus | | 19522 | 809 |

TABLE 158-continued

| Seq Id | SeqName | Clone Id | Seq Type | Lib Name | Cluster Id | Length |
|---|---|---|---|---|---|---|
| 23653 | Clu21222.con_1 | | consensus | | 21222 | 774 |
| 23654 | Clu25422.con_1 | | consensus | | 25422 | 766 |
| 23655 | Clu258716.con_1 | | consensus | | 258716 | 872 |
| 23656 | Clu374843.con_1 | | consensus | | 374843 | 656 |
| 23657 | Clu377719.con_1 | | consensus | | 377719 | 1382 |
| 23658 | Clu377939.con_1 | | consensus | | 377939 | 1152 |
| 23659 | Clu378206.con_1 | | consensus | | 378206 | 584 |
| 23660 | Clu398438.con_1 | | consensus | | 398438 | 736 |
| 23661 | Clu400889.con_1 | | consensus | | 400889 | 741 |
| 23662 | Clu403038.con_1 | | consensus | | 403038 | 773 |
| 23663 | Clu410674.con_1 | | consensus | | 410674 | 822 |
| 23664 | Clu411226.con_1 | | consensus | | 411226 | 907 |
| 23665 | Clu413700.con_1 | | consensus | | 413700 | 951 |
| 23666 | Clu416674.con_1 | | consensus | | 416674 | 766 |
| 23667 | Clu42008.con_1 | | consensus | | 42008 | 1057 |
| 23668 | Clu451094.con_1 | | consensus | | 451094 | 443 |
| 23669 | Clu451310.con_1 | | consensus | | 451310 | 484 |
| 23670 | Clu451496.con_2 | | consensus | | 451496 | 1000 |
| 23671 | Clu455524.con_1 | | consensus | | 455524 | 363 |
| 23672 | Clu456861.con_1 | | consensus | | 456861 | 525 |
| 23673 | Clu480233.con_2 | | consensus | | 480233 | 622 |
| 23674 | Clu512287.con_2 | | consensus | | 512287 | 491 |
| 23675 | Clu525660.con_1 | | consensus | | 525660 | 650 |
| 23676 | Clu532281.con_1 | | consensus | | 532281 | 636 |
| 23677 | Clu552745.con_1 | | consensus | | 552745 | 373 |
| 23678 | Clu554732.con_1 | | consensus | | 554732 | 474 |
| 23679 | Clu556189.con_1 | | consensus | | 556189 | 698 |
| 23680 | Clu579754.con_1 | | consensus | | 579754 | 653 |
| 23681 | Clu593641.con_1 | | consensus | | 593641 | 890 |
| 23682 | Clu643318.con_1 | | consensus | | 643318 | 498 |
| 23683 | Clu657028.con_1 | | consensus | | 657028 | 807 |
| 23684 | 5072.K10.GZ43_650909 | M00080470D:C10 | internal | chiron(27) | 410674 | 557 |
| 23685 | 5072.P20.GZ43_651074 | M00080489D:G10 | internal | chiron(27) | 856078 | 489 |
| 23686 | 5073.C07.GZ43_651237 | M00080495C:B05 | internal | chiron(27) | 533096 | 590 |
| 23687 | 5073.D08.GZ43_651254 | M00080498D:E12 | internal | chiron(27) | 1067312 | 578 |
| 23688 | 5073.J20.GZ43_651452 | M00080515D:H06 | internal | chiron(27) | 400889 | 504 |
| 23689 | 5074.H06.GZ43_651610 | M00080558A:G02 | internal | chiron(27) | 618862 | 544 |
| 23690 | 5074.J21.GZ43_651852 | M00080569D:E04 | internal | chiron(27) | 1118511 | 573 |
| 23691 | 5075.A20.GZ43_652211 | M00080608C:E03 | internal | chiron(27) | 1117586 | 584 |
| 23692 | 5075.M03.GZ43_651951 | M00080642C:G04 | internal | chiron(27) | 723800 | 577 |
| 23693 | 5076.B04.GZ43_652340 | M00080658D:B05 | internal | chiron(27) | 1083148 | 615 |
| 23694 | 5076.H07.GZ43_652394 | M00080683A:F07 | internal | chiron(27) | 168428 | 548 |
| 23695 | 5076.P22.GZ43_652642 | M00080721A:B11 | internal | chiron(27) | 1118511 | 625 |
| 23696 | 5097.D01.GZ43_652699 | M00080728C:A06 | internal | chiron(27) | 1116829 | 533 |
| 23697 | 5097.M04.GZ43_652756 | M00080734D:A04 | internal | chiron(27) | 613936 | 565 |
| 23698 | 5097.P10.GZ43_652855 | M00080747A:B06 | internal | chiron(27) | 831704 | 195 |
| 23699 | 5098.C09.GZ43_653210 | M00080839A:C05 | internal | chiron(27) | 1117079 | 536 |
| 23700 | 5098.E12.GZ43_653260 | M00080849C:A06 | internal | chiron(27) | 666002 | 500 |
| 23701 | 5130.F02.GZ43_659697 | M00081454C:B02 | internal | chiron(28) | 833900 | 670 |
| 23702 | 5130.O17.GZ43_659946 | M00081478A:A12 | internal | chiron(28) | 520284 | 542 |
| 23703 | 5130.P09.GZ43_659819 | M00081479D:H03 | internal | chiron(28) | 1138736 | 621 |
| 23704 | 5131.N24.GZ43_660441 | M00081516A:F04 | internal | chiron(28) | 469630 | 455 |
| 23705 | 5132.D09.GZ43_660575 | M00081524D:E12 | internal | chiron(28) | 411226 | 558 |
| 23706 | 5133.B13.GZ43_661021 | M00081558D:C08 | internal | chiron(28) | 532281 | 415 |
| 23707 | 5133.G11.GZ43_660994 | M00081568D:D02 | internal | chiron(28) | 89239 | 557 |
| 23708 | 5133.J24.GZ43_661205 | M00081574B:A04 | internal | chiron(28) | 644751 | 550 |
| 23709 | 5133.N07.GZ43_660937 | M00081580D:E03 | internal | chiron(28) | 526675 | 603 |
| 23710 | 5134.J13.GZ43_661413 | M00081607C:D05 | internal | chiron(28) | 964646 | 489 |
| 23711 | 5134.N11.GZ43_661385 | M00081616B:H01 | internal | chiron(28) | 454662 | 397 |
| 23712 | 5134.O05.GZ43_661290 | M00081618A:B06 | internal | chiron(28) | 31223 | 491 |
| 23713 | 5136.B15.GZ43_662228 | M00081661D:A10 | internal | chiron(28) | 1069553 | 413 |
| 23714 | 5136.H18.GZ43_662282 | M00081678A:A12 | internal | chiron(28) | 512287 | 487 |
| 23715 | 5136.K03.GZ43_662045 | M00081683B:C09 | internal | chiron(28) | 532281 | 626 |
| 23716 | 5136.K16.GZ43_662253 | M00081684B:C10 | internal | chiron(28) | 378206 | 509 |
| 23717 | 5136.P01.GZ43_662018 | M00081693B:F12 | internal | chiron(28) | 89239 | 495 |
| 23718 | Clu666002.con_1 | | consensus | | 666002 | 530 |
| 23719 | Clu685022.con_1 | | consensus | | 685022 | 599 |
| 23720 | Clu715440.con_2 | | consensus | | 715440 | 611 |
| 23721 | Clu726873.con_1 | | consensus | | 726873 | 687 |
| 23722 | Clu775364.con_1 | | consensus | | 775364 | 601 |
| 23723 | Clu800071.con_1 | | consensus | | 800071 | 685 |
| 23724 | Clu807607.con_1 | | consensus | | 807607 | 562 |
| 23725 | Clu954632.con_1 | | consensus | | 954632 | 292 |
| 23726 | Clu964646.con_1 | | consensus | | 964646 | 526 |
| 23727 | Clu982132.con_1 | | consensus | | 982132 | 987 |
| 23728 | 5066.J20.GZ43_648760 | M00080164D:H10 | internal | chiron(27) | 618862 | 344 |
| 23729 | 5066.N15.GZ43_648684 | M00080179D:G07 | internal | chiron(27) | 1083148 | 259 |
| 23730 | 5066.O24.GZ43_648829 | M00080184B:C10 | internal | chiron(27) | 19522 | 303 |

TABLE 158-continued

| Seq Id | SeqName | Clone Id | Seq Type | Lib Name | Cluster Id | Length |
|---|---|---|---|---|---|---|
| 23731 | 5069.A20.GZ43_649907 | M00080285A:E12 | internal | chiron(27) | 1119238 | 588 |
| 23732 | 5069.I09.GZ43_649739 | M00080317A:G01 | internal | chiron(27) | 1117079 | 537 |
| 23733 | 5069.M04.GZ43_649663 | M00080331C:D09 | internal | chiron(27) | 685022 | 592 |
| 23734 | 5070.G07.GZ43_650089 | M00080362D:F11 | internal | chiron(27) | 258716 | 520 |
| 23735 | 5071.H06.GZ43_650458 | M00080407D:G09 | internal | chiron(27) | 386188 | 216 |
| 23736 | 5071.J11.GZ43_650540 | M00080413D:D07 | internal | chiron(27) | 1117021 | 569 |
| 23737 | 5098.I02.GZ43_653104 | M00080819B:G07 | internal | chiron(27) | 398438 | 459 |
| 23738 | 5101.B10.GZ43_654377 | M00081030A:D09 | internal | chiron(28) | 1139444 | 562 |
| 23739 | 5102.A22.GZ43_654952 | M00081093B:C04 | internal | chiron(28) | 1139037 | 467 |
| 23740 | 5103.J01.GZ43_655009 | M00081178D:C12 | internal | chiron(28) | 643318 | 455 |
| 23741 | 5104.I13.GZ43_655584 | M00081223D:D06 | internal | chiron(28) | 558521 | 637 |
| 23742 | 5104.O16.GZ43_655638 | M00081228B:C04 | internal | chiron(28) | 1139048 | 327 |
| 23743 | 5105.P13.GZ43_655975 | M00081288D:G08 | internal | chiron(28) | 1140612 | 542 |
| 23744 | 5106.I21.GZ43_656480 | M00081313D:B12 | internal | chiron(28) | 643318 | 498 |
| 23745 | 5106.M18.GZ43_656436 | M00081323D:C07 | internal | chiron(28) | 964646 | 429 |
| 23746 | 5127.A11.GZ43_658684 | M00081333C:A04 | internal | chiron(28) | 89239 | 438 |
| 23747 | 5127.E23.GZ43_658880 | M00081344A:C10 | internal | chiron(28) | 715440 | 610 |
| 23748 | 5128.J24.GZ43_659285 | M00081385B:D11 | internal | chiron(28) | 848070 | 546 |
| 23749 | 5128.L10.GZ43_659063 | M00081388B:A12 | internal | chiron(28) | 1138291 | 483 |
| 23750 | 5129.J16.GZ43_659541 | M00081428A:B10 | internal | chiron(28) | 1141931 | 482 |
| 23751 | 5129.P04.GZ43_659355 | M00081441D:F01 | internal | chiron(28) | 1117586 | 496 |
| 23752 | 5130.C16.GZ43_659918 | M00081450C:E09 | internal | chiron(28) | 523988 | 573 |
| 23753 | 5130.D14.GZ43_659887 | M00081452A:G03 | internal | chiron(28) | 631472 | 408 |
| 23754 | 5177.B11.GZ43_664364 | M00081717D:A10 | internal | chiron(28) | 411226 | 366 |
| 23755 | 5177.D13.GZ43_664398 | M00081723A:C02 | internal | chiron(28) | 1139444 | 493 |
| 23756 | 5177.H05.GZ43_664274 | M00081705D:B04 | internal | chiron(28) | 964646 | 406 |
| 23757 | 5178.G24.GZ43_664961 | M00081767C:G04 | internal | chiron(28) | 374843 | 614 |
| 23758 | 5178.N01.GZ43_664600 | M00081780B:F07 | internal | chiron(28) | 884215 | 516 |
| 23759 | 5179.I06.GZ43_665059 | M00081806D:C10 | internal | chiron(28) | 685022 | 593 |
| 23760 | 5179.L07.GZ43_665078 | M00081812D:A11 | internal | chiron(28) | 9087 | 444 |
| 23761 | 5181.B17.GZ43_665996 | M00081873D:A03 | internal | chiron(28) | 1117625 | 129 |
| 23762 | 5181.C18.GZ43_666013 | M00081878B:G04 | internal | chiron(28) | 512287 | 434 |
| 23763 | 5181.O23.GZ43_666105 | M00081914C:H06 | internal | chiron(28) | 1140589 | 509 |
| 23764 | 5182.L02.GZ43_666150 | M00081924D:E02 | internal | chiron(28) | 532281 | 627 |
| 23765 | 5182.M10.GZ43_666279 | M00081938B:D03 | internal | chiron(28) | 480233 | 618 |
| 23766 | 5183.J06.GZ43_666596 | M00081995C:C03 | internal | chiron(28) | 867272 | 521 |
| 23767 | 5183.K20.GZ43_666821 | M00081999D:H07 | internal | chiron(28) | 416674 | 394 |

TABLE 159

| SEQ ID | SPOT ID | % Brst Pats | # Brst Pats | % Cln Pats | # Cln Pats | % Prst Pats | # Prst Pats | % Cln Unm Met | # Cln Unm Met Pats | % Cln Match Met | # Cln Match Met M/N Pats | % Cln Match Met M/T | % Cln Match Met M/T |
|---|---|---|---|---|---|---|---|---|---|---|---|---|---|
| 23576 | 62615 | 21.74 | 23 | 15.79 | 19 | | 97 | | | 5.56 | 18 | 5.56 | 18 |
| 23576 | 62615 | 21.74 | 23 | 15.79 | 19 | | 97 | | | 5.56 | 18 | 5.56 | 18 |
| 23577 | 42089 | 13.04 | 23 | 23.68 | 76 | 9.80 | 102 | 3.03 | 33 | 8.33 | 36 | | 36 |
| 23579 | 10592 | | 23 | 24.68 | 77 | | 102 | 12.12 | 33 | 16.67 | 36 | | 36 |
| 23579 | 10592 | | 23 | 24.68 | 77 | | 102 | 12.12 | 33 | 16.67 | 36 | | 36 |
| 23580 | 10592 | | 23 | 24.68 | 77 | | 102 | 12.12 | 33 | 16.67 | 36 | | 36 |
| 23581 | 24511 | | 23 | 9.38 | 64 | 4.00 | 100 | 24.24 | 33 | 26.09 | 23 | 4.35 | 23 |
| 23584 | 24511 | | 23 | 9.38 | 64 | 4.00 | 100 | 24.24 | 33 | 26.09 | 23 | 4.35 | 23 |
| 23585 | 62233 | 30.43 | 23 | 31.58 | 19 | 7.22 | 97 | | | 16.67 | 18 | 5.56 | 18 |
| 23585 | 53177 | 30.43 | 23 | 20.00 | 75 | 7.84 | 102 | 30.30 | 33 | 28.57 | 35 | 5.56 | 36 |
| 23585 | 62233 | 30.43 | 23 | 31.58 | 19 | 7.22 | 97 | | | 16.67 | 18 | 5.56 | 18 |
| 23586 | 61035 | 17.39 | 23 | 15.79 | 19 | 22.68 | 97 | | | 5.56 | 18 | | 18 |
| 23586 | 61035 | 17.39 | 23 | 15.79 | 19 | 22.68 | 97 | | | 5.56 | 18 | | 18 |
| 23588 | 65344 | 21.74 | 23 | 31.58 | 19 | | 97 | | | 16.67 | 18 | | 18 |
| 23588 | 65344 | 21.74 | 23 | 31.58 | 19 | | 97 | | | 16.67 | 18 | | 18 |
| 23588 | 65344 | 21.74 | 23 | 31.58 | 19 | | 97 | | | 16.67 | 18 | | 18 |
| 23588 | 61198 | 21.74 | 23 | 10.53 | 19 | 2.06 | 97 | | | 11.11 | 18 | | 18 |
| 23588 | 61198 | 21.74 | 23 | 10.53 | 19 | 2.06 | 97 | | | 11.11 | 18 | | 18 |
| 23594 | 24403 | 8.70 | 23 | 40.63 | 64 | 4.00 | 100 | 48.48 | 33 | 43.48 | 23 | | 23 |
| 23594 | 24403 | 8.70 | 23 | 40.63 | 64 | 4.00 | 100 | 48.48 | 33 | 43.48 | 23 | | 23 |
| 23596 | 62019 | 30.43 | 23 | | 19 | | 97 | | | | 18 | | 18 |
| 23596 | 62019 | 30.43 | 23 | | 19 | | 97 | | | | 18 | | 18 |
| 23598 | 61000 | 26.09 | 23 | 5.26 | 19 | 32.99 | 97 | | | | 18 | 16.67 | 18 |
| 23598 | 61000 | 26.09 | 23 | 5.26 | 19 | 32.99 | 97 | | | | 18 | 16.67 | 18 |
| 23599 | 3835 | | 8 | 20.00 | 35 | 2.94 | 34 | 23.33 | 30 | 14.29 | 7 | | 7 |
| 23601 | 3835 | | 8 | 20.00 | 35 | 2.94 | 34 | 23.33 | 30 | 14.29 | 7 | | 7 |
| 23602 | 35056 | 4.35 | 23 | 30.67 | 75 | 1.96 | 102 | 54.55 | 33 | 36.11 | 36 | | 36 |
| 23603 | 24403 | 8.70 | 23 | 40.63 | 64 | 4.00 | 100 | 48.48 | 33 | 43.48 | 23 | | 23 |
| 23603 | 24403 | 8.70 | 23 | 40.63 | 64 | 4.00 | 100 | 48.48 | 33 | 43.48 | 23 | | 23 |
| 23605 | 61000 | 26.09 | 23 | 5.26 | 19 | 32.99 | 97 | | | | 18 | 16.67 | 18 |

TABLE 159-continued

| SEQ ID | SPOT ID | % Brst Pats | # Brst Pats | % Cln Pats | # Cln Pats | % Prst Pats | # Prst Pats | % Cln Unm Met | # Cln Unm Met Pats | % Cln Match Met | # Cln Match Met M/N Pats | % Cln Match Met M/T | % Cln Match Met M/T |
|---|---|---|---|---|---|---|---|---|---|---|---|---|---|
| 23605 | 61000 | 26.09 | 23 | 5.26 | 19 | 32.99 | 97 | | | | 18 | 16.67 | 18 |
| 23605 | 61000 | 26.09 | 23 | 5.26 | 19 | 32.99 | 97 | | | | 18 | 16.67 | 18 |
| 23605 | 61000 | 26.09 | 23 | 5.26 | 19 | 32.99 | 97 | | | | 18 | 16.67 | 18 |
| 23606 | 24511 | | 23 | 9.38 | 64 | 4.00 | 100 | 24.24 | 33 | 26.09 | 23 | 4.35 | 23 |
| 23607 | 65474 | 21.74 | 23 | 78.95 | 19 | 12.37 | 97 | | | 66.67 | 18 | | 18 |
| 23607 | 65474 | 21.74 | 23 | 78.95 | 19 | 12.37 | 97 | | | 66.67 | 18 | | 18 |
| 23614 | 62019 | 30.43 | 23 | | 19 | | 97 | | | | 18 | | 18 |
| 23614 | 62019 | 30.43 | 23 | | 19 | | 97 | | | | 18 | | 18 |
| 23615 | 51042 | 26.09 | 23 | 2.67 | 75 | 3.92 | 102 | 3.03 | 33 | | 35 | | 36 |
| 23615 | 51042 | 26.09 | 23 | 2.67 | 75 | 3.92 | 102 | 3.03 | 33 | | 35 | | 36 |
| 23630 | 37575 | 4.35 | 23 | 22.67 | 75 | 14.71 | 102 | | 33 | 36.11 | 36 | 5.56 | 36 |
| 23630 | 37575 | 4.35 | 23 | 22.67 | 75 | 14.71 | 102 | | 33 | 36.11 | 36 | 5.56 | 36 |
| 23646 | 1542 | | 8 | 54.29 | 35 | 20.59 | 34 | 40.00 | 30 | 57.14 | 7 | | 7 |
| 23646 | 1542 | | 8 | 54.29 | 35 | 20.59 | 34 | 40.00 | 30 | 57.14 | 7 | | 7 |
| 23646 | 46009 | | 23 | 30.26 | 76 | 8.82 | 102 | 21.21 | 33 | 51.43 | 35 | 5.56 | 36 |
| 23646 | 4066 | | 8 | 28.57 | 35 | 11.76 | 34 | 26.67 | 30 | 42.86 | 7 | | 7 |
| 23646 | 4066 | | 8 | 28.57 | 35 | 11.76 | 34 | 26.67 | 30 | 42.86 | 7 | | 7 |
| 23646 | 1542 | | 8 | 54.29 | 35 | 20.59 | 34 | 40.00 | 30 | 57.14 | 7 | | 7 |
| 23651 | 53177 | 30.43 | 23 | 20.00 | 75 | 7.84 | 102 | 30.30 | 33 | 28.57 | 35 | 5.56 | 36 |
| 23651 | 62233 | 30.43 | 23 | 31.58 | 19 | 7.22 | 97 | | | 16.67 | 18 | 5.56 | 18 |
| 23651 | 62233 | 30.43 | 23 | 31.58 | 19 | 7.22 | 97 | | | 16.67 | 18 | 5.56 | 18 |
| 23651 | 54930 | 21.74 | 23 | 16.00 | 75 | 9.80 | 102 | 21.21 | 33 | 25.71 | 35 | | 36 |
| 23654 | 61000 | 26.09 | 23 | 5.26 | 19 | 32.99 | 97 | | | | 18 | 16.67 | 18 |
| 23654 | 61000 | 26.09 | 23 | 5.26 | 19 | 32.99 | 97 | | | | 18 | 16.67 | 18 |
| 23654 | 61000 | 26.09 | 23 | 5.26 | 19 | 32.99 | 97 | | | | 18 | 16.67 | 18 |
| 23656 | 60741 | | 23 | 47.37 | 19 | 22.68 | 97 | | | 33.33 | 18 | | 18 |
| 23660 | 62615 | 21.74 | 23 | 15.79 | 19 | | 97 | | | 5.56 | 18 | 5.56 | 18 |
| 23660 | 62615 | 21.74 | 23 | 15.79 | 19 | | 97 | | | 5.56 | 18 | 5.56 | 18 |
| 23661 | 35056 | 4.35 | 23 | 30.67 | 75 | 1.96 | 102 | 54.55 | 33 | 36.11 | 36 | | 36 |
| 23666 | 61035 | 17.39 | 23 | 15.79 | 19 | 22.68 | 97 | | | 5.56 | 18 | | 18 |
| 23666 | 61035 | 17.39 | 23 | 15.79 | 19 | 22.68 | 97 | | | 5.56 | 18 | | 18 |
| 23667 | 10592 | | 23 | 24.68 | 77 | | 102 | 12.12 | 33 | 16.67 | 36 | | 36 |
| 23667 | 10592 | | 23 | 24.68 | 77 | | 102 | 12.12 | 33 | 16.67 | 36 | | 36 |
| 23673 | 24403 | 8.70 | 23 | 40.63 | 64 | 4.00 | 100 | 48.48 | 33 | 43.48 | 23 | | 23 |
| 23673 | 24403 | 8.70 | 23 | 40.63 | 64 | 4.00 | 100 | 48.48 | 33 | 43.48 | 23 | | 23 |
| 23676 | 24511 | | 23 | 9.38 | 64 | 4.00 | 100 | 24.24 | 33 | 26.09 | 23 | 4.35 | 23 |
| 23679 | 52789 | 17.39 | 23 | 6.67 | 75 | 4.90 | 102 | 21.21 | 33 | 8.57 | 35 | | 36 |
| 23681 | 35754 | | 23 | 20.00 | 75 | 2.94 | 102 | 30.30 | 33 | 36.11 | 36 | | 36 |
| 23681 | 36946 | | 23 | 24.00 | 75 | 1.96 | 102 | 18.18 | 33 | 30.56 | 36 | 2.78 | 36 |
| 23681 | 35754 | | 23 | 20.00 | 75 | 2.94 | 102 | 30.30 | 33 | 36.11 | 36 | | 36 |
| 23681 | 36946 | | 23 | 24.00 | 75 | 1.96 | 102 | 18.18 | 33 | 30.56 | 36 | 2.78 | 36 |
| 23681 | 34559 | | 23 | 30.67 | 75 | 1.96 | 102 | 30.30 | 33 | 33.33 | 36 | 5.56 | 36 |
| 23687 | 62019 | 30.43 | 23 | | 19 | | 97 | | | | 18 | | 18 |
| 23687 | 62019 | 30.43 | 23 | | 19 | | 97 | | | | 18 | | 18 |
| 23688 | 35056 | 4.35 | 23 | 30.67 | 75 | 1.96 | 102 | 54.55 | 33 | 36.11 | 36 | | 36 |
| 23698 | 65508 | 30.43 | 23 | | 19 | 12.37 | 97 | | | | 18 | | 18 |
| 23698 | 35939 | 26.09 | 23 | | 75 | 9.80 | 102 | | 33 | 8.33 | 36 | | 36 |
| 23698 | 55189 | 26.09 | 23 | 5.26 | 19 | 8.16 | 98 | | | | 17 | | 18 |
| 23698 | 65508 | 30.43 | 23 | | 19 | 12.37 | 97 | | | | 18 | | 18 |
| 23698 | 54046 | 26.09 | 23 | | 75 | 14.71 | 102 | 3.03 | 33 | | 35 | 2.78 | 36 |
| 23700 | 62439 | 21.74 | 23 | | 19 | | 97 | | | | 18 | | 18 |
| 23700 | 62439 | 21.74 | 23 | | 19 | | 97 | | | | 18 | | 18 |
| 23701 | 24511 | | 23 | 9.38 | 64 | 4.00 | 100 | 24.24 | 33 | 26.09 | 23 | 4.35 | 23 |
| 23702 | 61479 | 26.09 | 23 | 63.16 | 19 | 3.09 | 97 | | | 61.11 | 18 | | 18 |
| 23702 | 33688 | 17.39 | 23 | 21.05 | 76 | 0.98 | 102 | 15.15 | 33 | 34.29 | 35 | 2.78 | 36 |
| 23702 | 54586 | 17.39 | 23 | 12.00 | 75 | | 102 | 6.06 | 33 | 31.43 | 35 | | 36 |
| 23702 | 51783 | 21.74 | 23 | 38.67 | 75 | 1.96 | 102 | 30.30 | 33 | 57.14 | 35 | | 36 |
| 23702 | 17831 | 22.22 | 18 | 39.02 | 41 | 1.56 | 64 | 40.00 | 30 | 54.55 | 11 | 9.09 | 11 |
| 23704 | 60458 | 4.35 | 23 | 57.89 | 19 | 25.77 | 97 | | | 61.11 | 18 | | 18 |
| 23704 | 60458 | 4.35 | 23 | 57.89 | 19 | 25.77 | 97 | | | 61.11 | 18 | | 18 |
| 23704 | 60458 | 4.35 | 23 | 57.89 | 19 | 25.77 | 97 | | | 61.11 | 18 | | 18 |
| 23704 | 60458 | 4.35 | 23 | 57.89 | 19 | 25.77 | 97 | | | 61.11 | 18 | | 18 |
| 23706 | 24511 | | 23 | 9.38 | 64 | 4.00 | 100 | 24.24 | 33 | 26.09 | 23 | 4.35 | 23 |
| 23707 | 24511 | | 23 | 9.38 | 64 | 4.00 | 100 | 24.24 | 33 | 26.09 | 23 | 4.35 | 23 |
| 23712 | 24511 | | 23 | 9.38 | 64 | 4.00 | 100 | 24.24 | 33 | 26.09 | 23 | 4.35 | 23 |
| 23713 | 51042 | 26.09 | 23 | 2.67 | 75 | 3.92 | 102 | 3.03 | 33 | | 35 | | 36 |
| 23713 | 51042 | 26.09 | 23 | 2.67 | 75 | 3.92 | 102 | 3.03 | 33 | | 35 | | 36 |
| 23715 | 24511 | | 23 | 9.38 | 64 | 4.00 | 100 | 24.24 | 33 | 26.09 | 23 | 4.35 | 23 |
| 23717 | 24511 | | 23 | 9.38 | 64 | 4.00 | 100 | 24.24 | 33 | 26.09 | 23 | 4.35 | 23 |
| 23718 | 62439 | 21.74 | 23 | | 19 | | 97 | | | | 18 | | 18 |
| 23718 | 62439 | 21.74 | 23 | | 19 | | 97 | | | | 18 | | 18 |
| 23719 | 9191 | 21.74 | 23 | 55.84 | 77 | 3.92 | 102 | 39.39 | 33 | 58.33 | 36 | 11.11 | 36 |
| 23727 | 11583 | 21.74 | 23 | 44.16 | 77 | 1.96 | 102 | 27.27 | 33 | 66.67 | 36 | 2.78 | 36 |
| 23727 | 37868 | 26.09 | 23 | 49.33 | 75 | 4.90 | 102 | 36.36 | 33 | 55.56 | 36 | 5.56 | 36 |

TABLE 159-continued

| SEQ ID | SPOT ID | % Brst Pats | # Brst Pats | % Cln Pats | # Cln Pats | % Prst Pats | # Prst Pats | % Cln Unm Met | # Cln Unm Met Pats | % Cln Match Met | # Cln Match Met M/N Pats | % Cln Match Met M/T | % Cln Match Met M/T |
|---|---|---|---|---|---|---|---|---|---|---|---|---|---|
| 23727 | 37868 | 26.09 | 23 | 49.33 | 75 | 4.90 | 102 | 36.36 | 33 | 55.56 | 36 | 5.56 | 36 |
| 23727 | 35285 | 30.43 | 23 | 56.00 | 75 | 2.94 | 102 | 33.33 | 33 | 52.78 | 36 | 8.33 | 36 |
| 23727 | 35285 | 30.43 | 23 | 56.00 | 75 | 2.94 | 102 | 33.33 | 33 | 52.78 | 36 | 8.33 | 36 |
| 23727 | 11583 | 21.74 | 23 | 44.16 | 77 | 1.96 | 102 | 27.27 | 33 | 66.67 | 36 | 2.78 | 36 |
| 23733 | 9191 | 21.74 | 23 | 55.84 | 77 | 3.92 | 102 | 39.39 | 33 | 58.33 | 36 | 11.11 | 36 |
| 23737 | 62615 | 21.74 | 23 | 15.79 | 19 | | 97 | | | 5.56 | 18 | 5.56 | 18 |
| 23737 | 62615 | 21.74 | 23 | 15.79 | 19 | | 97 | | | 5.56 | 18 | 5.56 | 18 |
| 23741 | 63119 | 26.09 | 23 | | 19 | 1.03 | 97 | | | | 18 | 22.22 | 18 |
| 23741 | 63119 | 26.09 | 23 | | 19 | 1.03 | 97 | | | | 18 | 22.22 | 18 |
| 23746 | 24511 | | 23 | 9.38 | 64 | 4.00 | 100 | 24.24 | 33 | 26.09 | 23 | 4.35 | 23 |
| 23749 | 24511 | | 23 | 9.38 | 64 | 4.00 | 100 | 24.24 | 33 | 26.09 | 23 | 4.35 | 23 |
| 23757 | 60741 | | 23 | 47.37 | 19 | 22.68 | 97 | | | 33.33 | 18 | | 18 |
| 23759 | 9191 | 21.74 | 23 | 55.84 | 77 | 3.92 | 102 | 39.39 | 33 | 58.33 | 36 | 11.11 | 36 |
| 23761 | 64570 | 4.35 | 23 | | 19 | 20.62 | 97 | | | 5.56 | 18 | 16.67 | 18 |
| 23761 | 64570 | 4.35 | 23 | | 19 | 20.62 | 97 | | | 5.56 | 18 | 16.67 | 18 |
| 23763 | 4066 | | 8 | 28.57 | 35 | 11.76 | 34 | 26.67 | 30 | 42.86 | 7 | | 7 |
| 23763 | 4066 | | 8 | 28.57 | 35 | 11.76 | 34 | 26.67 | 30 | 42.86 | 7 | | 7 |
| 23763 | 46009 | | 23 | 30.26 | 76 | 8.82 | 102 | 21.21 | 33 | 51.43 | 35 | 5.56 | 36 |
| 23763 | 1542 | | 8 | 54.29 | 35 | 20.59 | 34 | 40.00 | 30 | 57.14 | 7 | | 7 |
| 23763 | 1542 | | 8 | 54.29 | 35 | 20.59 | 34 | 40.00 | 30 | 57.14 | 7 | | 7 |
| 23763 | 1542 | | 8 | 54.29 | 35 | 20.59 | 34 | 40.00 | 30 | 57.14 | 7 | | 7 |
| 23764 | 24511 | | 23 | 9.38 | 64 | 4.00 | 100 | 24.24 | 33 | 26.09 | 23 | 4.35 | 23 |
| 23765 | 24403 | 8.70 | 23 | 40.63 | 64 | 4.00 | 100 | 48.48 | 33 | 43.48 | 23 | | 23 |
| 23765 | 24403 | 8.70 | 23 | 40.63 | 64 | 4.00 | 100 | 48.48 | 33 | 43.48 | 23 | | 23 |
| 23767 | 61035 | 17.39 | 23 | 15.79 | 19 | 22.68 | 97 | | | 5.56 | 18 | | 18 |
| 23767 | 61035 | 17.39 | 23 | 15.79 | 19 | 22.68 | 97 | | | 5.56 | 18 | | 18 |

TABLE 160

| Seq Id | PROBESET Id | % Breast T/N >= 2x | Breast T/N Patients | % Colon M/N >= 2x | Colon M/N Patients |
|---|---|---|---|---|---|
| 23569 | 3323 | 24.44 | 45 | 44.83 | 29 |
| 23570 | 47141 | 100.00 | 12 | 100.00 | 11 |
| 23571 | 22807 | 20.83 | 48 | 100.00 | 23 |
| 23572 | 47166 | 100.00 | 3 | 8.33 | 12 |
| 23573 | 47170 | 100.00 | 7 | 100.00 | 10 |
| 23573 | 47170 | 100.00 | 7 | 100.00 | 10 |
| 23573 | 47170 | 100.00 | 7 | 100.00 | 10 |
| 23574 | 54439 | 100.00 | 1 | | 15 |
| 23575 | 3323 | 24.44 | 45 | 44.83 | 29 |
| 23578 | 47204 | 100.00 | 21 | | 27 |
| 23581 | 7337 | 16.67 | 18 | 100.00 | 14 |
| 23582 | 9348 | 52.27 | 44 | 9.52 | 21 |
| 23583 | 55586 | 100.00 | 4 | 100.00 | 4 |
| 23584 | 7337 | 16.67 | 18 | 100.00 | 14 |
| 23587 | 48770 | 100.00 | 3 | 21.43 | 28 |
| 23589 | 26738 | 56.00 | 25 | | |
| 23589 | 26738 | 56.00 | 25 | | |
| 23589 | 26738 | 56.00 | 25 | | |
| 23589 | 26738 | 56.00 | 25 | | |
| 23590 | 48850 | 4.00 | 25 | 50.00 | 4 |
| 23591 | 35733 | 100.00 | 1 | 77.27 | 22 |
| 23591 | 35733 | 100.00 | 1 | 77.27 | 22 |
| 23592 | 25507 | 100.00 | 22 | 18.52 | 27 |
| 23593 | 48810 | 100.00 | 4 | | 28 |
| 23595 | 35493 | 48.00 | 50 | 3.45 | 29 |
| 23595 | 35493 | 48.00 | 50 | 3.45 | 29 |
| 23596 | 55391 | 16.28 | 43 | 100.00 | 1 |
| 23597 | 48850 | 4.00 | 25 | 50.00 | 4 |
| 23600 | 48901 | 10.00 | 20 | 100.00 | 11 |
| 23600 | 48901 | 10.00 | 20 | 100.00 | 11 |
| 23604 | 47395 | 100.00 | 1 | | |
| 23606 | 7337 | 16.67 | 18 | 100.00 | 14 |
| 23608 | 35013 | | 44 | 100.00 | 10 |
| 23608 | 35013 | | 44 | 100.00 | 10 |
| 23609 | 35493 | 48.00 | 50 | 3.45 | 29 |
| 23609 | 35493 | 48.00 | 50 | 3.45 | 29 |
| 23610 | 15407 | 100.00 | 24 | 3.85 | 26 |
| 23610 | 15407 | 100.00 | 24 | 3.85 | 26 |
| 23610 | 15407 | 100.00 | 24 | 3.85 | 26 |
| 23611 | 15407 | 100.00 | 24 | 3.85 | 26 |
| 23611 | 15407 | 100.00 | 24 | 3.85 | 26 |
| 23611 | 15407 | 100.00 | 24 | 3.85 | 26 |
| 23611 | 15407 | 100.00 | 24 | 3.85 | 26 |
| 23612 | 15407 | 100.00 | 24 | 3.85 | 26 |
| 23612 | 15407 | 100.00 | 24 | 3.85 | 26 |
| 23613 | 15407 | 100.00 | 24 | 3.85 | 26 |
| 23613 | 15407 | 100.00 | 24 | 3.85 | 26 |
| 23613 | 15407 | 100.00 | 24 | 3.85 | 26 |
| 23613 | 15407 | 100.00 | 24 | 3.85 | 26 |
| 23613 | 15407 | 100.00 | 24 | 3.85 | 26 |
| 23613 | 15407 | 100.00 | 24 | 3.85 | 26 |
| 23614 | 55391 | 16.28 | 43 | 100.00 | 1 |
| 23616 | 15407 | 100.00 | 24 | 3.85 | 26 |
| 23616 | 15407 | 100.00 | 24 | 3.85 | 26 |
| 23616 | 15407 | 100.00 | 24 | 3.85 | 26 |
| 23616 | 15407 | 100.00 | 24 | 3.85 | 26 |
| 23617 | 15407 | 100.00 | 24 | 3.85 | 26 |
| 23617 | 15407 | 100.00 | 24 | 3.85 | 26 |
| 23617 | 15407 | 100.00 | 24 | 3.85 | 26 |
| 23618 | 15407 | 100.00 | 24 | 3.85 | 26 |
| 23618 | 15407 | 100.00 | 24 | 3.85 | 26 |
| 23618 | 15407 | 100.00 | 24 | 3.85 | 26 |
| 23618 | 15407 | 100.00 | 24 | 3.85 | 26 |
| 23618 | 15407 | 100.00 | 24 | 3.85 | 26 |
| 23619 | 15407 | 100.00 | 24 | 3.85 | 26 |
| 23619 | 15407 | 100.00 | 24 | 3.85 | 26 |
| 23619 | 15407 | 100.00 | 24 | 3.85 | 26 |
| 23619 | 15407 | 100.00 | 24 | 3.85 | 26 |
| 23620 | 15407 | 100.00 | 24 | 3.85 | 26 |
| 23620 | 15407 | 100.00 | 24 | 3.85 | 26 |
| 23620 | 15407 | 100.00 | 24 | 3.85 | 26 |
| 23620 | 15407 | 100.00 | 24 | 3.85 | 26 |
| 23621 | 15407 | 100.00 | 24 | 3.85 | 26 |
| 23621 | 15407 | 100.00 | 24 | 3.85 | 26 |
| 23621 | 15407 | 100.00 | 24 | 3.85 | 26 |

TABLE 160-continued

| Seq Id | PROBESET Id | % Breast T/N >= 2x | Breast T/N Patients | % Colon M/N >= 2x | Colon M/N Patients |
|---|---|---|---|---|---|
| 23621 | 15407 | 100.00 | 24 | 3.85 | 26 |
| 23621 | 15407 | 100.00 | 24 | 3.85 | 26 |
| 23621 | 15407 | 100.00 | 24 | 3.85 | 26 |
| 23621 | 15407 | 100.00 | 24 | 3.85 | 26 |
| 23621 | 15407 | 100.00 | 24 | 3.85 | 26 |
| 23622 | 15407 | 100.00 | 24 | 3.85 | 26 |
| 23622 | 15407 | 100.00 | 24 | 3.85 | 26 |
| 23623 | 15407 | 100.00 | 24 | 3.85 | 26 |
| 23623 | 15407 | 100.00 | 24 | 3.85 | 26 |
| 23623 | 15407 | 100.00 | 24 | 3.85 | 26 |
| 23624 | 15407 | 100.00 | 24 | 3.85 | 26 |
| 23624 | 15407 | 100.00 | 24 | 3.85 | 26 |
| 23624 | 15407 | 100.00 | 24 | 3.85 | 26 |
| 23625 | 14582 | 100.00 | 5 | 42.86 | 28 |
| 23625 | 14582 | 100.00 | 5 | 42.86 | 28 |
| 23626 | 15407 | 100.00 | 24 | 3.85 | 26 |
| 23626 | 15407 | 100.00 | 24 | 3.85 | 26 |
| 23626 | 15407 | 100.00 | 24 | 3.85 | 26 |
| 23626 | 15407 | 100.00 | 24 | 3.85 | 26 |
| 23626 | 15407 | 100.00 | 24 | 3.85 | 26 |
| 23626 | 15407 | 100.00 | 24 | 3.85 | 26 |
| 23627 | 47141 | 100.00 | 12 | 100.00 | 11 |
| 23628 | 15407 | 100.00 | 24 | 3.85 | 26 |
| 23628 | 15407 | 100.00 | 24 | 3.85 | 26 |
| 23628 | 15407 | 100.00 | 24 | 3.85 | 26 |
| 23628 | 15407 | 100.00 | 24 | 3.85 | 26 |
| 23629 | 54439 | 100.00 | 1 | | 15 |
| 23631 | 15407 | 100.00 | 24 | 3.85 | 26 |
| 23631 | 15407 | 100.00 | 24 | 3.85 | 26 |
| 23631 | 15407 | 100.00 | 24 | 3.85 | 26 |
| 23631 | 15407 | 100.00 | 24 | 3.85 | 26 |
| 23631 | 15407 | 100.00 | 24 | 3.85 | 26 |
| 23632 | 3323 | 24.44 | 45 | 44.83 | 29 |
| 23633 | 47409 | | | 50.00 | 4 |
| 23634 | 47170 | 100.00 | 7 | 100.00 | 10 |
| 23634 | 47170 | 100.00 | 7 | 100.00 | 10 |
| 23634 | 47170 | 100.00 | 7 | 100.00 | 10 |
| 23635 | 15407 | 100.00 | 24 | 3.85 | 26 |
| 23635 | 15407 | 100.00 | 24 | 3.85 | 26 |
| 23635 | 15407 | 100.00 | 24 | 3.85 | 26 |
| 23635 | 15407 | 100.00 | 24 | 3.85 | 26 |
| 23635 | 15407 | 100.00 | 24 | 3.85 | 26 |
| 23635 | 15407 | 100.00 | 24 | 3.85 | 26 |
| 23636 | 35733 | 100.00 | 1 | 77.27 | 22 |
| 23636 | 35733 | 100.00 | 1 | 77.27 | 22 |
| 23637 | 47589 | 46.51 | 43 | 9.09 | 22 |
| 23638 | 47395 | 100.00 | 1 | | |
| 23639 | 15407 | 100.00 | 24 | 3.85 | 26 |
| 23639 | 15407 | 100.00 | 24 | 3.85 | 26 |
| 23639 | 15407 | 100.00 | 24 | 3.85 | 26 |
| 23640 | 15407 | 100.00 | 24 | 3.85 | 26 |
| 23640 | 15407 | 100.00 | 24 | 3.85 | 26 |
| 23640 | 15407 | 100.00 | 24 | 3.85 | 26 |
| 23641 | 15407 | 100.00 | 24 | 3.85 | 26 |
| 23641 | 15407 | 100.00 | 24 | 3.85 | 26 |
| 23641 | 15407 | 100.00 | 24 | 3.85 | 26 |
| 23641 | 15407 | 100.00 | 24 | 3.85 | 26 |
| 23642 | 52781 | 100.00 | 19 | | 27 |
| 23643 | 15407 | 100.00 | 24 | 3.85 | 26 |
| 23643 | 15407 | 100.00 | 24 | 3.85 | 26 |
| 23643 | 15407 | 100.00 | 24 | 3.85 | 26 |
| 23643 | 15407 | 100.00 | 24 | 3.85 | 26 |
| 23644 | 15407 | 100.00 | 24 | 3.85 | 26 |
| 23644 | 15407 | 100.00 | 24 | 3.85 | 26 |
| 23644 | 15407 | 100.00 | 24 | 3.85 | 26 |
| 23644 | 15407 | 100.00 | 24 | 3.85 | 26 |
| 23645 | 15407 | 100.00 | 24 | 3.85 | 26 |
| 23645 | 15407 | 100.00 | 24 | 3.85 | 26 |
| 23645 | 15407 | 100.00 | 24 | 3.85 | 26 |
| 23647 | 22180 | 100.00 | 5 | | |
| 23647 | 22180 | 100.00 | 5 | | |
| 23648 | 15407 | 100.00 | 24 | 3.85 | 26 |
| 23648 | 15407 | 100.00 | 24 | 3.85 | 26 |
| 23648 | 15407 | 100.00 | 24 | 3.85 | 26 |
| 23648 | 15407 | 100.00 | 24 | 3.85 | 26 |
| 23648 | 15407 | 100.00 | 24 | 3.85 | 26 |
| 23648 | 15407 | 100.00 | 24 | 3.85 | 26 |
| 23649 | 15407 | 100.00 | 24 | 3.85 | 26 |
| 23649 | 15407 | 100.00 | 24 | 3.85 | 26 |
| 23649 | 15407 | 100.00 | 24 | 3.85 | 26 |
| 23649 | 15407 | 100.00 | 24 | 3.85 | 26 |
| 23649 | 15407 | 100.00 | 24 | 3.85 | 26 |
| 23650 | 15407 | 100.00 | 24 | 3.85 | 26 |
| 23650 | 15407 | 100.00 | 24 | 3.85 | 26 |
| 23650 | 15407 | 100.00 | 24 | 3.85 | 26 |
| 23650 | 15407 | 100.00 | 24 | 3.85 | 26 |
| 23652 | 26408 | 16.00 | 50 | 56.00 | 25 |
| 23652 | 26408 | 16.00 | 50 | 56.00 | 25 |
| 23653 | 19860 | 16.33 | 49 | 65.52 | 29 |
| 23655 | 47444 | | | 44 | 74.07 | 27 |
| 23657 | 38650 | 24.14 | 29 | 100.00 | 1 |
| 23657 | 38650 | 24.14 | 29 | 100.00 | 1 |
| 23658 | 29692 | 100.00 | 12 | | 16 |
| 23658 | 29692 | 100.00 | 12 | | 16 |
| 23659 | 35013 | | | 44 | 100.00 | 10 |
| 23659 | 35013 | | | 44 | 100.00 | 10 |
| 23662 | 47338 | 100.00 | 2 | 25.00 | 4 |
| 23663 | 48850 | 4.00 | 25 | 50.00 | 4 |
| 23664 | 54961 | 100.00 | 28 | 7.14 | 28 |
| 23665 | 26394 | 68.00 | 50 | 34.48 | 29 |
| 23668 | 15407 | 100.00 | 24 | 3.85 | 26 |
| 23668 | 15407 | 100.00 | 24 | 3.85 | 26 |
| 23668 | 15407 | 100.00 | 24 | 3.85 | 26 |
| 23668 | 15407 | 100.00 | 24 | 3.85 | 26 |
| 23668 | 15407 | 100.00 | 24 | 3.85 | 26 |
| 23668 | 15407 | 100.00 | 24 | 3.85 | 26 |
| 23668 | 15407 | 100.00 | 24 | 3.85 | 26 |
| 23668 | 15407 | 100.00 | 24 | 3.85 | 26 |
| 23668 | 15407 | 100.00 | 24 | 3.85 | 26 |
| 23669 | 15407 | 100.00 | 24 | 3.85 | 26 |
| 23669 | 15407 | 100.00 | 24 | 3.85 | 26 |
| 23669 | 15407 | 100.00 | 24 | 3.85 | 26 |
| 23670 | 15407 | 100.00 | 24 | 3.85 | 26 |
| 23670 | 15407 | 100.00 | 24 | 3.85 | 26 |
| 23671 | 15407 | 100.00 | 24 | 3.85 | 26 |
| 23671 | 15407 | 100.00 | 24 | 3.85 | 26 |
| 23671 | 15407 | 100.00 | 24 | 3.85 | 26 |
| 23672 | 15407 | 100.00 | 24 | 3.85 | 26 |
| 23672 | 15407 | 100.00 | 24 | 3.85 | 26 |
| 23672 | 15407 | 100.00 | 24 | 3.85 | 26 |
| 23672 | 15407 | 100.00 | 24 | 3.85 | 26 |
| 23672 | 15407 | 100.00 | 24 | 3.85 | 26 |
| 23674 | 55038 | 100.00 | 8 | 6.67 | 15 |
| 23675 | 48810 | 100.00 | 4 | | 28 |
| 23677 | 15407 | 100.00 | 24 | 3.85 | 26 |
| 23677 | 15407 | 100.00 | 24 | 3.85 | 26 |
| 23678 | 15407 | 100.00 | 24 | 3.85 | 26 |
| 23678 | 15407 | 100.00 | 24 | 3.85 | 26 |
| 23678 | 15407 | 100.00 | 24 | 3.85 | 26 |
| 23678 | 15407 | 100.00 | 24 | 3.85 | 26 |
| 23680 | 47668 | 39.53 | 43 | 50.00 | 28 |
| 23682 | 47958 | | | 42 | 77.78 | 27 |
| 23683 | 47166 | 100.00 | 3 | 8.33 | 12 |
| 23718 | 52866 | 18.18 | 44 | 87.50 | 8 |
| 23719 | 3323 | 24.44 | 45 | 44.83 | 29 |
| 23720 | 48070 | 100.00 | 2 | 16.67 | 18 |
| 23721 | 35493 | 48.00 | 50 | 3.45 | 29 |

TABLE 160-continued

| Seq Id | PROBESET Id | % Breast T/N >= 2x | Breast T/N Patients | % Colon M/N >= 2x | Colon M/N Patients |
|---|---|---|---|---|---|
| 23721 | 35493 | 48.00 | 50 | 3.45 | 29 |
| 23722 | 15407 | 100.00 | 24 | 3.85 | 26 |
| 23722 | 15407 | 100.00 | 24 | 3.85 | 26 |
| 23722 | 15407 | 100.00 | 24 | 3.85 | 26 |
| 23722 | 15407 | 100.00 | 24 | 3.85 | 26 |
| 23722 | 15407 | 100.00 | 24 | 3.85 | 26 |
| 23723 | 3323 | 24.44 | 45 | 44.83 | 29 |
| 23724 | 55586 | 100.00 | 4 | 100.00 | 4 |
| 23725 | 15407 | 100.00 | 24 | 3.85 | 26 |
| 23725 | 15407 | 100.00 | 24 | 3.85 | 26 |
| 23725 | 15407 | 100.00 | 24 | 3.85 | 26 |
| 23725 | 15407 | 100.00 | 24 | 3.85 | 26 |
| 23725 | 15407 | 100.00 | 24 | 3.85 | 26 |
| 23726 | 48510 | 100.00 | 6 | 3.57 | 28 |
| 23728 | 28027 | 26.09 | 46 | 4.35 | 23 |
| 23728 | 28027 | 26.09 | 46 | 4.35 | 23 |
| 23729 | 14582 | 100.00 | 5 | 42.86 | 28 |
| 23729 | 14582 | 100.00 | 5 | 42.86 | 28 |
| 23730 | 26408 | 16.00 | 50 | 56.00 | 25 |
| 23731 | 47395 | 100.00 | 1 | | |
| 23732 | 47409 | | | 50.00 | 4 |
| 23733 | 3323 | 24.44 | 45 | 44.83 | 29 |
| 23734 | 47444 | | 44 | 74.07 | 27 |
| 23735 | 22963 | | | 100.00 | 1 |
| 23736 | 3323 | 24.44 | 45 | 44.83 | 29 |
| 23684 | 48850 | 4.00 | 25 | 50.00 | 4 |
| 23685 | 20206 | 100.00 | 4 | | 22 |
| 23686 | 35206 | | 47 | 100.00 | 2 |
| 23687 | 55391 | 16.28 | 43 | 100.00 | 1 |
| 23689 | 28027 | 26.09 | 46 | 4.35 | 23 |
| 23689 | 28027 | 26.09 | 46 | 4.35 | 23 |
| 23689 | 28027 | 26.09 | 46 | 4.35 | 23 |
| 23690 | 47589 | 46.51 | 43 | 9.09 | 22 |
| 23691 | 47170 | 100.00 | 7 | 100.00 | 10 |
| 23691 | 47170 | 100.00 | 7 | 100.00 | 10 |
| 23692 | 47615 | 34.09 | 44 | 100.00 | 17 |
| 23693 | 14582 | 100.00 | 5 | 42.86 | 28 |
| 23693 | 14582 | 100.00 | 5 | 42.86 | 28 |
| 23694 | 47644 | 100.00 | 6 | 25.93 | 27 |
| 23695 | 47589 | 46.51 | 43 | 9.09 | 22 |
| 23696 | 54439 | 100.00 | 1 | | 15 |
| 23697 | 47682 | 31.58 | 19 | 50.00 | 16 |
| 23697 | 47682 | 31.58 | 19 | 50.00 | 16 |
| 23699 | 47409 | | | 50.00 | 4 |
| 23700 | 52866 | 18.18 | 44 | 87.50 | 8 |
| 23738 | 52781 | 100.00 | 19 | | 27 |
| 23739 | 3308 | 50.00 | 16 | | 29 |
| 23740 | 47958 | | 42 | 77.78 | 27 |
| 23742 | 47958 | | 42 | 77.78 | 27 |
| 23743 | 9939 | 100.00 | 2 | | 29 |
| 23744 | 47958 | | 42 | 77.78 | 27 |
| 23745 | 48510 | 100.00 | 6 | 3.57 | 28 |
| 23746 | 7337 | 16.67 | 18 | 100.00 | 14 |
| 23747 | 48070 | 100.00 | 2 | 16.67 | 18 |
| 23748 | 48510 | 100.00 | 6 | 3.57 | 28 |
| 23749 | 7337 | 16.67 | 18 | 100.00 | 14 |
| 23750 | 22180 | 100.00 | 5 | | |
| 23750 | 22180 | 100.00 | 5 | | |
| 23751 | 47170 | 100.00 | 7 | 100.00 | 10 |
| 23751 | 47170 | 100.00 | 7 | 100.00 | 10 |
| 23752 | 35682 | 100.00 | 6 | | 29 |
| 23753 | 48220 | 100.00 | 6 | 3.57 | 28 |
| 23701 | 7337 | 16.67 | 18 | 100.00 | 14 |
| 23703 | 48261 | 100.00 | 3 | 100.00 | 1 |
| 23705 | 54961 | 100.00 | 28 | 7.14 | 28 |
| 23707 | 7337 | 16.67 | 18 | 100.00 | 14 |
| 23708 | 54795 | 100.00 | 1 | 100.00 | 1 |
| 23709 | 52709 | 100.00 | 4 | 100.00 | 4 |
| 23710 | 48510 | 100.00 | 6 | 3.57 | 28 |
| 23711 | 4308 | | | 100.00 | 2 |
| 23714 | 55038 | 100.00 | 8 | 6.67 | 15 |
| 23716 | 35013 | | 44 | 100.00 | 10 |
| 23716 | 35013 | | 44 | 100.00 | 10 |
| 23754 | 54961 | 100.00 | 28 | 7.14 | 28 |
| 23755 | 52781 | 100.00 | 19 | | 27 |
| 23756 | 48510 | 100.00 | 6 | 3.57 | 28 |
| 23758 | 19201 | | 30 | 44.44 | 9 |
| 23759 | 3323 | 24.44 | 45 | 44.83 | 29 |
| 23760 | 48580 | 100.00 | 4 | | 26 |
| 23762 | 55038 | 100.00 | 8 | 6.67 | 15 |
| 23766 | 48716 | | | 100.00 | 6 |

Those skilled in the art will recognize, or be able to ascertain, using not more than routine experimentation, many equivalents to the specific embodiments of the invention described herein. Such specific embodiments and equivalents are intended to be encompassed by the following claims.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

SEQUENCE LISTING (23767 sequences)

SEQ ID NO: 1 - DNA, 300 bp, Homo sapiens
  misc_feature 63: n = A,T,C or G
tctcccctgagctgcaggcctgcatatccagtaggtctactggacatctgtactggttgttgnggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagat

SEQ ID NO: 2 - DNA, 299 bp, Homo sapiens
  misc_feature 149, 150, 151, 152, 153, 154, 155, 156, 157, 158, 159, 160,161, 162, 163, 164, 165, 166, 167, 168, 169, 170, 171, 172,173, 176, 185, 187, 197, 200, 219, 220, 222, 223, 228, 232,236, 238, 239, 242, 247, 251, 252, 253, 254, 256, 260: n = A,T,C or G
  misc_feature 268, 279, 285, 289: n = A,T,C or G
cccagctgctcaggaggctgaggcaggagaattgcttgaacccaagaggcggaggttgtggtgagccgagattgcacctttgtactccagcctgggcaacgagcaaaaaactctgtctcaaacaaaaagaagaaaaaaaaaaaaaaaannnnnnnnnnnnnnnnnnnnnnnnnttnttctggcgncnagtcccaaantcntaccttgtaagacctttanntnncctgnggtntttntnnacncttanatannnntntttnctatcaantatagggaganttttcntttnggggcaactt

SEQ ID NO: 3 - DNA, 300 bp, Homo sapiens
  misc_feature 14, 15, 47, 48, 49, 63, 71, 73, 79, 93, 104, 112, 115, 117,122, 123, 153, 161, 168, 171, 197, 201, 208, 209, 212, 218,220, 222, 229, 234, 239, 251, 254, 256, 258, 259, 262, 263,270, 273, 276, 279, 280, 281, 290, 291: n = A,T,C or G
atacgattcgaacnnggacaagacgagtatggaataatatcccactnnntttacaatactganattatgcngngatagngcttgttccattcnaccagcgaatnatgcattnacncnacacnngagttactatccaaacacacgttttcacgntacctgangctggtnganaattatgcgaccatgaggctttccangatntttctanntancagacngngnacaatgntgaanaagcngtacacaccgcnctngncnnccnncactgancangtnacnnngctcactgnngcctctttc

SEQ ID NO: 4 - DNA, 287 bp, Homo sapiens
  misc_feature 4, 6, 13, 21, 24, 25, 26, 27, 29, 31, 32, 37, 38, 39, 41,44, 48, 50, 54, 59, 61, 84, 87, 91, 94, 96, 97, 103, 106,110, 115, 117, 118, 122, 137, 149, 150, 156, 158, 159, 160,161, 163, 196, 202, 203, 219, 221, 229, 234, 236, 247: n = A,T,C or G
  misc_feature 249, 262, 267, 278: n = A,T,C or G
aaancngcacgangccacgtncgnnnngntnntactnnncnatngccncntcantggcngncagctagacgcctaacagccganganccanccntnntgtganccngtcntgacngnnagcntgccggtcttgctcnttttgtctaccnngagganannnntntgggacatcccagactgagtgaggagatctgcngctgcnnctgtacttggttacancncacacgangactntnccttggactananacactagcctaanattcngcactacctantcctctggc

SEQ ID NO: 5 - DNA, 300 bp, Homo sapiens
gtccttttgaaccaccccaaagaactcaacatggcaaagcaaatggtaaaagcttcccgactgttctactttgggtccgcgcgaagcccactcacgtgtgatctgtgttgcccctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgc

SEQ ID NO: 6 - DNA, 284 bp, Homo sapiens
  misc_feature 2, 20, 27, 28, 35, 36, 41, 60, 63, 70, 81, 82, 86, 94, 96,104, 106, 109, 110, 113, 114, 119, 127, 137, 149, 151, 158,163, 168, 172, 177, 185, 203, 208, 231, 234, 237, 250, 252,257, 259, 263, 265, 272: n = A,T,C or G
tntcccctttgacgccttantgccctnncgctacnngtccnttaggccttatcccatcgnccntcgtttngcattctgccnnagantgactttncnatcatgcntnatnngtnnttacnaggggctngggtgaattnttacaccctgcnantccatancacantgccntgcnagctncaccctcntgaataaatgcaataaantttcngttgatcttatacaccttatgcnccntanttaatcagccctntnttacnanatcnanttatgcnggtattaaaaca

SEQ ID NO: 7 - DNA, 277 bp, Homo sapiens
  misc_feature 135, 136, 137, 138, 139, 140, 141, 142, 143, 144, 145, 146,147, 148, 149, 150, 151, 152, 153, 163, 171, 175, 190, 192,197, 200, 201, 234, 241, 244, 249, 255, 256, 271, 272: n = A,T,C or G
gtgctgcagacaacacaccttcctgatggaggtgtccggctgatggagaagtctgtgggcttgtaaatcatctttgatgttaaccaggccgacgctgtggccacattccgaaagattaaccctgtcaaaccctannnnnnnnnnnnnnnnnnnggatttgatnagcctgtnccanacctctgcagcctcnancggtngtnntaccatagtggggatgaccctctgatactttgncctggtngancatgntgacanntgcttctacagcttnngggac

SEQ ID NO: 8 - DNA, 292 bp, Homo sapiens
  misc_feature 189, 190, 191, 192, 193, 194, 195, 196, 197, 198, 199, 200,215, 230, 239, 249, 254, 263, 275, 276, 278, 283: n = A,T,C or G
cttgggaggctgagtcaggagaattgcttgagcccaggagatggaggttgcagtgagccaagatcatgccactgcactccagactgggcaacagagggagactccgtctcaaaaactaaaaaaaaaaatacatttagtatagcggggggtgggcgggagaaataatgttatttcctatgcaaatgacgnnnnnnnnnnnncccatggtaaatgtnaatatactgcgtctnttttggganagccttttantaaangagtcttanatgaatctctanntnatgantttaacttg

SEQ ID NO: 9 - DNA, 300 bp, Homo sapiens
ccaggttagctgctgaatcaaagcttcaaacagaagttaaagaaggaaaagaaacttcaagcaaattggaaaaagaaacttgtaagaaatcacaccctattctatatgtgtcttctaaatctactccagagacccagtgccctcaacagtaaagacttttctttaataagagtacggtgccacttgcctcaaaagttactatggtgcttaagattgtcttgatctgacatatatcaccttctgggttatttactcattgtgccaggacctggcattttcatgtgcctttgaccaagtgtt

SEQ ID NO: 10 - DNA, 300 bp, Homo sapiens
  misc_feature 91, 92, 93, 94, 95, 96, 97, 98, 99, 100, 101, 102, 103, 104,105, 106, 107, 108, 111, 117, 120, 122, 130, 135, 138, 147,152, 160, 163, 176, 181, 188, 212, 213, 217, 228, 231, 236,247, 253, 255, 258, 267, 273, 276, 277, 285: n = A,T,C or G
aggaggcggagcttgcagtgagctgagatcgcgccactgcactccagcctgggcaacagagtgagactctgtctcaaaaaaaaaaaaaaannnnnnnnnnnnnnnnnnaanctcgtnttngnaaggaaanggggnaanggaccggtnttatncctatgtngtntttgcaggcaaangaaanggacccntttttgtaaaaaaaagtcttttgnncaantaaacggggtntgngggtncaggccctggnggggcncncanttgcctggnggcttntgnnaaatcggnaaagggaggaaaggc

SEQ ID NO: 11 - DNA, 300 bp, Homo sapiens
  misc_feature 140, 141, 142, 143, 144, 145, 146, 147, 148, 149, 150, 151,152, 153, 154, 155, 156, 157, 158, 159, 160, 161, 162, 179,183, 184, 190, 197, 204, 207, 210, 218, 221, 228, 234, 238,243, 245, 253, 254, 257, 258, 266, 273, 280, 294: n = A,T,C or G
cgtctgtaatcccagctgcttgggaggctgaggcaggagaatcacttgaaccctggaggtggcggtttcagtgagcacagatcatgccactgcactccagcctgggcaacaaaacgagacttcgtctcaaaaaaaaaaannnnnnnnnnnnnnnnnnnnnnncgggttctcccaaattntttnnaggggnccatggncaactgnttnacntttgtttnggnaaccccntgcccnaagncgcananaggctgtnnttnnccttgttnccaaggntgaggancaaaaagtaccctntgtttt

SEQ ID NO: 12 - DNA, 300 bp, Homo sapiens
caaagatggtcgtattactaaaggtgaataaccagcgcggggggcacgtggagtcactggaacatttgtgcaatgctggtgggaatgtcaacccgtgcggccctctggaataagcctggcagctcctccaagagttaccgtgtgacccagcaattccactcctagctccacccacaggaattgaaagcaaagacgcaaacagatgcctgtgcaccaaagttcacggcagcatccttcgccatagtggcagcatccgtcgtcacagcggcatcatccttcatcatagcggcagcatccgtc

SEQ ID NO: 13 - DNA, 278 bp, Homo sapiens
  misc_feature 141, 142, 145, 146, 148, 149, 150, 151, 152, 153, 156, 157,158, 159, 160, 162, 163, 170, 171, 172, 174, 175, 176, 184,185, 186, 187, 190, 191, 194, 195, 196, 199, 200, 201, 202,203, 205, 206, 211, 214, 215, 216, 219, 220, 221, 228: n = A,T,C or G
  misc_feature 229, 230, 231, 233, 242, 246, 249, 254, 256, 261, 262, 263,265, 266, 270, 271: n = A,T,C or G
cctgcagccactaatgcattgtgtatgataacaaaaactctggtatgacacattttctgtgatcattgttaattagtgacatagtaacatctgtagcagctggttagtaaacctcatgtgggggaggtgtgggaggttttnncgnnannnnnngcnnnnnannccccggnnngnnngaagctgnnnnttnnaannngcnnnnnannatganaannnccnnngactggnnnnangaggcctancccntgntttananaaacnnncnncagnntctctca

SEQ ID NO: 14 - DNA, 300 bp, Homo sapiens
gtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaa

SEQ ID NO: 15 - DNA, 300 bp, Homo sapiens
gttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgcgatggatttatggagtatgtgggtatagaaatca

SEQ ID NO: 16 - DNA, 276 bp, Homo sapiens
  misc_feature 108, 109, 110, 111, 112, 113, 114, 115, 116, 117, 118, 119,120, 121, 123, 124, 125, 126, 127, 128, 131, 132, 137, 145,149, 162, 164, 167, 170, 175, 176, 180, 185, 195, 196, 202,207, 208, 216, 219, 220, 245, 248, 250, 252, 256, 259: n = A,T,C or G
  misc_feature 260, 261, 263, 268, 273, 275: n = A,T,C or G
gtttcatttaagaagaatgagctagataaatgtgctcttctggttaccccaccctgacagagtgcatttttacacggctagcaggggttgagactgcagcctggcctnnnnnnnnnnnnnngnnnnnngcnnacttnacttcccngaancactataattggnanacnttnctaannggtnatctngccgacctgnnagatanactcnngataaaanccnntgcagaaagcgcccttccatgtcangcncntnaganacnnncntaccncctangna

SEQ ID NO: 17 - DNA, 300 bp, Homo sapiens
ggtgcccatcaccacacccagctaacttttgtatttttagtagagacggggtttcaccatgttggccaggctggtcttgaactcctgacctcgtgatccgcccgccttggccccgcaaagtgctgggattacaagcatgagcccagcgcctggctgtatctttcattttacccaagtcactttacccaagtaagtaattaggggaaagcctgagtcttgtaccacctgttcatttggggaactgtgggaaacggagccaacggacctaagtgccctttgacagtgagtttcataccattt

SEQ ID NO: 18 - DNA, 273 bp, Homo sapiens
ctcagctgaggcaattaaactggaaaagaaatagattgaaaagatactacagaagaagcagtacagaagttgggggactgaaggagagggagccactgcaggtgctagctgcttaaggggataccagtccttttacagatataatagatacagcttctgaggtggagggtgataggagtgtgtagagaaattgcagttcagaactggagcatgcagttaggcaagaggcatcccatgtgaagatgtcaagcaagtactggaaaatgctgaact

SEQ ID NO: 19 - DNA, 300 bp, Homo sapiens
gggtcctggtgggagttccatccagcagtgagtgcattttttccccagagcagttaagggtcttattaaaagccaccactttgctgaggcctgtacaggccttgggggtttggggaagagaaataaggcaggcacttgtcccttcagggagggacttgtccctcactgggaggtttggggttgaccttggctccagcagagatacccagcctggcgtggaaggggcaggtctgagcttacgcttgactgcagggcaagctgcaggcctcttctgccttcccctgcattcaccaaggacag

SEQ ID NO: 20 - DNA, 300 bp, Homo sapiens
atggcatgcactgacctcttcttggagcccagaactttatagagttgcctaccagggttactgtaatggaatttatgatcttaagaaattactagttgtattatttatcctatgattcattcattcaataagcttttactgcataaactttacatccagcactgtagttaagtacccaaaattgaatagaaataatggcttttgaaaatcgcacaaagcaggccaggcacggtggctcacgcctgtaatcccagcattttgggaggccgaggcaggcggatcacgaggtcaagagatcca

SEQ ID NO: 21 - DNA, 293 bp, Homo sapiens
  misc_feature 140, 141, 142, 143, 144, 145, 146, 147, 148, 149, 150, 151,152, 153, 154, 159, 162, 169, 179, 188, 190, 197, 207, 209,228, 234, 253, 276, 283: n = A,T,C or G
cgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaannnnnnnnnnnnnnnccttnggncgggttntcccaaattnttttgaggngnccatggncaactgcttnanctttgttttggcaaccccntgcccnaagtcgcatataggctgtncttcaccttgtttccaaggctgnggaacanaaagtaacct

SEQ ID NO: 22 - DNA, 300 bp, Homo sapiens
ctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccat

SEQ ID NO: 23 - DNA, 300 bp, Homo sapiens
gaaccaaagacgtgtatggagtgttctcttgtccttatcgacttgctctgctcccagctttccaagcgaccggatctgagtgatgcttctagaacatttgggtgttggggggttcccaatagtagaaagggtccccattcctgctcagcaccgcacctctctacccccccacagacacacatgcagacacacacatgcagacaacacgcagacacacacatgcaggcactcacatgcaggcccatgcacacacacgtgcacacacatgcagagacatgcagacacgcaggcacacatgca

SEQ ID NO: 24 - DNA, 300 bp, Homo sapiens
cctcccacaacacgtgggaattcaagatgagatttggttggggacacagccaacccatatcacccatgcctggatgcccttctcatgcttgggttctgtcatctgcaccaggccttctgctgcccgtctgtcttacccaccaggactctgactctccacgctgggccacctctcttctccaacactgctatggattgaatgtttatgttatccccaaatttgcatgttgcaatcccaatctccaatgccatagtattaggaggtgggggcctttgggaggtgatttggtcatgaaggtgg

SEQ ID NO: 25 - DNA, 300 bp, Homo sapiens
ggaaaatgaaatctgactatctgctagttgccaaaacccagaaacattcctgtgtaatggttagttgggaaagaaggcagcacttgaaaaaatttaccaggttcctcactgggagatgtgggaaggggcgtgggacgcacgcggtcactccctctcagccccccacatttctagaacacactgtagctgtgcctctacagactcccgctgcctggcctccacagatcctgctcagattcaccagtaggcaaagcttggccctattagctttttctctccatggctctgtgggaatgtgcg

SEQ ID NO: 26 - DNA, 300 bp, Homo sapiens
ctgcagtgagattctctgcaatgactggcctcagcaagggggcagcttaggaccctgacatcccaggtcactaagccacataggataagtaatgggtggacagaagcgggaaaggagaagggcagggcacatgtttaaaacttgaactttctgaggctaagactggaaaaggaatggtttcagctgatatatttggataccagttgactatttttaggaaaaaaacacaaatggcttttaaacatcacagtgtgatacagtctaactcagaattagagacaggcaaaacagaactccatc

SEQ ID NO: 27 - DNA, 300 bp, Homo sapiens
gtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcacgct

SEQ ID NO: 28 - DNA, 298 bp, Homo sapiens
  misc_feature 3, 5, 8, 9, 10, 11, 16, 22, 25, 30, 31, 42, 62, 67, 68, 79,85, 95, 108, 115, 120, 126, 127, 128, 129, 130, 131, 132,134, 136, 137, 140, 142, 143, 144, 152, 154, 157, 158, 169,171, 181, 191, 193, 199, 200, 201, 208, 209, 210, 219: n = A,T,C or G
  misc_feature 221, 224, 233, 234, 235, 244, 245, 246, 247, 252, 253, 254,255, 256, 258, 264, 272, 274, 276, 278, 280, 284, 287, 289,290, 291: n = A,T,C or G
aangnaannnnggggngttgantcnacctnngaaccgtgtanaaacccatggaaacagctantagannttgggcaggancagagngaggccaagntacgggggaggcnaggagcngagantggggnnnnnnnangnnaantnnngaaggggngnganngagggggggananaaggggggangagggcgaangncaggannnagaaaannnggggacgananggngaacagggnnnaaacggaannnnggagnnnnnanagatgncgggcagngncngngnaggnganannngagacgg

SEQ ID NO: 29 - DNA, 300 bp, Homo sapiens
cctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctag

SEQ ID NO: 30 - DNA, 300 bp, Homo sapiens
  misc_feature 201, 202, 203, 204, 205, 206, 207, 208, 209, 210, 211, 212,232: n = A,T,C or G
gtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccannnnnnnnnnnntgaggaagaggaacaggcanatgtcaatgaaaagaaggctgatctcattggaagtctcacccacaagctggagaccctccaggaggcg

SEQ ID NO: 31 - DNA, 300 bp, Homo sapiens
tttaaactgagctccaaatgacgttcaaacacccctctcgggtagagttttcatggtggaacggttgcgcccaccaaacagaagcttatgtttttggcacagaaggcctgggccattttcatggacacctggctggacctcggtggaagtgaactccgtaggttgttgcgttcactgcagcacctcacatgataccgtcccctctcatggaacggagcctcccccatgcagcccccactcaaatggagttttaaaggctgggttcaggttacgggggcgtttctcaccgtctgaatgcgg

SEQ ID NO: 32 - DNA, 300 bp, Homo sapiens
gtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaag

SEQ ID NO: 33 - DNA, 300 bp, Homo sapiens
gtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagc

SEQ ID NO: 34 - DNA, 300 bp, Homo sapiens
tgacagagctgttcagcgtacaccagatcgatgagctggccaagtgcacatcagacactgtgttcctggagaagaccagtaagatctcggaccttatcagcagcatcacgcaggactaccacctggatgagcaggatgctgagggccgcctggtacgcggcatcattcgcattattacccgaaagagccgtgctcgcccacagacctcggagggtcgttcaactcgggctgctgccccaaccgctgctgcccctgacagtggccatgagaccatggtgggctcaggtctcagccaggatg

SEQ ID NO: 35 - DNA, 300 bp, Homo sapiens
cttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccggagagagtgccagggtgccctggtctgagctggcatccccatgtcttctgtgtccgagggcagcatg

SEQ ID NO: 36 - DNA, 300 bp, Homo sapiens
gctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccttcgccccatgcatag

SEQ ID NO: 37 - DNA, 300 bp, Homo sapiens
gtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatga

SEQ ID NO: 38 - DNA, 300 bp, Homo sapiens
  misc_feature 278: n = A,T,C or G
catccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtatgaattntaaatacttagggttcattttt

SEQ ID NO: 39 - DNA, 300 bp, Homo sapiens
gggaaggagcgggcgtgaggccagctgaggcatggtgacccctgggaaggagcgggcgtgaggccagctgaggcatggcgacccctgggaaggagcgggcgtgaggccagctgaggcatggtgacccctgggaaggagcgggcgtgaggccagctgaggcatggtgacccctgggtacgggggacttgggggccgcaccttggtttgcccagggcccctcctgcaccacgggccacatgcggaggacggcgtgggataggctccctgggtccacagcttctgcccgtgtatggggaaccc

SEQ ID NO: 40 - DNA, 300 bp, Homo sapiens
ccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaat

SEQ ID NO: 41 - DNA, 300 bp, Homo sapiens
aaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatg

SEQ ID NO: 42 - DNA, 300 bp, Homo sapiens
ttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctcc

SEQ ID NO: 43 - DNA, 300 bp, Homo sapiens
gccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaagcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgc

SEQ ID NO: 44 - DNA, 300 bp, Homo sapiens
ggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccggctgcccactatggactgacaaccaaggaaagtcttccccagtccaaggagcagccgtgtc

SEQ ID NO: 45 - DNA, 300 bp, Homo sapiens
gtggaagaaaattttttgctgcttctggttcccagaaaagggagccattttaacagacacatctgtcaaaagaaatgacttgtcgattatttctggctaatttttctttatagcagagtttctcacacctggcgagctgtggcatgcttttaaacagagttcatttccagtaccctccatcagtgcaccctgctttaagaaaatgaacttatgcaaatagacatccacagcgtcggtaaattaaggggtgatcaccaagtttcataatattttccctttataaaaggatttgttggccag

SEQ ID NO: 46 - DNA, 300 bp, Homo sapiens
  misc_feature 53, 55: n = A,T,C or G
gtggaagaaaattttttgctgcttctggttcccagaaaagggagccattttangngacacatctgtcaaaagaaatgacttgtcgattatttctggctaatttttctttatagcagagtttctcacacctggcgagctgtggcatgcttttaaacagagttcatttccagtaccctccatcagtgcaccctgctttaagaaaatgaacttatgcaaatagacatccacagcgtcggtaaattaaggggtgatcaccaagtttcataatattttccctttataaaaggatttgttggccag

SEQ ID NO: 47 - DNA, 300 bp, Homo sapiens
acacagataattttaatacaatgtgaaaaagtgtatgggtgtgtagaagaggggttcttagagtttctggagagaatgattctgagctcggttttgacaaaagaggagctgctgaggctaaaagtggatgaaaagggccttataattaaaagaaacaagacaggactcagaggtgtgaaacaaatattatgcatggtgaattacaatgagttgggggtattctgtagccctaaagtacaaggtataaagagacagaaaatgatcctggaatatagacagaggatacttcatctctcatga

SEQ ID NO: 48 - DNA, 300 bp, Homo sapiens
gatggaacatgagtggaagtgggcagtctttttctttccctatcagctgagtgaatgaagatttagagggcagcagagtcatgacatggatgacgttgggtctctggatggctaaatggaagacccgccccccaacgccactctacccccctgctttgaactatgctttgagaaatgagcttatgagaccactgagacttgggggctgtttgttcagcagttcacctacacttattaggaaaggttgacttcttgtaactacgcctttccttaaatcatcttttgtataattctcagaag

SEQ ID NO: 49 - DNA, 300 bp, Homo sapiens
ccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaaccactatgagaagattataggaaaaacaccaagactagaggactctgggttccttttatgcaaagtcaactcttctgggtcacagttacccagcaacaaaaataaagagaggaccaggacgatgccagcaccccgtttatcctgagtgaac

SEQ ID NO: 50 - DNA, 300 bp, Homo sapiens
ctcctgtctcagcctcctgggtagctgggactacaggtgcatgccaccatgcctggctaacttttgtatttttagtacagacagggtttcaccacattggtcaggctggtctcgaactcctaacctcaggtgatccacctgccttggcctcccaaagtgctgagattacaggcgtgagccaccgcgcctggcctgattggttttttaacatgatttttctctaagcttaaataccacaaggccaaagagaaatggtcataatttaaaccattattatattggtgaggtatccctagctat

SEQ ID NO: 51 - DNA, 300 bp, Homo sapiens
ggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaag

SEQ ID NO: 52 - DNA, 300 bp, Homo sapiens
atatggtatagttggaaataggttattgtgagttatttgtagtcatgtctttaatggcccttgcatggtgtctaacttctgcaataaatgatctgccagtcctagtgtctggctttatgcaatttgttttcctttgtggatgaagtgggagtaagacttgttgctgtgaggattagatgaagtggctaggatatggacacactttacttgaattggaaaacaagccatgtatccctaatctgcaaaatgtggcatgtcacacgtgtaatctctgaggtttagtttttgctcaagattgca

SEQ ID NO: 53 - DNA, 300 bp, Homo sapiens
aagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacg

SEQ ID NO: 54 - DNA, 300 bp, Homo sapiens
ccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttc

SEQ ID NO: 55 - DNA, 300 bp, Homo sapiens
gggagggacccttgggggcaggttgtgggtagccagttgcagtctgtggcctccctcagaggtttggagtcgggcgtggcatgctgctgttggcctctttccgagggagtgccatccactccctgtcccaccgctgtccgcggtgaggacagtgagggcagtgctacgtggtggggaggtgtgtgagaagccacggaagggcttcacagggcagatgccaaggccagtgggccccggacagagtcaggctccctgggcggccttgtgtcttggtggccctgatcatcctgccaatgcaaa

SEQ ID NO: 56 - DNA, 300 bp, Homo sapiens
ctttgctctctccattccaagttgttctctgttctagaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggact

SEQ ID NO: 57 - DNA, 276 bp, Homo sapiens
  misc_feature 97, 98, 99, 100, 101, 102, 103, 117, 118, 131, 139, 143,154, 161, 163, 164, 166, 168, 169, 170, 172, 174, 175, 177,182, 183, 184, 185, 186, 187, 189, 190, 191, 193, 194, 195,198, 201, 204, 205, 213, 216, 217, 220, 223, 225, 226: n = A,T,C or G
  misc_feature 229, 230, 233, 236, 237, 241, 242, 243, 245, 246, 247, 248,249, 250, 251, 254, 258, 259, 262, 267, 271, 272: n = A,T,C or G
cctccctggatgtgcagacatggaggaggacagaaggcccagctcagtggcccccgctccccaccccccacgcccgaacagcaggggcagagccagnnnnnnntcgaagtgtgtccnngttgtcttttganccttgttntggngccttgcctanatgtatntnntntnnntntnntnatttnnnnnntnnntnnnttnctnttnntaaattgnttnnaanttntnntannttnttnnattnnnannnnnnntantgtnntgnattgntatnnatca

SEQ ID NO: 58 - DNA, 300 bp, Homo sapiens
ctgtaagtctctttcttgcccatcaccacatccctagtactgggtatcagtctggccacttggctttctggtttgccccaatgtggtctattcttgatgcagctaccaaagtaatgttttaaaaccattataccaagttactatccttgtcaaaacccccagtaactgccaatctcacttagaataaaatccggactcctgtgaagcacagcataaactggccactgcctatgcagcaacctcatctttaccgtttcctgccttgctcactcccttccagcgccgttattcttcctgatg

SEQ ID NO: 59 - DNA, 300 bp, Homo sapiens
  misc_feature 45: n = A,T,C or G
gacccaggtagaccagctcaagagttcatgttctttgtcatcctngtgtgagctctctgtaagtctctttcttgcccatcaccacatccctagtactgggtatcagtctggccacttggctttctggtttgccccaatgtggtctattcttgatgcagctaccaaagtaatgttttaaaaccattataccaagttactatccttgtcaaaacccccagtaactgccaatctcacttagaataaaatccggactcctgtgaagcacagcataaactggccactgcctatgcagcaacctca

SEQ ID NO: 60 - DNA, 300 bp, Homo sapiens
gggtcctggtgggagttccatccagcagtgagtgcattttttccccagagcagggtaagggtcttattaaaagccaccactttgctgaggcctgtacaggccttgggggtttggggaagagaaataaggcaggcacttgtcccttcagggagggacttgtccctcactgggaggtttggggttgaccttggctccagcagagatacccagcctggcgtggaaggggcaggtctgagcttacgcttgactgcagggcaagctgcaggcctcttctgccttcccctgcattcaccaaggaca

SEQ ID NO: 61 - DNA, 292 bp, Homo sapiens
  misc_feature 43, 65, 67, 75, 77, 143, 220, 242: n = A,T,C or G
caaggcccgaggtgccatcccctctgggaagcagaagcctggnggcacccagagtgggtactgtngnggtaaagngntcaccctctcacagcaccaccagcggcgagacagaccccaccaccatcttcccctgcaaggagtgnggcaaagtcttcttcaagatcaaaagccgaaatgcacacatgaaaactcacaggcagcaggaggaacaacagaggcnaaaggctcagaaggcggctttngcagctgagatggcagccacgattgagaggactacggggcccgtgggggc

SEQ ID NO: 62 - DNA, 300 bp, Homo sapiens
agcaaatcaagatcttcaggtacagttggaccaggcactccagcaagccttggatcccaatagtaaaggcaactctttgtttgcagaggtggaagatcgaagggcagcaatggaacgtcagcttatcagtatgaaagtcaagtatcagtcactaaagaagcaaaatgtatttaacagagaacagatgcacagaatgaagttacaaattgccacgttgctacagatgaaagggtctcaaactgaatttgagcagcaggaacggttgcttgccatgttggagcataataatggtgaaataaa

SEQ ID NO: 63 - DNA, 300 bp, Homo sapiens
caggcctggacttcgcccccaggcctaggaccgcggagggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccgg

SEQ ID NO: 64 - DNA, 294 bp, Homo sapiens
gctgcatctgcaatgaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcaccagacatctgcctactctcctccacgtgcaggccaagagcactgaagacaccctggtcctcccggaagggcagtcccacaggcagcggcacccatttctgggccccg

SEQ ID NO: 65 - DNA, 300 bp, Homo sapiens
aattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacattt

SEQ ID NO: 66 - DNA, 300 bp, Homo sapiens
agcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatt

SEQ ID NO: 67 - DNA, 300 bp, Homo sapiens
  misc_feature 62: n = A,T,C or G
tgttcttgtagtgtttgttgctattgttagaaagattattagtgatatgtggggtgtcttanctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctggtgctattgagtttgctatattagcagcaatgtcaat

SEQ ID NO: 68 - DNA, 300 bp, Homo sapiens
agacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggc

SEQ ID NO: 69 - DNA, 300 bp, Homo sapiens
  misc_feature 6: n = A,T,C or G
aattcnacacgaggtggcccataagttttaccttttaaacatccggctgcctgtgaatgagaagaataaaatcaatgtgggaattggggagataaaggatatccggttggtggggatccaccacaatggaggcttcaccaaggcgtggtttgccatgaagacctttcttacgcccagcatcttcatcattatggtgtggtattggaggaggatcaccatgatgtcccgacccccagtgcttctggaaaaagtcatctttgcccttgggatttccatgacctttatcaatatcccagtagg

SEQ ID NO: 70 - DNA, 300 bp, Homo sapiens
cccaaggcaagctgttaacaaaatcaacctgggccaatcatcaaagggttggacctaaggttgctatactcaatagaacaagcattttaaataaatttctcgtaagttgttgctttctttatgtggtgggtgtggctttaaagagcacaaaaccacaacaaatcaaagagtagctcgggcttgtcttttgctttatggctgagggtttgaaggatgattcatggacttgtgaatgccagccccagtcccggcttaggtctatctgccaataccaccagggccaacaaattcacgcaacaa

SEQ ID NO: 71 - DNA, 300 bp, Homo sapiens
ggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagcttgctgcaacctcatttagagagggttgccatcg

SEQ ID NO: 72 - DNA, 300 bp, Homo sapiens
ggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaa

SEQ ID NO: 73 - DNA, 300 bp, Homo sapiens
ataacacacatcacagtatgctctcagaaatttctttatttgaaccctataccaatatctgttgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttgttaaaagtactcatccctaatattacattgttctggaaggac

SEQ ID NO: 74 - DNA, 300 bp, Homo sapiens
  misc_feature 246, 247, 248, 249, 250, 251, 252, 253, 254, 255, 256, 257,260, 261, 263, 271, 276, 277, 279, 281, 282, 287, 293, 294,295: n = A,T,C or G
cagagtcaacatggagcatctcactgtgaaatgatccatggattgaaggatatggtaaaatgtttataggttactttgaaagtaaaatatactatgtcttggttttgaggatattggatacaaaactctcttcctttagggctactgagacttgattcctgatcatcagaaatttcaccagaaacaacttgcttccaatatacccaattctatatgaagaattcatggagagtgtactggcactgnnnnnnnnnnnnganncntgctgctncgaanntntnntattnactgannntgaat

SEQ ID NO: 75 - DNA, 300 bp, Homo sapiens
caagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaa

SEQ ID NO: 76 - DNA, 300 bp, Homo sapiens
gctagacgaagtggtgaagcccaaggacttatttttgagctcgctgtaagactgagaaatcacgtactccttcctgaaaccactaagaggaaaaatgtctgtgacactgcatacagatgtaggtgatattaaaattgaagtcttctgtgagaggacacccagaacatgtgagatggagtctcgctgtgtcccccaggctggagtacaatggcgcgatctcggctcactgcaacctccgcctactgggttcaagcaagtcttctgcctcagcctcccgagaactgcaagaggaggcaactg

SEQ ID NO: 77 - DNA, 300 bp, Homo sapiens
agagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccag

SEQ ID NO: 78 - DNA, 300 bp, Homo sapiens
caggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggaggga

SEQ ID NO: 79 - DNA, 278 bp, Homo sapiens
gtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgctcagcccag

SEQ ID NO: 80 - DNA, 300 bp, Homo sapiens
ggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacat

SEQ ID NO: 81 - DNA, 300 bp, Homo sapiens
  misc_feature 53: n = A,T,C or G
acctgtaccgcctggccactggctgtcaccggcgtgatgagctgccggtgttngaacgcaacctatgctggactctcccggcagactgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcc

SEQ ID NO: 82 - DNA, 300 bp, Homo sapiens
cccagctggacctggtggccctttcctagtgcctctgctgggggaggagaacctgggtccacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagccccatgcacgtggaggaggagctggctttcagccccagaccccacgctagcactttccacgctgcttgcccgctgttgat

SEQ ID NO: 83 - DNA, 272 bp, Homo sapiens
tctagatattgcccaatcgctgcccacagtgcacatacctttccaccagtcacatgtgagagggcagattttccaaatgctcatcaccacttggcactgtgtggactataattttggccagttaggaaatggcatctcattgttttcatcttaatttgcgtcagcctgattactcattgaaacttgtgaggttgagaaacttttcttaagcttattggccattcaagtttcctcctttatgaaatggttgttcatgtcatttgctcattttt

SEQ ID NO: 84 - DNA, 300 bp, Homo sapiens
cccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggtta

SEQ ID NO: 85 - DNA, 300 bp, Homo sapiens
ctgggagccaccaacatagcagattaccatgtgaagttgccactgctgcatctcctgaaacctggctgatgggagaggtctcattttgtgtctgagaatgtccaggttgtctgcagaccacagcactgatttcccattagcagttattatttcctggccatttcttcctgaaggttttgtggttaaactccctgtcctcaatattttatcagcagtagggctgtcattcttctggttatcaacctctacattatgaagtaaggttcaacccttctgcttttctcaggcccccaaaacggt

SEQ ID NO: 86 - DNA, 300 bp, Homo sapiens
agaacattggtgtgtgagtgttttttgatggtgcaggacccggaggtgctttccttgccaagaatagaaacatccagaatgctcctccccatcccccaatcccagacagcaattatgtcagccctgtaaggcattgcctgctcttgaccctttggcccatctttttatttttaaaaaattcccatgtcacagatgccctgtctatgcagagggtggcgtgggatgggtgaccactaagtttaggctggtgaaggtggtgagcccttctgaggccctgatagaactttccaggagttcatg

SEQ ID NO: 87 - DNA, 300 bp, Homo sapiens
ctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgc

SEQ ID NO: 88 - DNA, 300 bp, Homo sapiens
ctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaa

SEQ ID NO: 89 - DNA, 300 bp, Homo sapiens
ggggacatgtgtccctcagctcagcagaggctgtggtacaacatggtccttggtgaagacctgcacccctggaacctcccaccatcgtcacaactgtagtctcatttgcagtggagaaaagaacccgatgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatgg

SEQ ID NO: 90 - DNA, 300 bp, Homo sapiens
ctcatacagaaagtcagatcaacaaagagtccaagaaaaatgcgacccagctagaccatttgatcccaggcttagcacacgattgcatggcatcccctttagccacttcaaccactgcagacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctag

SEQ ID NO: 91 - DNA, 300 bp, Homo sapiens
aatgcaaagggctgcagttctcattcaggctactttcaggatgcacagaacatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctattgtaatacaaggcacctacagaatgtataggcagtattgtttctaccaaaagcttcagtgggc

SEQ ID NO: 92 - DNA, 300 bp, Homo sapiens
aagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttct

SEQ ID NO: 93 - DNA, 300 bp, Homo sapiens
cgattcgccagttctccattctgagagtcaatcacgttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaa

SEQ ID NO: 94 - DNA, 300 bp, Homo sapiens
tttgtgcctgagcacccacaatttcaggatttagactgtgtggcacctcagctttcctctggatgtaaccactccttggtgagagagggaactcctcaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaag

SEQ ID NO: 95 - DNA, 300 bp, Homo sapiens
gtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccct

SEQ ID NO: 96 - DNA, 300 bp, Homo sapiens
acaactccagacataattaaagactggcccaggaggaagagggcggtgggctgtggcgccggctcctcttccgggaggggcgaggtcggtgcagaccttcctgggagcctgtcactgcttgagacagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtc

SEQ ID NO: 97 - DNA, 286 bp, Homo sapiens
  misc_feature 13, 24, 65, 67, 68, 69, 70, 71, 72, 73, 74, 75, 76, 77, 78,79, 80, 81, 82, 83, 84, 85, 86, 87: n = A,T,C or G
gtccagggcccangttttaatttntttttaaaaagctttaggtcttgccgggacggtggttcacncnnnnnnnnnnnnnnnnnnnnnaggcctaggcgggtggatcacaaggtcagcagttcaagaccagcctgaccagcatggtgagaccctgtctctactggaaatacaaaaaaattggctgggcgaggtggcaggcacctgtggtcccagctacctgggaggctgaggcgggagagtctcttgaaactggaaggcagaggttgcggtgagccgagattgcgcc

SEQ ID NO: 98 - DNA, 300 bp, Homo sapiens
caccatttttattttgatgcttacactcatttattctgtttttgtaaaacagtttcgggaatttaaaaatccttccagttaatagagcttttgttattatattataattttgtaaacccactttgtttttcccactttaaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccctttctattttt

SEQ ID NO: 99 - DNA, 300 bp, Homo sapiens
agcctcgcctgggccggcctgtggctcccattttcctttcagcgggacaaaggggacttgttaccaggccattttctggatggcctgtgagatctctgcccctccaagaccctccaagtctgagcctgacccacagctgggacactgaattcagccctgggaaccatgggggcttctatctggcaccaggctgcagcctccccaatcccagcccactttgctgtgtctctggcgggctgtcctccttggtgggagctgtcctgcacactgtaggatgcttaaaggtatccctggcctcca

SEQ ID NO: 100 - DNA, 300 bp, Homo sapiens
tccaaccctggcgatgtcaccagcatggtggctcaggttagagctctctgaggacccagcatagagcactggtgccagggaccaaactgagaccccaccaccgtcatcaacacttacataccataaaggtcttcagagtgccttggccctagacctcccttcattctttgtagagatggaatctaagaatgaaacatctccactcagtcctgcaaatatggaagttcttgagatacctttttttggtagatacttgtgctggtattctgagagtcactttactctgatggtttgcaagat

SEQ ID NO: 101 - DNA, 300 bp, Homo sapiens
gtgtttcttctacctcccctgcacaacattgtttatatgccccctaaaatgtaacttctttagattctgttgttacgtgcaacactgtatatctctccatagcacttaatcagagtttgtaattaggcatctttttgtgtgattatttggtaaatgtccatatcccctactagcctataagctccatgacttctaggtaccctgtctgactacgtgtatcactggttctaccgcctaacattgcctagcacattcattgcttcacaggcatctgaatatgggtttataaaatacattgct

SEQ ID NO: 102 - DNA, 270 bp, Homo sapiens
  misc_feature 133, 134, 135, 136, 137, 138, 139, 140, 141, 142, 143, 146,147, 150, 151, 161, 177, 185, 189, 190, 195, 196, 200, 201,209, 216, 218, 242, 244, 259, 260, 262: n = A,T,C or G
cctggccctgctgcccctcctgaatctcgtatgatggtcacagtccggtggccgtgggggtgctctgccttccctggtccccactgcccatatctgtggactgccccttccaaagacccctggaggaggtgtnnnnnnnnnnnttnntgnncccactaccntgcactgaactggccntgttacancaannactgnncccnnttgttatnacacctntnacaaacacctgctgctgtacatgncnctactttaaggactnnanacctgtgc

SEQ ID NO: 103 - DNA, 300 bp, Homo sapiens
gctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatggggg

SEQ ID NO: 104 - DNA, 300 bp, Homo sapiens
ctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtg

SEQ ID NO: 105 - DNA, 300 bp, Homo sapiens
gggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgcccct

SEQ ID NO: 106 - DNA, 300 bp, Homo sapiens
gctcaacgcctatgtgacccatctccatgccgaatacaatcgacagaaggacatctacctagcacatcgtgtggcccaagcttgggaattggcccagttcatccaccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaa

SEQ ID NO: 107 - DNA, 300 bp, Homo sapiens
tgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccagggccagagctggtaacagcggggcagcagggtgggtag

SEQ ID NO: 108 - DNA, 300 bp, Homo sapiens
aggttgctcacctgaaggagcacaggagggttttccaggccatgtggctcaggttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacg

SEQ ID NO: 109 - DNA, 300 bp, Homo sapiens
cacaaggagaagaaagttaattaacattgaaagatgagaagacatcttggaagaacttgaattgggccttggaagaagaacagccattcaaatagatagaattgtggtagcaaaggcatagaggtaggaaagtatagatctccagggacagtagtcatggggttggggcactgttggaatttaaggttggaaggatatattggagccccttgaatacggtaacaaggcacaccttgggcagtggagagttatcagagtgtttgaaaaggagggttattgagtaaataaatagactggtac

SEQ ID NO: 110 - DNA, 300 bp, Homo sapiens
gacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggat

SEQ ID NO: 111 - DNA, 271 bp, Homo sapiens
  misc_feature 135, 136, 146, 147, 150, 151, 155, 169, 170, 171, 173, 176,178, 184, 187, 193, 197, 200, 202, 203, 205, 210, 211, 214,215, 217, 219, 221, 222, 224, 226, 231, 232, 233, 245, 246,249, 251, 255, 256, 263, 264, 267, 270: n = A,T,C or G
cctggccctgctgcccctcctgaatctcgtatgatggtcacagtccggtggccgtgggggtgctctgccttccctggtccccactgcccatatctgtggactgccccttccaaagacccctggggggggtggggnnttccttctannccnntacnctatgtgtttaatnnncntantnctttantantatttnccantgntnntnatatnnttnnanananncntncttannnacattattttanntangngatnntaccttnntgnaang

SEQ ID NO: 112 - DNA, 300 bp, Homo sapiens
gttccctcaccttattcctccaagttcccccttgggaacctctgagattaacttgataagctccttgggcaagctctttatcctaagattcctcagtgagccttatagagttgctgcgagaattacatttgttcatgatgtcaagtgtctggtatgtagctaatgcttattgaacacatagtaatttattgaataattgtcatgatcactggatgagatatagccactgtggaggtaggcacaccagggttttagaggcttgggatcttgcaacaggattttcctcttgcctctccaaac

SEQ ID NO: 113 - DNA, 300 bp, Homo sapiens
cccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctg

SEQ ID NO: 114 - DNA, 300 bp, Homo sapiens
acagttagtgtaaaggatctgaatggcatagacttaactcctgtgcaagatactcctgtggcttcaagaaaagaagatacatatgtacattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacacgaaacccactgactttaaaagaaagaaattgcaatta

SEQ ID NO: 115 - DNA, 288 bp, Homo sapiens
  misc_feature 262, 265, 273, 274, 277, 280: n = A,T,C or G
gtgatctgcctgccttggtctcccaaagtgctgggaatacaggcatgagccaccgcactcggccaggagctagttttatcagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatanaanaggaccannaanggngggagctg

SEQ ID NO: 116 - DNA, 300 bp, Homo sapiens
tcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgac

SEQ ID NO: 117 - DNA, 300 bp, Homo sapiens
gcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtggg

SEQ ID NO: 118 - DNA, 300 bp, Homo sapiens
agaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccaggtttggcatagaaatggtaccccttgttcaaaatgaacaagaagccttagatttg

SEQ ID NO: 119 - DNA, 300 bp, Homo sapiens
gaacaaagaaggaatgtcttcctcatgtttgggtctatagaagacgttaaagaaaacttccagaaagtgggtttgaggcatgagccaccacgcctggccaaaggatttaatgaattaatggatgtacagtgctggggctggtattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataat

SEQ ID NO: 120 - DNA, 273 bp, Homo sapiens
cctcagccttctaaaaagctggggctacacccagctgaagaaattgtaactaaagatagattgtttaaagcaaagcaagaaacttctgaagaaatggaacaaagtggagaagcctcaggaaagcccaacagagagtgtgcaccccagattccttgtagtactcctattgctactgaaaggacagttgcacatttgaacactctgaaggaccgtcacccaggtgatttgtgggcccgcatgcacatctcatcccttggaatatgctgcaggaga

SEQ ID NO: 121 - DNA, 300 bp, Homo sapiens; identical to SEQ ID NO: 118

SEQ ID NO: 122 - DNA, 300 bp, Homo sapiens
gttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaaatgaacactgtcgttcattgcagccgtgttttgtgacacagatgcacagtctgctgtgaagaccttctctcaagtgg

SEQ ID NO: 123 - DNA, 300 bp, Homo sapiens
gtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggcca

SEQ ID NO: 124 - DNA, 300 bp, Homo sapiens
catgctggccagcatccctgcctgtgcaagctctggatgagctgtgagcccctgccacccacacccccactccctgccagcctggcctcagggcctctgatccatgtgcactggagaggagatgactgacagggccactggggcatttccacgttaacagcagctgccactggcaaaagaagtgactcgccaatggaggcatctcagatgtgggcccaggagtctggggagctactttgaacagggctatccattcattgtcccaccaaaggctatggagcccacccaccatgtgctgga

SEQ ID NO: 125 - DNA, 300 bp, Homo sapiens
ggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattt

SEQ ID NO: 126 - DNA, 300 bp, Homo sapiens
tgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaaaaagagaaaacatatgcgttgtattttgcttcaattataaaataccatcctctcaaaggtggttctaaattacaaaggactttgatttctaggtagattctg

SEQ ID NO: 127 - DNA, 300 bp, Homo sapiens
ggtgattcccatgctgaacagtttgatctcctgccagagtgtcgggccacaaactgggcagcacatcaggatcacctgggggccttcaaaaatcaaaaatccacccccaggccatgccctggacccactgcaccaggacaagaaatccaccccaggcctctccccagacccactgcaccaggacaagaaatccacccccaggccacgccccagacccactgccctaggatgtgggggtgggaaccaggtggtgctttgtaaagacgtgcaggtggtaaccccaggcccccacgctcggaa

SEQ ID NO: 128 - DNA, 300 bp, Homo sapiens
tgagctgggagaaggggagaaagtttgtgaagaggagatcggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaaaaagagaaaacatatgcgttgtattttgcttcaattataaaataccatcctctcaaaggtggttctaaattacaa

SEQ ID NO: 129 - DNA, 285 bp, Homo sapiens
  misc_feature 236, 237, 238, 239, 240, 241, 242, 243, 244, 245, 246, 247,248, 249, 250, 251, 252, 253, 254, 255, 256, 257, 258, 259,260, 261, 262: n = A,T,C or G
ggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatnnnnnnnnnnnnnnnnnnnnnnnnnnnaggaagataccatttcttgacgg

SEQ ID NO: 130 - DNA, 300 bp, Homo sapiens
ccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggccgtgggcagcgggggc

SEQ ID NO: 131 - DNA, 300 bp, Homo sapiens
gatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatc

SEQ ID NO: 132 - DNA, 300 bp, Homo sapiens
ctcccatggaggtggtgggaatggcaccgagaagtttgatgacagttatctaatggactagaggttggcaaactttctgtaaatggccaggtagtaaatagttctgcttttgaaggcatatggtctcttgcacctactcgaggctgaaagcagctatagacaatacataaatgaatgagcgtgagtgtgttccaataagaaaaaaacatggctgtttgcttcggccccagggttgtagcttaccagtcctgtaacagatcacagtttgctcttttggtcacaaatacttgaacccctccc

SEQ ID NO: 133 - DNA, 269 bp, Homo sapiens
  misc_feature 251: n = A,T,C or G
atgctatgccaaagcctgctgccagctccatagcctggacctacagcactgcatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtccaggctntgcaaaaaggctgccctc

SEQ ID NO: 134 - DNA, 300 bp, Homo sapiens
gatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttga

SEQ ID NO: 135 - DNA, 300 bp, Homo sapiens
ggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccag

SEQ ID NO: 136 - DNA, 300 bp, Homo sapiens
gacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaa

SEQ ID NO: 137 - DNA, 300 bp, Homo sapiens
ttgacaaattgctggaacacacttattgtggtttacccggttttaattatgtcagagattgcatcatccttatgcttgtttacatctataatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctc

SEQ ID NO: 138 - DNA, 300 bp, Homo sapiens
ggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgttcaggagggcttgatg

SEQ ID NO: 139 - DNA, 300 bp, Homo sapiens
gacatcattttcttattctagtaagagaaagtacacagattcaactttagagaggacttttttttttctggagctaaatcaaggaaggattatcacgtggcctcccttgaatataattttgaagctgtgaacagtaccatcagtaacattttatggacagctctgatggtttttataccacggcactcttcttacctttgggggaagctatctggagttatgactgatgtgtaaagtggtttactgttagaatcctggtgtgctaggattctgggagagtcactttcaggaagttacctg

SEQ ID NO: 140 - DNA, 300 bp, Homo sapiens
gctgcccaggcagttttatggcctcctggttgtgtgccttcacacccgcctacagccccacctcaccatcaagcgctgagccaatgcgggtgtggctggccctgagttcctgagtcagctccttgccagggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccggg

SEQ ID NO: 141 - DNA, 300 bp, Homo sapiens
cccaaacttatcgggggtgccagaggcagagtagacaagccttagtggccgccatttgttgaatatctactgtgcgccaagcagtgcgtcacaactttatgaagtaggtattattatcatccccattttacaggtgaagaaactgagtctctgagagaccaacttttccaaggtcacacagaggtgggatccagcccacttccgtctgaccccaagcccctgctgttaacccctgccccattgtggggaggttccggcccactctggagttctctggtctgcgtcagtcctcaggagaag

SEQ ID NO: 142 - DNA, 300 bp, Homo sapiens
gaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttc

SEQ ID NO: 143 - DNA, 300 bp, Homo sapiens
cttggccttgcttctctgagaaaactttggtcacacctccagagccagggtgggtgcctccctggaggagggggctttcctggttggtggcacagcaggagtccaggctttgtaccgtggacaccatgggctatggcaacaccttcctcaccatccttccatgaggacctcgggagagagtggacatgaaaccctttgtgctctgaagcattcaacagaagctttctggttctgtgcctatttctttggcacttgagcgtgtttgcaggttcattacacacatgatgaaagctctggccc

SEQ ID NO: 144 - DNA, 300 bp, Homo sapiens
cctgactgagtgcctgacggtggaccccctcagtgccagcgtctgaaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgtt

SEQ ID NO: 145 - DNA, 300 bp, Homo sapiens
  misc_feature 227, 242, 243, 244, 245, 246, 247, 248, 249, 250, 251, 252,253, 255, 275, 279, 291: n = A,T,C or G
gccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggnccgactcaaggggannnnnnnnnnnncncaacccccgctggacccccngaanctggcaagaccngctgcccct

SEQ ID NO: 146 - DNA, 300 bp, Homo sapiens
tgactttgtacctggtccaagctgttggggaattgctgctgttgacccaggcaggagtctgactagagaacaaactaaggttgctgcaacaaacaaggacctcttccaagaagggctcccaggcctggcgcagtgactcatgcctgtgatcccagcacttgggaggccgaggcgggtggatcatttgaggccaggagttcgagaccagcttggccaacatgatgagaccccgtctctattaaaaatacaaaaattagccaggcgtggtggcgcctgtagtcccagctactcaggaggttg

SEQ ID NO: 147 - DNA, 295 bp, Homo sapiens
  misc_feature 3, 6, 9, 11, 12, 14, 21, 29, 31, 36, 37, 40, 45, 53, 54,70, 79, 87, 94, 96, 99, 100, 104, 111, 112, 114, 115, 116,117, 120, 125, 126, 132, 135, 136, 138, 143, 145, 152, 155,162, 171, 186, 192, 195, 197, 198, 201, 203, 208, 213: n = A,T,C or G
  misc_feature 215, 217, 218, 219, 220, 222, 223, 231, 235, 244, 256, 259,262, 266, 269, 270, 272, 273, 275, 277, 278: n = A,T,C or G
ggnaangcnanngnaggaganagagaagnancagtnnagncccangaaacccnntgaaacccttagaagncagaggagngaaaggangaaaaananggnnggangagaacnnannnnggncaaannaagganganngntaggngngaaaaanaanaacaaanggggaaaangggaaaaaaggcganaaaggnaanannagnanaaggnggaananannnnannagaaaggncaanaaaagaagnacaaagaaaaanganaanaagnaannannananngacagagacaagaagga

SEQ ID NO: 148 - DNA, 300 bp, Homo sapiens
cgctgtgcttgagaccaacctgacgggtaccttctacatgtgcaaagcagtttacagctcctggatgaaagagcatggaggatctatcgtcaatatcattgtccctactaaagctggatttccattagctgtgcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttt

SEQ ID NO: 149 - DNA, 300 bp, Homo sapiens
agtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagc

SEQ ID NO: 150 - DNA, 300 bp, Homo sapiens
tgtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatga

SEQ ID NO: 151 - DNA, 300 bp, Homo sapiens
gcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggtt

SEQ ID NO: 152 - DNA, 300 bp, Homo sapiens
gatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgta

SEQ ID NO: 153 - DNA, 300 bp, Homo sapiens
cagagaccagccttctccagaggctgtcactgcaggagccgtgggcctgggaagacttggaagcggcctctctcaactggtttctgtctccgtggagctggaactgcctgcacttgccttcagagggaggcacagtccacccagatccacctttccagcaagacccccagtggctgcccagcctgggagcacctctttgcttttcacaccaaaccaaaactggcgagagcccctcctagccaccagtgatccccaagcatccagtacagaaccaggcatcgagctagctccctgcacggc

SEQ ID NO: 154 - DNA, 300 bp, Homo sapiens
cttgacctctgtactttaaagaaatcactaaccaaattttcaaagtttccttttaaatgcgtttagctagaaatctatgtatttatccctttcctattttgcattcttctcccactatttttaaaaactcatttacagtagaaaccattcttctttctcccaacagtatcctttgccaagaccatgagaacagtatgggagcatgttgttggtcagggtttcagaatacgcgtgatgtcactgagaatgtttgctcacagtcaataattgtctttgtggatgtgataattttggagatac

SEQ ID NO: 155 - DNA, 81 bp, Homo sapiens
gatcattgttaattagtgacatagtaacatctgtagcagctggttagtaaacctcatgtgggggaggtgtgggaggtttta

SEQ ID NO: 156 - DNA, 300 bp, Homo sapiens
ggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatg

SEQ ID NO: 157 - DNA, 300 bp, Homo sapiens
ctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattcagaaggagcaagagattttcgagaggaccgaagaagcagagggcattttggatccccaggagtcggaaatgttaaactttaatgagaagtgcactcggagcccactactgacc

SEQ ID NO: 158 - DNA, 300 bp, Homo sapiens
cgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtc

SEQ ID NO: 159 - DNA, 300 bp, Homo sapiens
agtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatg

SEQ ID NO: 160 - DNA, 294 bp, Homo sapiens
  misc_feature 235, 254, 258, 262, 263, 270, 272, 273, 277, 279, 284: n = A,T,C or G
ctttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtnctgataacatccctcactnactngatnntcacatngnncttncnctgangtcccatttt

SEQ ID NO: 161 - DNA, 300 bp, Homo sapiens
cttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggacca

SEQ ID NO: 162 - DNA, 300 bp, Homo sapiens
gccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaa

SEQ ID NO: 163 - DNA, 300 bp, Homo sapiens
gaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtatctgccactgtggacagggt

SEQ ID NO: 164 - DNA, 300 bp, Homo sapiens
  misc_feature 11: n = A,T,C or G
aaaatttatangtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataa

SEQ ID NO: 165 - DNA, 300 bp, Homo sapiens
ctggactctgagtcgtcttggtcccaggagccagtagtgaaggcaacagtctgcccacctgtggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccac

SEQ ID NO: 166 - DNA, 300 bp, Homo sapiens
cttctgttgattggtttgtttaaagtacctaagtactaccctttgactccctaccaaaagttcttttgttttttaaacaacttttatttgtgacttactttcttgagaagtgttcttaatgaattgcataaaatagtggtagcagcttatttcttaagtactttattatttgtgctttaccatttcaggttcttatctttaacccttatttactcagttttccatctgaatgatcctatctctaaattaaggatttaataaatgctgcaaattgtccactttgcaaattgtccaaaagct

SEQ ID NO: 167 - DNA, 300 bp, Homo sapiens
gcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggattccatatggc

SEQ ID NO: 168 - DNA, 300 bp, Homo sapiens
gtctgggcagcctacgctttccggataaaaatggcagaatgaaagaattatgagtggaactagagaataggaaagacatgaaccaacgcccaaaatgagaaagaaggacatataaagaaaaagacaaatacaagtgaaaaaaatatactaatggattaacgtccctgtcgagtgacattttctgactatggaaatgatattagacaaaaagcaacttcaagtgggtttcttatttgagttcaaaatgggtcataacgcagcatagataacttgaaacatgaacagcgcatttggcccagg

SEQ ID NO: 169 - DNA, 296 bp, Homo sapiens
  misc_feature 244, 252, 263, 268, 270, 273, 277, 283, 287: n = A,T,C or G
gagatctctgggatgtcagtgaggctggttgaagaccagaggtaaactgcggaggtcaccaccctcaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaagccctgatggccccgtgccctncattgggncccctggctanttcancnagncccncaggtngagnccaaagcca

SEQ ID NO: 170 - DNA, 300 bp, Homo sapiens
gggtgttggagcagattgtagttgatccacagcaaagagcatcaccaaagccattccaggaggaactagatccaccacttcctctgctgggcatgctccaaaaatggttgtggcttccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggaca

SEQ ID NO: 171 - DNA, 300 bp, Homo sapiens
atggaggcaccagcaggtagtggcccctgtaagcagggccagagtcgggacaaagagcaggagtgaagcagccaagagacagaggaccaggctggagccagtgggcacgcaggagcctgcctgggaaaagccggggggcaaggctggcatgggaatgaacacctgctggtgacacctctctgagcttcagttcccttaactagaaaaatagaacaggcccggtgcggtggctcatacctgtaatcccagcactttgggaggctgaggcgggtggatcatgaggtcaggagatcaagacca

SEQ ID NO: 172 - DNA, 300 bp, Homo sapiens
ggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcg

SEQ ID NO: 173 - DNA, 300 bp, Homo sapiens
gtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaatttcaggccatctatttttaatttaatcccgttcaagtacttgattgttatac

SEQ ID NO: 174 - DNA, 300 bp, Homo sapiens
attatttccaaagcagcctacagtagaaaatagtcattatggcagcagcttctgatgtttttgtttggtaggttttctgatttcaatatatagaatcatattcatagagtatcttcttttaacgaattgcacaaagtacccatttaaaatttacatgcacagttcattgccacctttcttaggcctatgcatagttaataaggttataatctactcaacatggaaaatggagcctatttgcaaacacacaagtaattaaagtaccaattctctcttagtttctttttttatagttggttt

SEQ ID NO: 175 - DNA, 300 bp, Homo sapiens
  misc_feature 5, 14: n = A,T,C or G
tgganactctttantatggaaggtgaatttcctgtcaacatagtccaggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaag

SEQ ID NO: 176 - DNA, 300 bp, Homo sapiens
tataaactttattttattctcttctggggtagagttacatgacaagaaattgaattaattcaataaaattttagttcgggttgcttaggtttttactgctcccattcttgcttttactaatttatccaagattagatgtgattactatttaataataatttagtcctcacacttacaaaccacttacaataccagcatgcttctatcactgtaattctattcaattctcaggcccatgaggcatgccagccagacgaccagacagcatttatagagagggcactcaataccagccacaaa

SEQ ID NO: 177 - DNA, 300 bp, Homo sapiens
  misc_feature 289, 290, 291: n = A,T,C or G
gactggagaagtcagaagtagaaaagcagattgctaggagagacaggatgacagattttggtcagaaaatgggatattggagtttaaagtatcaaatacagaatagttccagatgttcagagatccagcatgggattaggtactgaaatggattagaactaaaagtcactagaatttagaaattgagaaccatgagagtggatgcaatgacttgttgcttgattgaaaaataaattaataataataaaggaccatgagactagcctgttatagggggtatctccatgannnttgtttttc

SEQ ID NO: 178 - DNA, 300 bp, Homo sapiens
tcctggtgtcaaacactataaacctttgaccagctgagctgtgactgctgtcacatatctgagtcctgtgtgcacagtaatatcctgggtcaggtaaaatccaggtcttcaagttttaaggattttttgaagaattcgggcttctttaagacgatccatgcccaaatccacaagcttgttgacagtggattacagtttgtgtggcaaagtccaagttgttacactgtgctttaaaaaaaatcttatctgcatgtattgttaacttagagaccatgagatctatttatcaggaccaggaag

SEQ ID NO: 179 - DNA, 300 bp, Homo sapiens
ctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtg

SEQ ID NO: 180 - DNA, 300 bp, Homo sapiens
gtgatctgcctgccttggtctcccaaagtgctgggaatacaggcatgagccaccgcactcggccaggagctagttttatcagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggagctgccctgtggtgca

SEQ ID NO: 181 - DNA, 300 bp, Homo sapiens
cccatgccgggatcttcccacacccgtcctcacagatccagccccagccccttgcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgtta

SEQ ID NO: 182 - DNA, 300 bp, Homo sapiens
tttgcagtgttgtcagaaacaaataataaagccccaaaagattaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctgggacaaagaaaacatgtgtatacacatgggtcaagcagtgctggtctgtggctgcctgtccagaggaatggaaatatcccttgtcttta

SEQ ID NO: 183 - DNA, 300 bp, Homo sapiens
cggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatca

SEQ ID NO: 184 - DNA, 300 bp, Homo sapiens
ctgttttgcagatgaggaaactgaggtacagaattcttagggaacttacccaaaatggcttttctgcactctgccctttggtattgtcccatgtgaattgtttaaaacttatgtgtatagtggcatgagtaggtgatttcagaaacagaactcacttttgttgtttggtcttaaaattaggaacttttcttcatctgggcttcatttccctgcaccttcccagctttctagtcatgcaagccacatgtctccacgtgaggggttcattggaaagcagccacagagccaccccctggctgg

SEQ ID NO: 185 - DNA, 260 bp, Homo sapiens
attatagagattaatctcctttgctcgaagtctatttaaatattagtcacatctaaaacatacttttacagcaacatctagactggtgtttgaccaaacaactgggcatcatagctgacacataaaattaaccatcacaaccatgttctaggcactgttcctcactgcctgagaagacaccgttatgtttattagggtttttgagttttatccacagcttttggttatctgcaaccatgtctcccacctttaacatagtt

SEQ ID NO: 186 - DNA, 300 bp, Homo sapiens
gataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgatattgagagatgtatgcacatatacatacaacagtcatagtaagacaccgttagacaaaaggtgatgtatgaaaaagaggcaaaacaacaagaagaaaagattgaaaaaatgagagctgaagacgg

SEQ ID NO: 187 - DNA, 300 bp, Homo sapiens
  misc_feature 292: n = A,T,C or G
aaaaagtaaagcttttcatgagcacaaatcccttgcattgtttgatgttactgatattcgtaaaatgaatattttttgttttgttttgttttatttttttgagacaagtcttgctttgttgcccaggctggagtgcaatggcatgatcttggctcactgcaacccctgccttgcgagttcaagtgattcttctgcctcagcctcctgagtagctgggattacaggcgctcaccaccacacccagctaatttctgtatttttagtagacacagggttttaccatgttggccangctggtct

SEQ ID NO: 188 - DNA, 300 bp, Homo sapiens
gagcattcctcctttgttaacgaagcaacatttacacaagatggacattacattattagtgcatgctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtt

SEQ ID NO: 189 - DNA, 300 bp, Homo sapiens
ctaatatccagaatctacaaagaactcaacaagaaaaaaaccaaccccacaagcgggcaaaggacatgaacagacatttcccaaaagaagacatacaagcaacctaaaataatctaaaataatttttaaaaagaaaaaatgcttgacagagttttgatagtacttagtaaaaagttatatctagtggctttttgtttgtttgtttttgttttgtttttaagaaatagtctctgtttcccaagctggagtacagtggcgcaatcttggctcactgcaacctcgaactcctgggctcaagcg

SEQ ID NO: 190 - DNA, 300 bp, Homo sapiens
aaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccca

SEQ ID NO: 191 - DNA, 300 bp, Homo sapiens
gcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcc

SEQ ID NO: 192 - DNA, 300 bp, Homo sapiens
gacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctggggatcgggtaaagataccagtgatgtggagccaactgcaccgatggaggaacccacagtggtggaggagtcccagggcaccccggaagaggagtctccagccaaagttcct

SEQ ID NO: 193 - DNA, 300 bp, Homo sapiens
ctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctg

SEQ ID NO: 194 - DNA, 300 bp, Homo sapiens
cagaagcttagtcatatttcaaaatgatcaaatatcaagaaaaattctgagctgcataacttgtataaagtaattttcagtgatttttttcatggttatgataaaagaactggattagcagaaacttttaccctgaatcaagatttaatttttctttgagctcatcttaaggatatcggaacatagggagcaaacgatggtgtggctgcctcagtgcttgatttttaacggttttgaagagaatagttacatttcttctcctagtaagaactaataaatacattaacagaaatgaattcc

SEQ ID NO: 195 - DNA, 300 bp, Homo sapiens
ctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgatcttatgactaagtagataaattcattgccataatgaggctagctcccagataaacagcgtattttct

SEQ ID NO: 196 - DNA, 300 bp, Homo sapiens
tggatactgacaatggtggcaggcatttcaagccttttaaattagtactttttgtcgtcttgcttattaaaattttgttaattttagcaaagaccaattgttgtgataaactggtgttttttggatgcttcaagcacacgttaaccaattttttaattccccttttggttcctcccattgttctaaaataggactttcatattattaaaacctcaaaagatgatccacccaggatgaacaaagatcaccaaggggaaagaaaacattttttatctttacagaaaacatgttaagattata

SEQ ID NO: 197 - DNA, 300 bp, Homo sapiens
atccagatgggatacctctaaacacgaaaagaaagaagattccattagtgaatttttaagtttggctagatcaaaagccgagccacctaaacaacagtccagccccttagtaaacaaagaggaagagcatgcaccagaatcatccgcaaatcagacagtcaacaaagatgtggacgcacaggctgaaggagaagggagccgcccatccatggacttattcagggccatctttgccagttcctcagatgaaaagtcctcatcctccgaggatgagcaaggtgacagtgaagatgatcaggc

SEQ ID NO: 198 - DNA, 300 bp, Homo sapiens
gcaacatttgtctacaactctactgtaaaattggaaatgcttttccacagaaaaacctctcaaaatgctgaatgcaaaagttgggatcacagaaacattgtgcctatttttggtctgctggaaactgtatttttacaaggtaatccctgttttcaatatagttcctgtcttgccactggcggttttcttgtagcatttttctagttctgagattgctactacccaaagtattcatttctttcttactggggtgtcctctgtcttcacagcctgcttctggattgtaggttttttcctttc

SEQ ID NO: 199 - DNA, 300 bp, Homo sapiens; identical to SEQ ID NO: 198

SEQ ID NO: 200 - DNA, 300 bp, Homo sapiens
agtagaaaaatacaaagactgtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgccctgtaactgtg

SEQ ID NO: 201 - DNA, 300 bp, Homo sapiens
ttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagc

SEQ ID NO: 202 - DNA, 281 bp, Homo sapiens
ggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcccaaaatggtggagctgaagagggggatggggcgggcgaggggtgcacagcgggaaggggagtggtggtctcacgatactgtgactctgagtaact

SEQ ID NO: 203 - DNA, 300 bp, Homo sapiens
gccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagct

SEQ ID NO: 204 - DNA, 269 bp, Homo sapiens
gcggactctcaggacgaaaagagccaaacctttttgggaaaatcagaggaagtaactggaaagcaagaagatcatggtataaaggagaaaggggtcccagtcagcgggcaggaggcgaaagagccagagagttgggatgggggcaggctgggggcattgggaagagcgaggagcagggaagaggagaatgagcatcatgggccttcaatgcccgctctgatagcccctgaggactctcctcactgtgacctgtttcaggagcctcatat

SEQ ID NO: 205 - DNA, 300 bp, Homo sapiens; identical to SEQ ID NO: 201

SEQ ID NO: 206 - DNA, 300 bp, Homo sapiens
gggattacaggcatgacccaccgcgcccagcctgtaatttcttatacttggtattttgtacttggattatgcttctgatacgctataattatttatgtacatgttatttttcttcaatagactgtgaactcttcgaatgtaggactcctagagctagatactcaattattttttattaaattgaatgacttgaaactacagatcctttatttaaacttcccaaatttctgctttatctaggcaactctttaaattctttgatctcatgtagattccaaaggctgaaataattgagatttt

SEQ ID NO: 207 - DNA, 300 bp, Homo sapiens
tcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgacca

SEQ ID NO: 208 - DNA, 300 bp, Homo sapiens
attccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcact

SEQ ID NO: 209 - DNA, 300 bp, Homo sapiens
gagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgag

SEQ ID NO: 210 - DNA, 300 bp, Homo sapiens
gtaacgtgacacgtattttacttcttttagtaggcggacacactttcttaaagtggtaatacgtcatggccctgctataaggtagtagttctagaagactgtttatctaataattcagactaaagctatttatattgctgtgacaccacgtggaaaacttttataattccatcttatttctgatgtatatgttttattttctctgccttcataagaactaaaaaccaaagttatttacgtgaaaacaagatttttgtttgagttcatttacttgagatatgtttaaaaaatccaccttct

SEQ ID NO: 211 - DNA, 300 bp, Homo sapiens
gtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagt

SEQ ID NO: 212 - DNA, 300 bp, Homo sapiens
gcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtc

SEQ ID NO: 213 - DNA, 300 bp, Homo sapiens
ggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggaggagctaatct

SEQ ID NO: 214 - DNA, 300 bp, Homo sapiens
ggaaagggccctaaaagagatgaacaatacccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagaacgtggaaaagaagaattggctgaagctgagat

SEQ ID NO: 215 - DNA, 300 bp, Homo sapiens
atactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctac

SEQ ID NO: 216 - DNA, 300 bp, Homo sapiens
gcagatatttactgaaggaatctaggttgtattttcagtggacaatgggaataaagcatttctaaagcaccgactggagaggaaggcaacagagacaaggagagaagccgagagacatgtctgcgtgctgccacgcatctgagcgattgctctgtgaagagttgtacactgaacattttcaggggaggctgtttacccaggcaatgtcctcaaacaagcctgtgccggggagtcctggaatctgtgccaggactgtgtttttagcccttcacctctcagctttagcaggacatgaaccag

SEQ ID NO: 217 - DNA, 300 bp, Homo sapiens
cccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactgttgatgtggtttg

SEQ ID NO: 218 - DNA, 300 bp, Homo sapiens
acggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactaca

SEQ ID NO: 219 - DNA, 300 bp, Homo sapiens
caactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggcttt

SEQ ID NO: 220 - DNA, 260 bp, Homo sapiens
ggtaagtcaggtgattgaatcccggaaaggttcattgtcttcaagctcacaatactattttgggacaaacagttgtctagtgtttggactcatgaaccctgattcttgagggtggtattttactgcttttgtgatttggtttcaacatatatagtcttttctccggagttaccttaggtcagtggccagtgtttcagcccctggaaagggcatgggctgccactgaggttggtcacaggcctctcagctcatggtgggag

SEQ ID NO: 221 - DNA, 300 bp, Homo sapiens
gggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagtgaccctccaggactatcgcctcccagacagtgatgacgacgaggatgaggagacagccatccaaagagtcctgcagcagctcactgaagaagctgccctgatgag

SEQ ID NO: 222 - DNA, 300 bp, Homo sapiens
gcggtgacccacgtgtcctgcatgattgccctactgctgtggagacctcgtgctgaccatctggcagtgttcttcgtattctctggcctgtggggcgtggcagatgccgtctggcagacacaaaacaatgctctctacggcgttctgtttgagaagagcaaggaagctgccttcgccaattaccgcctgtgggaggccctgggcttcgtcattgccttcgggtacagcacgtttttgtgcgtgcacgtcaagctctacattctgctgggggtcctgagcctgaccatggtggccgtatgg

SEQ ID NO: 223 - DNA, 300 bp, Homo sapiens
gccccctctggatcctgagctccctgctctagacagtgatggtgattcagatgatggcgaagatggtcgaggtgatgagaaacggaaaaataaaggcacttcggacagctcctctggcaatgtatctgaagggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctga

SEQ ID NO: 224 - DNA, 300 bp, Homo sapiens
ctgcggccgcaggagctgtggcggttttcctaatcctgcgaatatgggtagtgcttcgttccatggacgttacgccccgggagtctctcagtatcttggtagtggctgagtccggtgggcataccactgagatcctgaggctgcttgggagcttgaccaatgcctactcacctagacattatgtcattgctgacactgatgaaatgagtgccaataaaataaattcttttgaactatgatcgagctgatagagaccctagtaacatgtataccaaatactacattcaccgaattccaaga

SEQ ID NO: 225 - DNA, 300 bp, Homo sapiens
gccccgctccatgagcagtgactccccagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcat

SEQ ID NO: 226 - DNA, 300 bp, Homo sapiens
tatataacaacttttgctttcaaagttgggtgggactagaacacacaatggaaggatggagtcaggagacctggattcttgtgcccgctctggcttttacagtctgcctaactctatgcagtcacttcctgccagcctgtttccttacctacaagagggagagacactccctggccagcctagttctcagggtgaacgaaaggtcattatcactgcatcctctagtcatttgcttcttcgctaattaacacatcttgagcacctgcgatgttccaggaacaggagatggcagcgtgcaag

SEQ ID NO: 227 - DNA, 300 bp, Homo sapiens
ttgctgaaatgggcacttctgctgtgatgctagtgttgattttgctctcagatgaacacaatgtctcatactaaccaagaagcaagaaaagccccatgcattcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacataccatgc

SEQ ID NO: 228 - DNA, 300 bp, Homo sapiens
gctatgtattgtgtcctaccatgaattcactccatgctagccacattggcctgtatggctattccttggacacacctaggatgttcttgcctcttagcttgcctacctttctctcatcatttgggcctcagcgaggatatcatctcctcagagaagccttctgtgaccatgctatctaaaatactccagcacttcagtcaccctttatcccattactctgctttttcagaaacattggtgctccctgaaacatatttgtttacttgcttagtgtcttttctcccgcactaccatgtaagc

SEQ ID NO: 229 - DNA, 300 bp, Homo sapiens
gattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaa

SEQ ID NO: 230 - DNA, 300 bp, Homo sapiens
  misc_feature 223, 224, 225, 226, 227, 228, 229, 230, 231, 232, 233, 234,235, 246, 250, 252, 256, 261, 264, 269, 277, 284, 288, 293: n = A,T,C or G
acttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgannnnnnnnnnnnnaaccctttctnattngnattngtttnagnattgngaagttgngttaaanagtnctagntagaaat

SEQ ID NO: 231 - DNA, 300 bp, Homo sapiens
  misc_feature 15, 42, 43, 45, 48, 50, 59, 80, 81, 89, 131, 153, 180, 224,261, 273, 285, 290, 297: n = A,T,C or G
tgattctttttgttnttttttttgatattgacaaaagcttanncnttncnattaaaaangccactaattagactttttanntaaaaaangtagggggttttaaaactactttcctactaccaaaaaatcanaaagtatctagctttctaaatngggaaagcaagcaatgttataaaaacnctgaaggaatctctttcttcgggaccttttgttaaactcggttnaagctgtaaaccttatttaaaataaaatttaccacanaacaggaaatanaacctggggaanactcnaaatacncct

SEQ ID NO: 232 - DNA, 300 bp, Homo sapiens
ggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagc

SEQ ID NO: 233 - DNA, 300 bp, Homo sapiens
gaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaagg

SEQ ID NO: 234 - DNA, 300 bp, Homo sapiens
ggaacataattagcttactgatttgatggttctgtgtagttcctgaaactcttggctcttgtttgcctttctttaactctggctccttctccttcttctgtttgtgtatctgtttaattcattgagtgaggaggacaggcagaactgtgtctgccaaggaccggatgtacttctttccttgctcttggttttttgctcacttttatatgtaaggtattagtacaaacctaaaggagagaaagtagaggatcagatcattgggacttgttctggtttcaagaaagaattaacaaattgccg

SEQ ID NO: 235 - DNA, 300 bp, Homo sapiens
gttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggc

SEQ ID NO: 236 - DNA, 300 bp, Homo sapiens
gaatcatcgaaggttgagaccgtgtctagttacatagttataaatacccatctatgtactgatgccttctaaatgtctatctccagtatggtcttttcctttaagctctagatccattgacaccctcaccatctctaaaaggcatttcaaactgaacacatctgatacagaacttttcatttccttcccaactttgcccacgccagcctgctcctccttcacgctttccacttagtatatgatcccactattcactcagtctctgaagcttaaaacctaggattcatccttgactactgt

SEQ ID NO: 237 - DNA, 300 bp, Homo sapiens
caggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgac

SEQ ID NO: 238 - DNA, 300 bp, Homo sapiens
cactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtga

SEQ ID NO: 239 - DNA, 300 bp, Homo sapiens
atttcctccagtcctgggccccatccttgagggccttcccagccagccagcaggagaggcaagaactgggggaacacaggaacctaggggaggaggggagcgctgggcatcctcaggctggcggccaaggcctgcccctggaggcactagaggagggcatctgtctgtgggagcccagaggctgcagggaggaggaggagggaggtatctggtgtgagcgttgcccctgcgacatttgggaccacacaggtgggcttccttattccctgacaaagcctctgtttccagctcttccgccct

SEQ ID NO: 240 - DNA, 274 bp, Homo sapiens
catgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaaagtttta

SEQ ID NO: 241 - DNA, 300 bp, Homo sapiens
ctgttgcctgccaagctcagggcccatttatcatgcatcttcccatccttgtctcccccaactgtcccttacctgagtcacaatttcgccaaagccaaagggattgtcctaagccaatgttgatttatcactcttcctgctcaaaagcccccaagatcacctatcaatcacctacttgagtgcaagctttgactctgtcacctgacattcaagtccccctctgcccccatgccagtcttatcccctcccctacatatgccctatgcctcagtttgccttccctccactttaaaaagcctc

SEQ ID NO: 242 - DNA, 300 bp, Homo sapiens
ccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggta

SEQ ID NO: 243 - DNA, 300 bp, Homo sapiens
caagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtac

SEQ ID NO: 244 - DNA, 300 bp, Homo sapiens
agtaaattttttatgcatattttattgcaataaaaaatgaaaacagtttcaatctaggaggattttggatgcatctatgccttgagaaatgaatggtttgatgtaaatgcatggtagcaagaataaataattatgttaattcatataatatgttatatatagttttaaagaaaattctatcactgtcttcctatgggtagggctataatgtccagttctttcagggattaagagggtagggtctgaagttaatccttgtttgtcgtaatgttattaatttattcaaccaagacttaattg

SEQ ID NO: 245 - DNA, 300 bp, Homo sapiens
tagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatctaaaaaaaatttaatataaaaaatcattttgt

SEQ ID NO: 246 - DNA, 300 bp, Homo sapiens
tggaatatttgctgtgaagggagaaagggagagaaaactcttctgaggatcatttgtcttggtagtatagtaaaaccaaccagctgaacctttcaggctacaagagaacccgggtcggtaatgtctttttaagaataatttttaattgcttataacaagcatattttgtggcatttgaactatatttactgctccaatatccgttattttccaaaggattttgtatctttttgaaaatgtttacatcatcagatgatccacagaattcactttatgtgagatctcccgagagtttccatc

SEQ ID NO: 247 - DNA, 300 bp, Homo sapiens
gtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaag

SEQ ID NO: 248 - DNA, 300 bp, Homo sapiens
gagaggatcacttgagcttaggagttcaaatccagcctgagccaacataacaagactttgtctctaaacaaaacagttattgtttaaagaatctgaaatcttcatctttaattcaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagggctatcaaagggaggctttttacagagaactaaggaagagaaggagg

SEQ ID NO: 249 - DNA, 300 bp, Homo sapiens
ctagcctgggcaatatagtacgaccctgtctttactaaaaatgcaaaaattaaccacgtatggtggctcacacctgtagtcctggctactgaggaggctgatgcaggagaatcatttgaacccaggaggtcaaggctgcagtgagctatgattgcaccactgcaatccagcctggacaacacagtgagaccctgcctcacaaaaattatattctgattttctgagtccatgaacacattgtccaaatggatttttctagctcctccaagttacagatagttccacgcacacacagaactc

SEQ ID NO: 250 - DNA, 300 bp, Homo sapiens
aggaaggtggaggggcaggaacaggacggacaggccccgggctctggcacatcctggggaacaagggaccacaaggacgggggcagtctccagacttcccctgggcgcttgaccccaggccttgcaggggagagagccagggcctccctcaggtctttgttcatgctgttttccctgccgtggacaccctttcccgctctccgattctctaaatcctgccccatctcccagatcttgttcatgtccaagcttttccaggaagtcttagcagctcccacaccgcagagctcgagatgtctc

SEQ ID NO: 251 - DNA, 300 bp, Homo sapiens
gaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaat

SEQ ID NO: 252 - DNA, 300 bp, Homo sapiens
gcacttctctctcactggaaagagaactgttctcctttctctttcttctgcctattaagcctctgctcctaaactcctcatgtgtgtctgtgtcctaaattttcctggcatggcaggacaaaccccgggtatttaccacagacaacaaaaccgcttcactatgatgtatgcatgctgcaaaggaagagacagaatcttgctctatcacccagctggagtgcagtggcaccattgcagcttactgcagcctcaaactcctggctcaagggatccttcagcttcagcctcctggttaactag

SEQ ID NO: 253 - DNA, 300 bp, Homo sapiens
gtctgatgcaggagaattgctaaaacccaggagggagaggttacattgagccgagattgcgccactgcactctagcctgggcgacagagcaagactccgtctcgaaagaaagaaagagaaaggaaattccccagggaagtacctcggcttatttcataaacaggtactgaaggaagcagaggcatgtggaggacttccccacctcgtgcagctatttgggccgtggcatctgaaatttcttatttcagagtcacccctttgatgaccttggcagtgaactgcagtcatctgtttaggcct

SEQ ID NO: 254 - DNA, 300 bp, Homo sapiens
atgttacagacatgaaatatgaacagaatgctaaaagaacataaaagaataagagctccttaaagattataaataaatggtgatgttaaagtaatagcaccattggacgaagctagggaatcaacacttgacagaaagatacatattttttttatacaaactacatatatttgagcaatcaagtagtagacatagagaattttctttttatggaagtactctaataagtaaagggctgatagaattatatcagcattttctagctcctggggaattatgcattgggcatccatggctgct

SEQ ID NO: 255 - DNA, 300 bp, Homo sapiens
  misc_feature 42: n = A,T,C or G
gctgcctgtggcatagccactgctgtacgtttttggttgttnttaagaaactcgatgaagaggggtgtcattctgggctcggggtggttgccaatttttcaccagaaagggagccaccccttgcaaccacttctgtctccgttagccccccctctgccctcctccaagccaaagcgtggcctggcttttgtcttcccatttagttttcctcttttacccttccttttgtgcttaatttattaaaatagttgctgtataatttattttcataaactataaaaaaatactaaatggttaaaa

SEQ ID NO: 256 - DNA, 300 bp, Homo sapiens
acagtctcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatctt

SEQ ID NO: 257 - DNA, 300 bp, Homo sapiens
atagaactaggcactgatttgtttatatttatcctgctcgagacacatgatgtttcatgtatctgtggctttttatagtttaaaataatttctggaaaagtcatagtcattatctctttaaccgctccctctcttccattctctttgttctctcttcctcgaactcctgttagtcatttgatcctccatatctctgaatatttttgtatttcttttattatttatttcttgtctctgctacattttacattgagtaaaagtgggatgtgacagtgggaaatcattagtgacttagaaatt

SEQ ID NO: 258 - DNA, 285 bp, Homo sapiens
tactctattatattgtgcatgctcctgatttagctgctcttggcatcattggtcgcagtggaaccttgaaatgcatctggctagatttatgctcaaatcattctcagttagccttttagtgcctcttcaaaggtttttttttgtatgttttctattcttaataaaagcttaggattaattagaaagaatctgatatggttatgtttccccttgtgtacgctgacctcattcatacgtttttcatagtccagtggtctaaacgctttcaagagcccagctccttgg

SEQ ID NO: 259 - DNA, 300 bp, Homo sapiens
gccttctctggcctcaccaattaggtcaaatgttccttagaatgtgttgtggggcatggtctctccctgtgaggacctgtccagctggacctccgccttcctgcgactgtattggtgtctttccctctcaagcctatgagctctgcaagggcagggaccctgtatgattttgcctatcgtatgtcctccagcccccagcacagcgcctggtgtccagtgagagctcagcaaatactttgtgagttaaggacaggcggctgggtagatggatcgtctgcctagacagggcagttattcgct

SEQ ID NO: 260 - DNA, 300 bp, Homo sapiens
gaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgt

SEQ ID NO: 261 - DNA, 300 bp, Homo sapiens
tttgctttcagtggttggctttcactgaaagaaagtgtaaaaaaagtcagaatttatagctttcactatgtccaagactaggactgggttataaagattttcttttgtgaaggaaaataaaagaaaatttgccactactgcatttactttactattgtaaacttaagattcattccttagtctttggaattttgatgtctcaaaaccagatgagtggaagtgctgaatttgcaaaataaagctaagaatgcttaactctgcactttaagttctactctgaccaaattgaagatgagcaga

SEQ ID NO: 262 - DNA, 300 bp, Homo sapiens
ttttttaagagataaggtcttgctatgttatctaggctggcctaaacttctgggctgaagtgatcctcctgtgtagctgggactacaagcatgtgccaccaatgcctggcttctcacactgttttgtaacatagatatgtgaagatgtgtattatagaattgtttgtaatactgtagtgttgtaggcaatgtgactgtctatagggaagtggacaggttatttgtggtaaatactcatggaaaacggtcaagcagttaaaagcaatcaattatggtcacccagcaatgcagataaatctt

SEQ ID NO: 263 - DNA, 300 bp, Homo sapiens
agaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtga

SEQ ID NO: 264 - DNA, 300 bp, Homo sapiens
ttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttg

SEQ ID NO: 265 - DNA, 300 bp, Homo sapiens
caggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttata

SEQ ID NO: 266 - DNA, 300 bp, Homo sapiens
  misc_feature 300: n = A,T,C or G
tgtgccaccacacccagctcattattattattattattattattattttgagacgaagtttcactcttatcccccaggctggagtgcaatggtgcgatactggctcactgcaacctctgcctcctgggttcaagcggttctcctgccttggcaggcacctgtagtgtcagctactcgaaggctgaggtgggagaatcgcttgaacctggggggcggagattgcaatggtgtggtctcggctcactgcactcgagcctggcgacagagcaagactctgtctcaaaaaaaaaaaaaaaaaan

SEQ ID NO: 267 - DNA, 300 bp, Homo sapiens
atataactctggaggtcaggacataggagatattgattcaggacttgccagagtatggtcttggggtgtgccctgatattacaaacagggatcttagtggctaggtgatgaggccatggcaaatgtagatggaccaagatcaatttgcctttctagatgaggttttctaggtgaaatgtttttgaaactattttgtagcctagtataatttataaaagtagagagaaactataaatataaatttggaaggggttagctaaaaggagaaaacagcagaatcttcatatatatagaaatgga

SEQ ID NO: 268 - DNA, 300 bp, Homo sapiens
cctacttattggatgttggctctttggtgtcatggagatggctttactgtaggtttgtgtgtgttgcattacttttcattgggattgaactgagaaataacaaacaagctttaagtgggaaattaaaaaaaagaagtaacctatgtagatccaaacttaaaatgtgagaaattattgaaatttcattttctacaaacttgaaattagcctgctaattgtaaagttgttttaataatgctgacaaatgtcagttacgtttgcaaaggagtgtatggttctaggtatttgcctactgttacc

SEQ ID NO: 269 - DNA, 300 bp, Homo sapiens
cctacttattggatgttggctctttggtgtcatggagatggctttactgtaggtttgttgtgttgcattacttttcattgggattgaactgagaaataacaaacaagctttaagtgggaaattaaaaaaaagaagtaacctatgtagatccaaacttaaaatgtgagaaattattgaaatttcattttctacaaacttgaaattagcctgctaattgtaaagttgttttaataatgctgacaaatgtcagttacgtttgcaaaggagtgtatggttctaggtatttgcctactgttaacc

SEQ ID NO: 270 - DNA, 300 bp, Homo sapiens; identical to SEQ ID NO: 269

SEQ ID NO: 271 - DNA, 300 bp, Homo sapiens
ccacatttaagtgagatatgggaaggaggagcagattgtttttgaagggaggaagagcagttacttagggtcaaattaagttgtaaaatcccccccgggattttgtatgtaagtcaaagtgaattgtatttggaagaagaactggggagcccacctctggtattttttttatgtccctcatatggacaaataaacctctggtattaaatgaattttcttttgggggattctatatattcgggatttcaaccaccaacctatctggtttttcccgctgaaatgttgggtgatggaatcagg

SEQ ID NO: 272 - DNA, 300 bp, Homo sapiens
gaacgcttccattttatacctgtgtctagttagtttctgcctatctatccaagaagcttttatcaagggtccaccatgtgccagccactgaagtagatataaatacaaggatgtgtaaggtatggatgatggtatacgaactgtcatcttactggatttgtccgctctgttaaagatacggttccgaaaactttttaaagccctagagagggctttaaggcaatgtagcatcatatatagaggcatcaacctgttcatatctttctatttaacagaactgtgcacctgggcacaagggtg

SEQ ID NO: 273 - DNA, 300 bp, Homo sapiens
gaatggcgtgaacccgggaggcagatggtcttaaagtggggagacccgggttacaggcctgactgcatcactaactcgctgtgtgtccctgggcaagtcagtgcagtgcagtagcctctccgtctccgactgaggagcaaagccctcggctcaagatcctcacctacttcacagggatttgaaatagtgcagtcaacaggaaaagaaaagcgctatagaaatgctcgacgctatcacttggggcccacgtggaagtatcaacgtataaattggcccaggcagacagaaggatgcagggga

SEQ ID NO: 274 - DNA, 300 bp, Homo sapiens
ggaaccaggggctgcagaaccagcccctccccaatgaggaccccctctggacgcccctccccatggagaacaccaggagccacagaccccagaccacaggagcacacaggggagggcacggggcggccggggcagggtgtctgctgcctcgtttatgggatttgctccgcgtctagcacactgctgcctgcagtgctcctgtcccctgcagtggctactctgggcctacgggcctaatcctggttggcatgaaaatgtcctgaggctactgtgacaaatttccacaagctgagtggctta

SEQ ID NO: 275 - DNA, 300 bp, Homo sapiens
ctttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttattt

SEQ ID NO: 276 - DNA, 300 bp, Homo sapiens
tttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttg

SEQ ID NO: 277 - DNA, 300 bp, Homo sapiens
ctcacacagcatgtgtcagatccatggggtaggagtcggccagagacttggtaacagacagattgctggatcccacccctagactctctgattcagttagtttggggtaaggcgcaagactgaatttttcacaagtttcccagtggtgctgatacttctggtccaggaacttagtgggagagaacgactaatctagaccatttcacttcacattctgagcttcttgtacactgtcacactgcatccttttaacaatgcattccctatcctattgcaatactgacatctcatcaatatttt

SEQ ID NO: 278 - DNA, 300 bp, Homo sapiens
ctgacaacttgattgggttctccttcaggtttgaagcgccctcgagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcc

SEQ ID NO: 279 - DNA, 300 bp, Homo sapiens
ggtaaacctatttatataatagaaggatgattataaacatttaataaattatatcaaatagatattatatattaaatgggcagataatagaaatctgtccaagcaaaactctggataatttttatgttgccttattttttgttttctgtgaactccaagaaaaatgagataccagtttggaacagatgtaatattgctgatttaacagtttagggatactccccaagttcaataattttgccaagatacaaatttaaatggaaccttttatgaagcttcatagtgtgtgaagaacttacc

SEQ ID NO: 280 - DNA, 300 bp, Homo sapiens
ataactgcttgcgaagatgtagtttctctttggaaagctacacacacgagattatacacatcaggcactggaactatctgtaatactggaacctctgcgaagtgccaggtataaagtttttcccactgccaagcatccagagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaa

SEQ ID NO: 281 - DNA, 300 bp, Homo sapiens
caccatcgaatatttttatttattttgagagacagactctgtcacccaggctagtcttaaactgttggtgaatcttaagtgattctcccacctcagcctcccaaagtgctgggattacaggcatgagccactacccttggctgtgatcaagtatttagtctgttgttaaatgtttactaaatagtctgaagtagagaaaatagcacccaatctaaaataaggtgaggtctagtcacttatttaaatctacattttaagctatagtttactattagtttaaactttaagacaggtaatgtt

SEQ ID NO: 282 - DNA, 300 bp, Homo sapiens
gcaaccttcgcctcctgggttcaagtgattctcctccctcagcatcccaagtagctgggactacaggcacgtgccaccacacccagctaatttttgcatttttagtagaggcagggtttcatcatgttggccaggctggtctcaaactcctgatctcaagtaatctgcccactttggcctcccaaagtgctggcattacaggaatggagccaccgcgcccagcctgatttctttttttaggtcttgtcaggaaagatattgattcttttgattcgtgaacatggtttttggtcgtcttta

SEQ ID NO: 283 - DNA, 300 bp, Homo sapiens
cccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaagaagggagaaagtgtcagatggtgatgaggtctgggggggaaatagagaatggggatcaggagtgtggatggtggtattccctcaccaagaggtgacatgtgagcagggagctgggaggtgagggtgtgacccgtgtggaaatcagggaa

SEQ ID NO: 284 - DNA, 300 bp, Homo sapiens
ggtgtcctccccagtgcgccgcgatttttgtgtccaagccccagagtccctctgagaccaacccccagccagcacagacttcctgccttcccagctcggaagcgccctcgagaagtgtctaaaggagacagttgatagccaaacaacagttttggattcactgactgattatgaaagaagcagtagactggtatcaagaatcagtcaggtttttggaatccttaggcttccacgtgtggaaagcctgagctaacctactggaggatgagccatcacctggagcagattcaggccatccta

SEQ ID NO: 285 - DNA, 300 bp, Homo sapiens
aattccgttgctgtcgggccgccatgtcattctggagagagacagagtaaaacaaagaaggtgatgggtaaagcgcagtcgcctgctatatattgtctatttttggtttttcacttaccttttatatttatgtcttttatgtacaacaggattataagtagcttgagtccagtgaatataccatttcattttgctatccttcactgcacttagcttagaggaaataatcacagcttattattgattaattaattaattaatagatgaatggtgaacacatgactatcatcccaagaaatg

SEQ ID NO: 286 - DNA, 300 bp, Homo sapiens
agccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggccca

SEQ ID NO: 287 - DNA, 300 bp, Homo sapiens
gggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttc

SEQ ID NO: 288 - DNA, 300 bp, Homo sapiens
accactaacagcatctacttgactactgatactttgatcatggagttagggcatgccacttgatagaaatttgaagagcaattatatttttcaaaaagagttttgaataatgttaagatagattgcaacatgactatcaattcttcccttcccatcaaaggagagagtccgtttatccagcctttgaatcttgattattcaagtgacttgcttcacccaatgtaacattaataagcacaatacaagcagaggcttgccaagaacttggtttgtttctaatgcttagaagaagaatggtgt

SEQ ID NO: 289 - DNA, 300 bp, Homo sapiens
  misc_feature 55: n = A,T,C or G
tgtccttatctgaaattcagcgatcttcatgaataagcatttctctgattgtggnatatgcctttaattttatttctagagtgacaaatttttggttttgacagtttttttctagctttatagtttcttcttggggagagaatatgtcaacctcactccatcatgctgaagtaaatcttcatctcttaattttatctctcaaaaatatcctaaggattccctctggagcctgataagtaattgcagtatctggtttctatggttggatgattcaggattccaggaataatagttactttt

SEQ ID NO: 290 - DNA, 300 bp, Homo sapiens
ggaaccatgagaaccgaagctagaattgctattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaatggaaattttaaatccagttcct

SEQ ID NO: 291 - DNA, 300 bp, Homo sapiens
tatgattttatttttggcctaatataggaatgtttaaaaaaggcttttctatgaaaattagaaatttatacttgaaattaaaagtctacaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattctttaagcttttgagataattttagacttacagaagagttggaa

SEQ ID NO: 292 - DNA, 278 bp, Homo sapiens
  misc_feature 230, 231, 232, 233, 234, 235, 236, 237, 238, 239, 240, 241,242, 245, 249, 250, 259, 262, 264, 265, 272: n = A,T,C or G
cccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaactttttttttttttttnnnnnnnnnnnnntgntttnncccccaggntgnanngcagggncccaat

SEQ ID NO: 293 - DNA, 297 bp, Homo sapiens
ggaaggcagtgggaggagaggaccaagtctcaaactccagaagccccacctccctgagctcagctcctctgccaagccccctcagcgcgaagtcctcgtccagagaaggcaacggcgagaaacaaatccaacatcctgggctgctttttccttcccccactttttaaaagtttggtgtccaagtcacttgacaaacccagaccctaacaatgatattttgtgtagaattctgggatcaaaatataatttcaaaaataatatattttctgacatcccccaaaaaaaaaaaaaaaaaaa

SEQ ID NO: 294 - DNA, 300 bp, Homo sapiens
ggaacagtttgagcaaaggctctcaagtaatagggtgtctgacttgttcatttttgaaagtagaactaataggatttcttattggaacgtagggtgtaagagaaaagaggagtcaaaaagagccacaagatttttggtctcagcaattagaaggatagaattgacatttactgagatttttgtttttgtttttgagacggagtttcgctattgttgcccaagctggcgtgcaatggcgtgatctcggctcagtgcaacctccacctcccagattcaagcgattctcctgcctcagcctcc

SEQ ID NO: 295 - DNA, 299 bp, Homo sapiens
  misc_feature 118, 119, 120, 121, 122, 123, 124, 125, 126, 127, 128, 129,130, 131, 132, 133, 134, 135, 140, 152, 159, 162, 176, 179,186, 187, 191, 192, 203, 215, 217, 218, 222, 225, 229, 230,232, 234, 235, 239, 241, 243, 244, 252, 257, 260, 263: n = A,T,C or G
  misc_feature 265, 267, 272, 281, 285, 286, 290, 291, 293: n = A,T,C or G
gtaatattgatgtgattgttgtcgcttgagaaaaaaaggcaacagctgattctttcaacaactgtcacagaatggctgggctgagaacgctgcccagggccctgcagctggcgggagnnnnnnnnnnnnnnnnnngtgcntgctgcaacatntggttanatngtatccttccctanagntgctacnncttnnatccccttgtnaatatgttgagntnncttngcnttcnngntnntccngntnnttgacacntatgnaanttntntngtctngctctgctngatnncttnnangctgcc

SEQ ID NO: 296 - DNA, 300 bp, Homo sapiens
gcagaaccttttcccctctactcttgtctaaaagttctgtgtggcacacagagatgcgacctactcaatctgacttagtaaaaccatgctgaaaaattttggtctaaaaaggacccatacccagcacccatgaaataaaagattcatctgtaattgggattcaaagggattaaattcctttggtcatactcataaatagcactaaagtgttataacattttcatttacctatttttagttccttcattttaacttaataaaaatcttggattgatattctttttttttttttttgggacg

SEQ ID NO: 297 - DNA, 300 bp, Homo sapiens
gctaggattacaggtgtgagccaccatgcccagccacttatctttaaaggattaagtttatgtttcctactatgggaaaccatcccaccccaaacttgatgaccgcattatgtgcttttatagaacatggcacttctccaggatagcatttattctgttttgtaagtgtgaatgtaattaccctacacacagcatacacataatcttcatattctttgccttgtcttgtgaaggcaagggccatgtctatcttattcgtcattagattcccacatccaacatagtcctggggacagcacc

SEQ ID NO: 298 - DNA, 300 bp, Homo sapiens
ccaaatctgcctagagattgagttcacagtgtatgttctgggggcgctggtgcagtcagcggtccagtctccagcctgcaggcgtgcacactggggtggacgatgggtggccccgcaggtgtacacatttgggtggccccggcccctataccccagtgttctctttgatccagtcccgaaacagagggagccttgtgtacacgcctccaaagtggagctgggaggtagaaggggaggacactggtggttctactgacccaactgggggcaaaggtttgaagacacagcctcccccgccag

SEQ ID NO: 299 - DNA, 300 bp, Homo sapiens
ctccattgtgaagatccaggcatttttccgagccaggaaagcccaagatgactacaggatattagtgcatgcaccccaccctcctctcagtgtggtacgcagatttgcccatctcttgaatcaaagccagcaagacttctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctg

SEQ ID NO: 300 - DNA, 300 bp, Homo sapiens
agcaattccactcctagctccacccacaggaattgaaagcaaagacgcaaacagatgcctgtgcaccaaagttcacggcagcatccttcgccatagtggcagcatccgtcgtcacagcggcatcatccttcatcatagcggcagcatccgtcgtcacagcggcagcatccttcgccacagcggcagcatctgtcgtcacagcggcagcatccttcgccaaagcggcagcatccttcgtcatagcggcagcatcctttgccatagcggcaaggtggaaaccctgtccatccactgaggcgt

SEQ ID NO: 301 - DNA, 300 bp, Homo sapiens
tcacagatatgaaagttcagtcagaggggctgggccgacatctgtgcttttccctgcaggatttttaggatcagtgagacggtgtgtatttggaagcatttcaaatgtgttaccatcgtgttacttccgtgggcacctggtgttattggttggactagtcaggattctccagagcagcagaagcaatgggatgtgtgtgcatgtgtttgtgcagagacagaaagagagattttaaggaactggcttatgcagttgtgggggctagcaagtctgaaatttgcagggcgggccagcaagctg

SEQ ID NO: 302 - DNA, 300 bp, Homo sapiens
tcaccaggaatacagtgacattaaaagtgtgatatggtttagctgtgcccccacccacatttcaacttgaactgtatctatctcccagaattcccacatgttgtgggagggacccagggggaggtaactgaatcatgggggctggtctttcccgtgctattctcgtgatggtgaagtctcacgagatctgatgggtttatcaggggtttccacttttgtttcttcattttctcttgccaccagcatgtaagaagtgcctttggtctcctaccatgattctgaggcctccctagccatggg

SEQ ID NO: 303 - DNA, 300 bp, Homo sapiens
gccctctccattttctgaggaggtgatatttgggcagattacaaactgaggaagcatactggatagacatcaggatgaagagaataggcagttgaaaagtcccagaaaggggagtgtgcttagagtgtttgaggaacagcaaggaagcaagcccttgttgaaacagattgagcaaggtagaaagtggtaaaagatgaagttaaagaggtagctgagagccagatcatgtaaagccttggtaaggactgacttttattttaagagggttaggaagacattggtaggttttgactctggctt

SEQ ID NO: 304 - DNA, 300 bp, Homo sapiens
aacaggaatatggaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcagg

SEQ ID NO: 305 - DNA, 300 bp, Homo sapiens
aatagtagaaagggtccccattcctgctcagcaccgcacctctctacccccccacagacacacatgcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgcagatacacatgcacacacacatacacacactggcccctgtttttctgtggtgtcactgggtg

SEQ ID NO: 306 - DNA, 300 bp, Homo sapiens
cagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagggagtgaggtgccgaagtccccggagccaccacccgtccccgtcctggctcccacggaggggccgcccctgcaggc

SEQ ID NO: 307 - DNA, 300 bp, Homo sapiens
  misc_feature 217, 218, 219, 220, 221, 222, 223, 224, 225, 226, 227, 228,229, 231, 239, 260, 262, 263, 265, 266, 287, 291: n = A,T,C or G
gctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggannnnnnnnnnnnnantggccttntgtggcctccaccagcagctntnnannatgacatggagtcccaactgnacgnctccctcat

SEQ ID NO: 308 - DNA, 300 bp, Homo sapiens
agttaagagtgtgaaccctagatttgccatctgaaagtcatgtgtccttcagtgatgcatttaacctctctgtgcctcaaatttctccctctggggtatgttaggagtatacaaattaacacatgtaaagtgcttagaatagattggtactgttaaatatgagctaacgtcacatttgatatttttttaaaaagaaaaaatcattatggagtctcagtcctagagattctgattcattaattctgcttctcggcaaggagcgatttgctggtgtagacattccgggtccgtgtaaagggt

SEQ ID NO: 309 - DNA, 300 bp, Homo sapiens
ccaacacccagttctcactctgtcatccaggctggtgtgcagtggtgcaatgtgggcttactgcagccttgacctccaggacaagtgatctcccacctcagcctccggaatagctgggactacagctcaacaacgcccctctgaaagtaggactcttggaaatgaaccttgttgggagtaaagctgaaccttcacctctcctttccaggattctactccattcatacggcctcacactgaattaatggttctagcagccacatcactttgttacccaattgatctagtagtaaagtcttc

SEQ ID NO: 310 - DNA, 300 bp, Homo sapiens
aggaaacacccccttataaaaccatcatatcaggctgggtgatctgacagagctagacactgtcaaacaaacaaacaaacaaacaaaaaaaccccatcacatctcatgagacttatttactatcatgagagcagctcaggaaacacccactcccgtgattcagttacatcccactgggtctgtcccacaaattgtgggagctacaattcaagatgaggtttgggtggggacacagccaaaccctatcaccatgtaaaataatatctaatttgtagagattaaagaacaagataacttaaa

SEQ ID NO: 311 - DNA, 300 bp, Homo sapiens
  misc_feature 3, 213, 232, 239, 265: n = A,T,C or G
ttntgcagatctccagcacaagcctctgctagttgatctcacggtagaagaaggtcaaagattaaaggttatgtttggttcacacactggtttccatgtaattgatgttgattcaggaaactcttatgatatctacataccatctcatattcagggcaatatcactcctcatgctattgtcatcttgcctaaaacagatggaatggaaatgcntgtttgctatgaggatganggggtgnatgtaaacacctatggccggataacnaaggatgtggtgctccaatggggagaaatgcccac

SEQ ID NO: 312 - DNA, 275 bp, Homo sapiens
  misc_feature 97, 98, 99, 100, 101, 102, 103, 104, 105, 106, 111, 116,117, 120, 122, 124, 125, 130, 136, 145, 146, 147, 150, 157,158, 161, 162, 163, 170, 171, 174, 177, 185, 186, 188, 190,191, 198, 199, 200, 202, 209, 211, 213, 224, 234, 235: n = A,T,C or G
  misc_feature 237, 241, 244, 261, 264, 269, 270: n = A,T,C or G
cctccctggatgtgcagacatggaggaggacagaaggcccagctcagtggcccccgctccccaccccccacgcccgaacagcaggggcagaggcagnnnnnnnnnntaagngtgtnnaantntnnatttnttcctnttttttttnnnttnaaatatnntgnnnttttttnntantanttattatnntntnnttattannntntttttcntntnttactttgttnttgattttanncntttnatnttttttttgttcttctnttntattnnatctt

SEQ ID NO: 313 - DNA, 300 bp, Homo sapiens
tcctgtcttcttgcccaaatgttgcattttccaagaccactctggcctgccatgccacccattctgtgcctataaaaaccctgagaccccagcgggcacacacacaagcggctggacgtcaagaggaacacactggcagaagaacacatcgaaagacgctggcaggccattgatggtggaacgattcggacgccaagggaaattcggccaaggacagtaggagatcccggctgctgagcagccagactccagaggaagactaccttcccatgctatcccccttctggctccccagccatc

SEQ ID NO: 314 - DNA, 300 bp, Homo sapiens
ataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttcatcgtggacctccagcctccagaattgcaagaaaatacatttccgtcgttgaaaccacccagtctgtggtattttgttatggcagcccaggcagactaatacgtgaagcctgctctaaatagataaaataagaaattactacaga

SEQ ID NO: 315 - DNA, 300 bp, Homo sapiens
gtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagag

SEQ ID NO: 316 - DNA, 300 bp, Homo sapiens
gaaatgcctctatgtaggtgaagtgttctctctgcatgcaacaggaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcactt

SEQ ID NO: 317 - DNA, 295 bp, Homo sapiens
acactgtcccactccatcacccaggctggagtccagtggtgtgatcatagctcgctgcatcctccagttcctgggttcaagccatccctcctgcctcagcctccccagtagctggaactacaggtgtgtgccatcacacctggctttacatttttctgtggggacttactatgttgcccaggccggcctcaaactcctgagctcaagtgatcctctgcctcagcctccagagtatctgggattacatatgtcggctaccgtgtctggccgttcacatctttggccactatttgct

SEQ ID NO: 318 - DNA, 261 bp, Homo sapiens
  misc_feature 205, 206, 207, 208, 209, 210, 211, 212, 213, 214, 215, 216,217, 218, 219, 220, 221, 222, 223, 225, 229, 230, 234, 235,246: n = A,T,C or G
cctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccgacccaagaannnnnnnnnnnnnnnnnnntngccnnaacnnttcaccaaatnccccgggggggcttg

SEQ ID NO: 319 - DNA, 300 bp, Homo sapiens
gggacctctgcccaagaaagcctgggtattgaccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaagctgaccattcccattcgttctattctgagataggagaaaaccgccctgtggctggaggtgagatatgct

SEQ ID NO: 320 - DNA, 289 bp, Homo sapiens
  misc_feature 175, 176, 177, 178, 179, 180, 181, 182, 183, 184, 185, 186,188, 192, 196, 197, 207, 209, 210, 224, 226, 229, 233, 236,243, 250, 261, 269, 276, 281: n = A,T,C or G
caccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttctttttttttttnnnnnnnnnnnntngttntgtnncccaggctgnanngcaggggcctgatntnggntaantgnaaccttngcctccnaggttaaagcnattttttngcctaancctcnaaagtacc

SEQ ID NO: 321 - DNA, 300 bp, Homo sapiens
gaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggaga

SEQ ID NO: 322 - DNA, 300 bp, Homo sapiens
cgccctttaactgcagttctgctctattttcttttctctctctggagctgagagtcagagggcccttctcctcctcctttcagcccccaacactaagctgatggattgataaatacctcagcccctcgccttcctcaacccacctggcaagtcttcttaggatctgatcccagttttctggaagcaatcctaccccagcccaagcttcccaagagtcgagccttaatccttctcacttctcagtgtcagagcagaaatgaatcctggggttgactgtgtccattcgggttattagcagct

SEQ ID NO: 323 - DNA, 300 bp, Homo sapiens
agattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacatag

SEQ ID NO: 324 - DNA, 300 bp, Homo sapiens
gtctgagaagtcaaggatcggggtgctggcctattcagttcctggtaagggctgtcttcctggcttgcagttgaactacttcttgctgtgtcttcacaagcatgcccccatcctgtgccgataagaactccagaccccaaactcagctcatacacacacggaagagagaagcatctgaacatcaagaagagaagaagctgctggacatcagaaactgtgaaaggagaggagtttggctgagctccaggggaagactgcctgcacattctatccccttttcagttccccatcctgctgtca

SEQ ID NO: 325 - DNA, 283 bp, Homo sapiens
  misc_feature 270, 271: n = A,T,C or G
gtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcgtccacaaggccagttcactctctgatcctgtggaaaggatgcnngtgtgtagctgc

SEQ ID NO: 326 - DNA, 300 bp, Homo sapiens
atgacatcctcattatccacactgcaaagccaaccatccctatgatgggttcattgtggatcatgacttagtgggtcaagagtttggaagtggctcagctgggcggttcttctgctccatgtggctgccagatggtaccctgctggtgggcagtctggtctagagggtccatgatggctttactcacatgcctggcatcttgacagggacagctggaaggcaaggttcagctgggactgtccacagagctcctccctgtggcctttccagcatggtggtctcagggtagctggacttcct

SEQ ID NO: 327 - DNA, 300 bp, Homo sapiens
ggtagactggctagggatcctggacccagggttccacgtagcaacacctgctgagttctctgggttttcttcctgcctcatgtagcccagacttggagctgaagaagctggaaacatggaaacaccaacagctacagaccaaaaaaagtcccaacaaaggcctgtcagtctgccagcctgttctgtggatttccaactcaagattgcagcatcaactcacacctgaagttctggcttccctacaaactttgaacttgccagtccccacaatggcataagccaattccttaaaatgaatgt

SEQ ID NO: 328 - DNA, 300 bp, Homo sapiens
gtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcacttaaggtgcccccccgaccccgctccaccatagtca

SEQ ID NO: 329 - DNA, 300 bp, Homo sapiens
ttttggtcgtctttaatttgtctcatcagtgcctccatgtgtttttgatgcctttgaactggtatttttaaaatttcaatttctaattgttcattatagaaacacaattgggttttatatattggcattgtattttgcaactttcctaaactcactagtaattctagtagctttttttggtagattcttaaggattttctgtgtaaatagtcatgtcatttgtgaataaagccatttttttttccttttcaaattttgtgccttttatttcttattcttaccatatcacattggcaaaga

SEQ ID NO: 330 - DNA, 300 bp, Homo sapiens
tcaaggatcggggtgctggcctattcagttcctggtaagggctgtcttcctggcttgcagttgaactacttcttgctgtgtcttcacaagcatgcccccatcctgtgccgataagaactccagaccccaaactcagctcatacacacacggaagagagaagcatctgaacatcaagaagagaagaagctgctggacatcagaaactgtgaaaggagaggagtttggctgagctccaggggaagactgcctgcacattctatccccttttcagttccccatcctgctgtcagccacattta

SEQ ID NO: 331 - DNA, 300 bp, Homo sapiens
accgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcccccccatgctgagcgc

SEQ ID NO: 332 - DNA, 300 bp, Homo sapiens
ggaaaaacaacaggtttgagtcctataaagccataatttaactccagtagctgatgtcagacaagcttgtcctatgtcctatttgagtggcagcagcgccagcccagcaagaaggctgggggttgtcaaggttgtccccagaccttgcttgcagtggttggagaacccagggggctgccttgggccctctggccagagggaagcgggcagctctagccctggagattgtggtcacattggggcttgtttaggattggagggccaggtcacctccccagccaccctcccttctctcctctg

SEQ ID NO: 333 - DNA, 300 bp, Homo sapiens
cctcctactcccaaacaaatctttggggaaaaaaaaactaccaactgtcagccatgggcctgacggcgctaagctctggggctccgtgcactgacgtggggccagccacagggaggcggggatcaagtagcggaggccaggattttggccacctcccgggcaagttgcagggcagtggcgccgggagcaaaagcagcatgatgcagctcatgcacctggagtccttttatgaaaaaacctcctcctgggcttatcaaggaagatgacactaagccagaagactgcataccagatgtacca

SEQ ID NO: 334 - DNA, 262 bp, Homo sapiens
gccatgcccatttgtttactcattgtctatggttgctttcatgccctcacagcaaaggcgagtagttgtgatggatcaaatggcccacaaagcctgaaatatttactctttgaccctttacagaaaaaaaccttgttgacccctgctttagagaatgagaagccatgcagggatcagtgatgccagaggaagggaaggaactgcttccagctattgtgacaataataataataataatattgggtctttgactagaacgtgt

SEQ ID NO: 335 - DNA, 300 bp, Homo sapiens
  misc_feature 3, 5, 10, 11, 16, 20, 26, 31, 41, 43, 44, 46, 47, 50, 51,54, 58: n = A,T,C or G
tcntntctcnntattnttgngtagtncctcntttccttgtncnntnntcnnctnttgncttttgcggaccctcgattctatctcatatgagtgagaacgcttaccagtgcagcgaatgtgggaaagccttccgagggcactcggacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggctttta

SEQ ID NO: 336 - DNA, 300 bp, Homo sapiens
gaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtg

SEQ ID NO: 337 - DNA, 300 bp, Homo sapiens
agacaacccagaaacaaattcatacatctatggtgaccacttttgacaaaggaatgaagaacatacactggggaaaagataatgtctttaataaatggtgctgggaaaactggatatccatatgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaa

SEQ ID NO: 338 - DNA, 292 bp, Homo sapiens
tcaataaccatgaagatgcatcctaccaccgtcagggcaatcattagatagctgatcttcactcgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcttgtattaaaaaggatgtggtacgaggatccatttcataaagtatgattt

SEQ ID NO: 339 - DNA, 300 bp, Homo sapiens
gaaatttgcactgatggctcagaaggcttacgtcatggagagtatgacctacctcagagcagggggggctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctgacgggtctgcagcatg

SEQ ID NO: 340 - DNA, 300 bp, Homo sapiens
  misc_feature 6, 10, 50, 53, 60: n = A,T,C or G
ctcagngcancgatcatggctcagtgcagcctcaaactcttgggctcaancanagcgggnacctcaacctcctgagtagctaggactataggcacacagcaccatgccccggctatttttttattttgtagagatggggtctcactatgttgcccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggc

SEQ ID NO: 341 - DNA, 296 bp, Homo sapiens
  misc_feature 173, 174, 175, 176, 177, 178, 179, 180, 181, 182, 183, 184,185, 186, 187, 188, 189, 192, 193, 199, 201, 203, 205, 207,208, 221, 222, 224, 227, 229, 230, 231, 234, 236, 239, 242,245, 251, 253, 254, 255, 263, 266, 267, 277, 281, 284: n = A,T,C or G
  misc_feature 287, 288: n = A,T,C or G
atccaggtgtttctgatgcacagtgaaattggggtaccactggtattaggttgggtatggcaactttttcatcacttgttttatgtagttgtctgatcaattgtgaaaacataatgaatgttggaaatggaacagtaaaataacgaaagccaacttttttttttttttttttnnnnnnnnnnnnnnnnnttnncccccngncngnanngcaggggcccaanntnggntnnntgnanccnccnccnccgggntnnncccctttntcnngcctaacccncccnagnacnnggaactac

SEQ ID NO: 342 - DNA, 300 bp, Homo sapiens
ggcacgatcatggctcattgcagcctctaactccggggctcaagcaatcctcccacctcagcctaccaagtagctgtgaccacagctgcccctcaccatgctaagctaatttttttaattagatagtacataaacgtcccaaaattagaagataaaaagacatgagggatccattctaatttgtgtttggagtgtaatggtccagctccattcttctgcacatggatatccagttttacacaacactgtgaatgtaatgaatgccactgaatcatacactcaaaaatagctaaaatggca

SEQ ID NO: 343 - DNA, 300 bp, Homo sapiens
gttttcatcactacatattctacacacactgggaagctctgacaacttattccctgctattatcaactaaagatcaccctttctactgctgtctctggagcaggagctggcaaactatggcctgctgtctgtttttgtacagttttactgaaacacagccatgcccatttgtttactcattgtctatggttgctttcatgccctcacagcaaaggcgagtagttgtgatggatcaaatggcccacaaagcctgaaatatttactctttgaccctttacagaaaaaaaccttgttgacccc

SEQ ID NO: 344 - DNA, 300 bp, Homo sapiens
ccccaacctgcactctacccacccccatcacctactccagctcccaacttttgtggactgagcggccgcagagactgggtcgccttggattccctctgcctccgaggaccccaaaagacacccccaaccccaggccagccggccctgctctggcgcgtccaaaatactacctagcacaggcctctgctcgaggcacccccaaactacctatgtatccagccccagagggcctccattcccaggaagtccctatgtatcccaacactggcagacacccagcaccaccctcccagacccgca

SEQ ID NO: 345 - DNA, 300 bp, Homo sapiens
cccccatcacctactccagctcccaacttttgtggactgagcggccgcagagactgggtcgccttggattccctctgcctccgaggaccccaaaagacacccccaaccccaggccagccggccctgctctggcgcgtccaaaatactacctagcacaggcctctgctcgaggcacccccaaactacctatgtatccagccccagagggcctccattcccaggaagtccctatgtatcccaacactggcagacacccagcaccaccctcccagacccgcaagaaagtgaatctcactacta

SEQ ID NO: 346 - DNA, 300 bp, Homo sapiens
gtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaa

SEQ ID NO: 347 - DNA, 300 bp, Homo sapiens
gctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcagaccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggc

SEQ ID NO: 348 - DNA, 300 bp, Homo sapiens
gttctgtggctggcatggtctgcctgctactggagagatctcctgagaattcaggtttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatctt

SEQ ID NO: 349 - DNA, 300 bp, Homo sapiens
  misc_feature 53: n = A,T,C or G
gtcagcttttgatgaagctatgtcatactgtcgatatcatccttccaaagggnattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaa

SEQ ID NO: 350 - DNA, 270 bp, Homo sapiens
  misc_feature 9, 39, 67, 70, 89, 105, 107, 117, 128, 133, 136, 139, 141,142, 143, 144, 149, 153, 154, 155, 156, 157, 158, 160, 161,162, 166, 170, 171, 172, 173, 174, 175, 176, 177, 178, 180,181, 182, 183, 184, 185, 186, 188, 190, 192, 193, 196: n = A,T,C or G
  misc_feature 198, 199, 200, 201, 204, 205, 208, 211, 214, 215, 216, 217,219, 222, 223, 227, 228, 230, 236, 238, 241, 246, 247, 248,249, 250, 254, 260, 261: n = A,T,C or G
ccatgctgntaacgggtttcaaggggactcttgaggaantgccccctaaaatagaacacagcaatanggngggcttcctgtccccaggnccaccccacagtgctntntggcactggnaactctgctanggagngantgnannnnaccantaannnnnnannnatcnacannnnnnnnncnnnnnnncntntnnccnannnntannctnccntannnnanccnnccannancactcncnatnaacgnnnnnttantgagannttctcaact

SEQ ID NO: 351 - DNA, 300 bp, Homo sapiens
aaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcagtgcctttcttgtgttatgaaaggcaggtagatattatagccataggtaaaaatc

SEQ ID NO: 352 - DNA, 300 bp, Homo sapiens
aagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcac

SEQ ID NO: 353 - DNA, 300 bp, Homo sapiens
cccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtg

SEQ ID NO: 354 - DNA, 299 bp, Homo sapiens
  misc_feature 277, 278, 280, 281, 283, 285, 287: n = A,T,C or G
gaaggaggacctaggcacacacatatggtggccacacccaggagggtagtggggagttagatttcagagtccaggccctaggttgggacccactccaaataatctcctcggtgtgggtggtggttctatagagggataaatgaataataaacattgttaaaatatacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacnncnncnananaaaaaaaaaaaa

SEQ ID NO: 355 - DNA, 300 bp, Homo sapiens
actgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggcagcggcaaacttgttttctttgagcgtaggactttccaaagg

SEQ ID NO: 356 - DNA, 300 bp, Homo sapiens
ttcagaaagaaacatttaatagggacttacaaacaaattaatgtctgagtctcaggtggcagcaagacaagatggtggatccccatgccattacctgctagactcagggtttatatactgtagtggagaggtgattccgaaggaatgttgtaagacaattgaagagcagtaacatcaaagttatttgacctaagggcaggagttacagtaagtatccacttttatacaagaaacaatagataaactggaaatcttggagcccttcctggaactggggttaatgagaagtcaacatggtgg

SEQ ID NO: 357 - DNA, 300 bp, Homo sapiens
acaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgg

SEQ ID NO: 358 - DNA, 300 bp, Homo sapiens
ggtgattacagaagcccagaaggttgataccagagccaagaacgctggggttacaatccaagacacactcaacacattagacggcctcctgcatctgatggaccctgcacttgatggaccagctggcaccacccagatcaataaactggcttatttgaatttgcggccccccacccaggaactgactcagtgcaagaagacagcttcgactccctgtgatttcatctctgaccaatccgcactcctggctcactggcttccccaacccatgaagttttccttaaaaactctgctcccgaa

SEQ ID NO: 359 - DNA, 300 bp, Homo sapiens
  misc_feature 280: n = A,T,C or G
atcaggtgttcctcccatggcaggagggaagaaacccagcaaacggccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgngtcctggagctggaagagcg

SEQ ID NO: 360 - DNA, 300 bp, Homo sapiens
tctgtctggtgatttttattttaagtgaacctttggatctatctttaactctctttattgtgagtggtaaattccaattctgcagcagatcagtaaactcacagtatttttcctgtggaaatctattcaataaggaaaccaagacaggataataaaatttaaaaaaaaacaactttgaattcccctgcctaggtcttccagttgttttccagcgcatacctcaggtatgactttgctagccggggacaaaattagcaccttccgattctctagtccaaatgaactttgtgctaaataaaa

SEQ ID NO: 361 - DNA, 300 bp, Homo sapiens
gtagaacagaaaatgagcatccgatttcttcactaaaggagaccaaactgttccttgcggtctagtattgaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctg

SEQ ID NO: 362 - DNA, 300 bp, Homo sapiens
actaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagc

SEQ ID NO: 363 - DNA, 271 bp, Homo sapiens
  misc_feature 156, 157, 158, 159, 160, 161, 162, 163, 164, 165, 166, 167,168, 169, 170, 171, 172, 173, 174, 175, 176, 177, 178, 179,180, 183, 188, 190, 191, 198, 202, 204, 206, 210, 211, 212,213, 216, 218, 224, 229, 231, 236, 237, 238, 239, 240: n = A,T,C or G
  misc_feature 242, 244, 246, 247, 248, 249, 251, 254, 256, 260, 261, 263,268: n = A,T,C or G
ggcaattagcctcgcttaagttgccttttttacacaccaaaactttttacatgaagggctggtttcacatgaatactatactgaaatctgtgctctcaagatctagcagtgaccagggctgcccggcgggggctctcctggcaagtcaggaaggtnnnnnnnnnnnnnnnnnnnnnnnnncanattantnnctgatcntctntnangaannnngantngctctnttggncnttgtnnnnngncntnnnntnaantntttnntnatgtngct

SEQ ID NO: 364 - DNA, 300 bp, Homo sapiens
agaggaccctgcagttagggggtgttactttgtcgcccaggatggcctggacccccaggttcagggattctcccgccgctgcttcctgagtagctgggacctcaggcttccgcctcgtgcccgcatccctgctgtgtttaggcagcaggtggtgacctcactcctccctggcctgagctctccgtcccgcatcccaggcggaggccctagggaacactttgaagctgagcacggggtggaccctccctcctgagtgaatggagaatagaaagggagaggatttctgttctgttctgtggg

SEQ ID NO: 365 - DNA, 300 bp, Homo sapiens
gttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaag

SEQ ID NO: 366 - DNA, 300 bp, Homo sapiens
gccagtcctcaccttccctagtcctcgtgtgtattttaggagatgcgtgggtgtggaacagcctcctgcctccggtccaggtgtactggggtctgtgtgttgtgtttctgcgtgttctcggcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagt

SEQ ID NO: 367 - DNA, 300 bp, Homo sapiens
cattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattga

SEQ ID NO: 368 - DNA, 300 bp, Homo sapiens
gcccggcccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggt

SEQ ID NO: 369 - DNA, 300 bp, Homo sapiens
gtggggtgtgcctcgtgtgcgtggattcgtgtgtgtgtgtgtgtcttgtatatgtgtgcgcagagtgcatcattttcagactctactatttccgtcaagtattctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccacagaggggacctggtgtgtcacct

SEQ ID NO: 370 - DNA, 273 bp, Homo sapiens
  misc_feature 179, 180, 181, 182, 183, 184, 185, 186, 187, 188, 189, 190,191, 192, 193, 194, 195, 196, 197, 198, 199, 210, 211, 236,239, 245, 246, 252, 256, 261, 268: n = A,T,C or G
cagaggctggttcagaaaaggaggaagaggcccggctggcagccctggaagagcagaggatggaggggaagaagcccagggtgatggcaggcaccttgaagctggaggataagcagcggctggcccaggatgaggagagtgaggcctagcgcctggccattatgatgatgaagaagctnnnnnnnnnnnnnnnnnnnnncatcatgtccnntgcatggctacctatcccatatttnatntccctnncgttgnttcnaattncacattntcttt

SEQ ID NO: 371 - DNA, 300 bp, Homo sapiens
gatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaatttgatccagttggagagattttaaaaatgcaggatgagctcttaaagccaatttccagaaaagtaccagaattgcccttaatgaatttagaaaat

SEQ ID NO: 372 - DNA, 300 bp, Homo sapiens
gggccccaatgcagctgccctctccagatacctggcagcctcatatatcagccaaagcctggctcggcggcaggggcctgggggaggggcccccgcagcctcccggggctcctggtcctctgctcccacgtcacgggcatcttcgccgcccccccagccccagccaccacctcccgcagccaggcggctcagctatgccacgacggttaacatccacgtgggcgggggtgggcggctgcggccagccaaggcccaggtccggttgaaccaccctgctctcttggcctccacacaggaatc

SEQ ID NO: 373 - DNA, 300 bp, Homo sapiens
accctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgaccc

SEQ ID NO: 374 - DNA, 300 bp, Homo sapiens
tcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacaccc

SEQ ID NO: 375 - DNA, 300 bp, Homo sapiens
cttcagtgcacacaacaggagagaggagaaagaagaaacgctagtaattccaagcactggaattaagttgccttcatcagtgtttgcttcagagtttgaggaagatgttgtgattgttaaataaagcagctccagtttcaggacctcgactggattttgatcctgacattgttgcagctcttgatgatgattttgactttgatgatccagataatctgcttgaggatgactttattcttcaggccaataaggcaacaggagaggaagagggaatggatatacagaaatctgagaatgaag

SEQ ID NO: 376 - DNA, 300 bp, Homo sapiens
gggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggtcagaatttaaggttatctctcttgtttcctaaacattgctgttatcctgttcttttttcaaggtgcccagatttcatattgctcaaacacacatg

SEQ ID NO: 377 - DNA, 300 bp, Homo sapiens
gatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcctctggtattctgggttctgaagtctggtattctggtattctgggttcaaaagtatgacttgagagtgttgctctggtattctgagagttgctctgtattctgggttctgaagattatttgaaaaataactcctac

SEQ ID NO: 378 - DNA, 300 bp, Homo sapiens
tcgctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggt

SEQ ID NO: 379 - DNA, 300 bp, Homo sapiens
acactatagaatacaagctacttgttctttttgcaggatcccatcgattcgaattcggcacgaggcagcttcgagccaatggtgagctccttctggatcagctccttcagctccttcttgctcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtca

SEQ ID NO: 380 - DNA, 296 bp, Homo sapiens
  misc_feature 169, 170, 171, 172, 173, 174, 175, 176, 177, 178, 179, 180,181, 182, 183, 184, 185, 186, 187, 188, 189, 190, 191, 194,198, 207, 211, 213, 216, 218, 222, 226, 233, 239, 252, 253,266, 274, 278, 281, 282, 285, 288: n = A,T,C or G
acctggacagggccagctgctgggggagcggcactggggactggaggctggaagcgggtggtgtgtgtcccctgtttacttttagctgagctggggttgggtgtacgggttctgttcctctgagccctgcggcccacctgatgtttacgtgtgtgtgtgagggggggcnnnnnnnnnnnnnnnnnnnnnnngtnatangcttaacanatgnanagncnactnactnctgattntttatncatttgtgcattnnaactatgcttttncgatcttnctgntgnnatnacnggcatgat

SEQ ID NO: 381 - DNA, 300 bp, Homo sapiens
cagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaa

SEQ ID NO: 382 - DNA, 300 bp, Homo sapiens
gccaccggtctcttcctaatctgcacagactattttgggtatttctgggcgggcagttcctttgcatgtttcgggagaggtttgctgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgt

SEQ ID NO: 383 - DNA, 273 bp, Homo sapiens
  misc_feature 157, 158, 159, 160, 161, 162, 163, 164, 165, 166, 167, 168,172, 175, 178, 183, 186, 189, 190, 204, 208, 210, 212, 213,216, 218, 219, 221, 222, 223, 226, 231, 236, 238, 242, 244,247, 252, 253, 254, 266, 268, 272: n = A,T,C or G
gagatttgatattcgagtgctgggcttaggtctgttgataaatctagtggagtatagtgctcggaatcggcactgtcttgtcaacatggaaacatcgtgctcttttgattcttccatctgtagtggagaaggggatgatagtttaaggataggtggnnnnnnnnnnnngccngcnttnacttnatngcnnctttttcttgatcnacgncngnnatncnnannngtntatantaatncngaananttntttgnnntgctttatcaantnttcnt

SEQ ID NO: 384 - DNA, 259 bp, Homo sapiens
aagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggcccgaagagaaagctggagtc

SEQ ID NO: 385 - DNA, 296 bp, Homo sapiens
  misc_feature 264, 265, 286, 287: n = A,T,C or G
agagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcatagcgccacgggcagtgtggcttgctgccccccaggaggcctgaggctgggtctcactgctctgaaaaagacccnnccaaaatgggccttggggctnnaggcccttg

SEQ ID NO: 386 - DNA, 300 bp, Homo sapiens
gaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctc

SEQ ID NO: 387 - DNA, 300 bp, Homo sapiens
ccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcagg

SEQ ID NO: 388 - DNA, 300 bp, Homo sapiens
tggaggtctcctttcgccccagcccaggtggccaagcccatcctggcctcagaacatgctgagcacattttgtagggtggcacctttttatccaagttactagctacacatcagtgtttaaagagaaaaaagtgacctttcatttttttttcttgaaacttgaggaaacaagatacatactactgattttttttttcttaaaactaaatgcatgactgcagagcggtagaggtgtatatttttcatactgtggggcaaagtatttgtgctgctttttggagatggactggaacgtctggt

SEQ ID NO: 389 - DNA, 293 bp, Homo sapiens
  misc_feature 155, 156, 157, 158, 159, 160, 161, 162, 163, 164, 165, 166,167, 168, 169, 170, 171, 172, 173, 179, 183, 195, 196, 202,205, 208, 213, 220, 222, 228, 229, 232, 234, 242, 243: n = A,T,C or G
gtcaagctggccctggatgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcannnnnnnnnnnnnnnnnnnatgaancagntactcctatggnnttagcnttntanctatnacctgcncnaactannctnangtgctagnncttgccccaacccctacttttgtatttatattgtgtgtgcgtgtgtgcgt

SEQ ID NO: 390 - DNA, 300 bp, Homo sapiens
  misc_feature 56: n = A,T,C or G
ctcacacctgctttggatgcttcaagcacctcagccctctgaactacaaaacagangagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcac

SEQ ID NO: 391 - DNA, 257 bp, Homo sapiens
acccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccc

SEQ ID NO: 392 - DNA, 300 bp, Homo sapiens
gcgcgagcgtcggctccgcctgggcccttgcggtgcgctgcgggcaggcggtgaggctcacgcatgtgcttacgggcaagaacctgcacacgcaccacttcccgtcgccgctgtccaacaaccaggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatg

SEQ ID NO: 393 - DNA, 300 bp, Homo sapiens; identical to SEQ ID NO: 392

SEQ ID NO: 394 - DNA, 300 bp, Homo sapiens
  misc_feature 268, 272: n = A,T,C or G
gtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgccatcatctctcacnaggngaccatattggtttttgacctggagacc

SEQ ID NO: 395 - DNA, 300 bp, Homo sapiens
gcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaagcaatgatcaaagctgaagaaagcagtaagcaagaagagtgcaccacaacatcaacagccccagtc

SEQ ID NO: 396 - DNA, 300 bp, Homo sapiens
  misc_feature 197, 198, 199, 200, 201, 202, 203, 204, 205, 206, 207, 208,209, 210, 211, 212, 214, 216, 220, 222, 225, 226, 228, 229,231, 232, 236, 240, 241, 245, 252, 257, 259, 261, 276, 279,280, 285, 286: n = A,T,C or G
aagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaaaaaacnnnnnnnnnnnnnnnntntngggngnctnntnncnnaaanccanncttnataaaanccttngntnatttggaacaacccncanntaaanngcagggaaaaaaag

SEQ ID NO: 397 - DNA, 300 bp, Homo sapiens
gataaatacctcagcccctcgccttcctcaacccacctggcaagtcttcttaggatctgatcccagttttctggaagcaatcctaccccagcccaagcttcccagagtcgagccttaatccttctcacttctcagtgtcagagcagaaatgaatcctggggttgactgtgtccattcgggttattagcagctaagaagcccagacgagtagtgtgagctgccttgggagcctcagtgagggcactgggactggcctcactctcttgcccccagcctagtgggctttctcctctgtctctc

SEQ ID NO: 398 - DNA, 300 bp, Homo sapiens
ctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttctt

SEQ ID NO: 399 - DNA, 300 bp, Homo sapiens
gctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcataagatgctgtttgaggaacgaaatcattttgccgagatagagacagagttacaagctgagctggtcacaatggagcaacagcaccaagagaaggtgctgtacctt

SEQ ID NO: 400 - DNA, 300 bp, Homo sapiens
ggctagcgatttctacctgcgctactacgtagggcacaagggcaagtttgggcaccgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttacca

SEQ ID NO: 401 - DNA, 300 bp, Homo sapiens
acccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggcca

SEQ ID NO: 402 - DNA, 300 bp, Homo sapiens
ggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctc

SEQ ID NO: 403 - DNA, 300 bp, Homo sapiens
aattccgttgctgtcggacagattgccctagtacccacccacctatcagggttatgcaatggaacatcctcgcccaagctcttggagaaggcaaagacaactttgtacagtgccctgttgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtag

SEQ ID NO: 404 - DNA, 300 bp, Homo sapiens
agtgggataaaatgagacgagccctggaatataccatttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagataagagcagattaagcagaggactaagttggagcttaaagccaaggatttacaagatg

SEQ ID NO: 405 - DNA, 856 bp, Homo sapiens
  misc_feature 8, 25, 30, 33, 35, 42, 44, 46, 51, 270, 279, 292, 295, 305,307, 314, 320, 322, 323, 325, 343, 344, 350, 352, 361, 366,373, 385, 386, 389, 390, 391, 393, 401, 402, 405, 409, 413,414, 419, 421, 428, 429, 440, 444, 445, 449, 451, 457: n = A,T,C or G
  misc_feature 460, 461, 470, 473, 476, 481, 483, 484, 486, 487, 489, 497,499, 500, 510, 521, 524, 527, 531, 535, 538, 544, 545, 547,551, 555, 557, 558, 560, 561, 564, 565, 566, 568, 569, 571,574, 586, 587, 593, 595, 599, 600, 605, 607, 611, 612: n = A,T,C or G
  misc_feature 613, 614, 616, 619, 621, 622, 625, 635, 641, 643, 644, 648,658, 659, 673, 674, 676, 681, 683, 684, 687, 688, 696, 698,699, 707, 709, 710, 712, 713, 715, 717, 718, 723, 725, 737,740, 743, 745, 751, 753, 755, 760, 763, 767, 769, 772: n = A,T,C or G
  misc_feature 776, 777, 783, 785, 790, 791, 793, 797, 805, 806, 807, 808,813, 814, 816, 817, 818, 820, 821, 824, 826, 834, 836, 838,841, 842, 845, 846, 854: n = A,T,C or G
tggtgccngttcctattccgtgctntcgtnctncnccaggancnangcgtntcgaattcggcacgaggaaggaggacctaggcacacacatatggtggccacacccaggagggtagtggggagttagatttcagagtccaggccctaggttgggacccactccaaataatctcctcggtgtgggtggtggttctatagagggataaatgaataataaacattgttaaaatatacgaaaaaaaaaaaaaaaaaaaaaaaaaaaaaaaaaanaaaaaaaanaaaaaaaaaaaanaanaaaaaaaaananaaaaatnaaaaanannanaaaaaaaaaaaaaaaaanncccctncnccctaaaanattcnggggggntttttcctccannccnnntntttaatannctncttnttgnntcttngnctcaccnnttcttttggtnggcnntaananaaaatnttnnttttttttnggntanaaatncnntnncngttttttntnnttttttttcnaaaccctcctnttntanctcncgtntcnaaaaanntntttntccncnncnnttnnntnntnctntttctatttttnnttcttntncaannttccnangtgnnnngngtntnntgnggcttgtttntttttncnncctngcgtcatccnnccaataatttcttnncnccccnannccnnattttttntnncctctatntnngnngngnnatatnantcccctttattnttnatnantagtcntntnttttnttntccntngtnatannattttntntcccnntntaanttcctcannnnatttnntnnncnncgngntatatttnangntanntcnncggggttnct

SEQ ID NO: 406 - DNA, 843 bp, Homo sapiens
  misc_feature 2, 3, 5, 6, 7, 8, 9, 12, 14, 20, 21, 22, 23, 28, 32, 41,45, 55, 60, 70, 76, 447, 477, 478, 479, 482, 488, 498, 500,511, 512, 513, 514, 515, 517, 519, 520, 521, 522, 523, 524,525, 526, 527, 528, 529, 530, 531, 532, 533, 534, 535: n = A,T,C or G
  misc_feature 536, 537, 538, 539, 540, 541, 542, 543, 544, 545, 546, 547,548, 549, 550, 551, 552, 553, 554, 555, 556, 557, 558, 559,560, 561, 562, 563, 564, 565, 566, 567, 568, 569, 570, 571,572, 573, 574, 575, 576, 577, 578, 579, 580, 581, 582: n = A,T,C or G
  misc_feature 583, 584, 585, 586, 587, 588, 589, 590, 591, 592, 593, 594,595, 596, 597, 598, 599, 600, 601, 602, 603, 604, 605, 606,607, 608, 609, 610, 611, 612, 613, 614, 615, 616, 617, 618,619, 620, 621, 622, 623, 624, 625, 626, 627, 628, 629: n = A,T,C or G
  misc_feature 630, 631, 632, 633, 634, 635, 636, 637, 638, 639, 640, 641,642, 643, 644, 645, 646, 647, 648, 649, 650, 651, 652, 653,654, 655, 656, 657, 658, 659, 660, 661, 662, 663, 664, 665,666, 667, 668, 669, 670, 671, 672, 673, 674, 675, 676: n = A,T,C or G
  misc_feature 677, 678, 679, 680, 681, 682, 683, 684, 685, 686, 687, 688,689, 690, 691, 692, 693, 694, 695, 696, 697, 698, 699, 700,701, 702, 703, 704, 705, 706, 707, 708, 709, 710, 711, 712,713, 714, 715, 716, 717, 718, 719, 720, 721, 722, 723: n = A,T,C or G
  misc_feature 724, 725, 726, 727, 728, 729, 730, 731, 732, 733, 734, 735,736, 737, 738, 739, 740, 741, 742, 743, 744, 745, 746, 747,748, 749, 750, 751, 752, 753, 754, 755, 756, 757, 758, 759,760, 761, 762, 763, 764, 765, 766, 767, 768, 769, 770: n = A,T,C or G
tnntnnnnncgnangctggnnnnttctncccntttctaatngttnctaatactanggatngtcacgaggntcccangtaggcatagcgcactgctgtacgtttttggttgtttttaagaaactcgatgaagaggggtgtcattctgggctcggggtggttgccaatttttcaccagaaagggagccaccccttgcaaccacttctgtctccgttagccccccctctgccctcctccaagccaaagcgtggcctggcttttgtcttcccatttagttttcctcttttacccttccttttgtgcttaatttattaaaatagttgctgtataatttattttcataaactataaaaaaatactaaatggttaaaatagacttgcaggccaatcttaaatggggtgggaggggtctgagggtgggatggggaaagggaaagaggttttgatntaaacaaaacaaatgcactttgggtgtgtnnnggnattttnctggggatananggggtgggggnnnnngnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncn

SEQ ID NO: 407 - DNA, 743 bp, Homo sapiens
  misc_feature 6, 9, 10, 14, 16, 18, 33, 39, 52, 55, 544, 598, 615, 643,644, 671, 697, 698, 699, 700, 701, 702, 703, 704, 705, 706,707, 708, 709, 710, 711, 712, 713, 714, 715, 716, 717, 718,719, 720, 721, 722, 723, 724, 725, 726, 727, 728, 729: n = A,T,C or G
  misc_feature 730, 731, 732, 733, 734, 735, 736, 737, 738, 739, 740, 741,742: n = A,T,C or G
tgggcnggnnctantngngggctctcgacttcntacgancttccaatggttnggnggcacgagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactgttgatgtggtttggatctgtgtcctcaccgagtctcatgttgaaatgtaagccccctggtgggaggcgatgggattatggggcagagtcctcacaaacggtttacaccacccgctcagtgctggtctcctgatattgagtcctcatcacatctggttgcttcaaagtgtgtggtgcctcccctctatctccctnctgctctggccatataagatgtgcctgcttctcttcgccttctaacatgattgnaagtttcctgaggcctncctagaacaaaactgctgtgctttctgnncccatctacaggacccggagccaattnaaccccttttctttataaaaaaaaannnnnnnnnnnnnnnnnnnnnnnnnnnnnnnnnnnnnnnnnnnnnnt

SEQ ID NO: 408 - DNA, 746 bp, Homo sapiens
  misc_feature 7, 14, 16, 19, 25, 39, 42, 83, 119, 152, 443, 496, 647, 701,728, 733, 743: n = A,T,C or G
tgtccgnttcttangntgngctctngcttcctaggagtntcnaatcgcttggtgcagacctccagcacaagcctctgctagtngatctcacggtagaagaaggtcaaagattaaaggtnatttttggttcacacactggtttccatgtaatngatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatggctggggcgagaaagctattgagatccggcagtggaacaggacatttggatggagtattnatgcataagcgagctcaaaggttaaagtttctatgtgaaagaaatgataaggnattttttgcattccgtgcgatctggaggaagtagcccaagtgtttttcatgaccctcaacagaaattccatgatgaacctggtaaccagaagaaccccttggcacttatcttcatggcgttattctaatttaaaaagaacataactcatgnggacttatgcccagtctagaggcagaatcagaaggcttgggtggaacatatcgntttcctttttcctttccttcggccctnccagnccagtccatnttt

SEQ ID NO: 409 - DNA, 761 bp, Homo sapiens
  misc_feature 25, 34, 42, 43, 58, 61, 101, 376, 450, 546, 628, 662, 674,691, 700, 721, 728, 739, 755: n = A,T,C or G
ggatccggtttccaatgctcgggcnctcgagctncctaagannttgctaatgcttggnggngtgcctcgtgtgcgtggattcgtgtgtgtgtgtgtgtctngtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagagccaggaggggacctggtgtgtcacctgcccaccacctggctcatccctcangcccaccctgaccctacattacataggttacgtcagcctactgtggctgttgagcaaagcatttctcctttctngggcctcattgcactagatgggcctgtggtcccaaagtaggtcagtaggttggggttgctgacaccccttgggtgcaactttgggacaagatgaantggctctgtcctgtcactggcctctccttgcctgggggctatgtgcacttcaaaaccctggccaagctcaagcccatgaagnattggagaacaccctgggcccccaagaactggangcacccggccanttcccctgggattccanctttgccanggtgaacccttcttttacccnaaacttntgtccccctgnttccacttccaaaaanaactgg

SEQ ID NO: 410 - DNA, 748 bp, Homo sapiens
  misc_feature 20, 46, 50, 55, 58, 64, 68, 80, 83, 88, 101, 108, 115, 127,182, 207, 217, 227, 278, 365, 462, 504, 562, 622, 623, 629,641, 645, 676, 690, 696, 702, 725, 729: n = A,T,C or G
gatgccggttcctatgatgngctctcggcttcctaggagttccaanactnggctngcncgaggncttntaaatatatctnggntttantaggtgataagtnctgtcanttagtancatctgaaaaancagctttgtcctgggtgaaaaaggatgccaaaattgcctggaaaagagcagtganaggagtccgggagatgtgtgatgcntgtgaagcancattgtttancattcactgggtctgccaaaaatgtggatttgtggtctgcttagattgttncaaggcaaaggaaaggaagagttctagagataaagaactatatgcttggatgaagtgtgtgaagggacagcctcatgatcacaaacntttaatgccaacccaaattatacctggttctgttttgacagatcttctagatgccatgcacactcttagggaaaaatatggtattaaatcccattgncattgtctaacaaacagaatttacaagttggaaattttcctncatgaatggtgtatctcaagtttacagaatgtcttaatcacagtataaaattctctgngcatgcctgagtctcagcgccaaaatcctcctccgaagtctgagaaaaatggtggcagcnnccccanaaagtgatgttnggcnccagattaccaggttaacttcctccagaatnccagtcaccactgnactggntagcanatcttgccgagccaaaaagcccnaagngggaaaaaaaaaaaaaaaa

SEQ ID NO: 411 - DNA, 773 bp, Homo sapiens
  misc_feature 2, 4, 6, 7, 8, 10, 14, 38, 52, 60, 134, 181, 529, 600, 608,640, 667, 681, 683, 692, 727, 729, 746, 747, 751, 754, 761,770, 771: n = A,T,C or G
gnangnnngnttcntagtgcccgtgggagtcttagatnccctaaaaaattgntaatgctnggtcggcacgagtcaaggcctacgaaacaggtgatgcactaccccggctacggttcccccatgcctggcagctnggccatgggcccggtcacgaacaaaacgggcctggacgcctcgcccntggccgcagatacctcctactaccagggggtgtactcccggcccattatgaactcctcttaagaagacgacggcttcaggcccggctaactttggcaccccggatcgaggacaagtgagagagcaagtgggggtcgagactttggggagacggtgttgcagagacgcaagggagaagaaatccataacacccccaccccaacacccccaagacagcaatcttcttcacccgcttgcaacccgttccgtcccaaacagagggccacacagataccccacgttctatataaggaggaaaccgggaaaagaatataaagttaaaaaaaaagcctccggtttccactactgngtagacttcctgcttcttcaacacctgcagattctgatttttttgttgttggttgttctctccattgctgntggtgcanggaagtcttacttaaaaaaaaaaaaattttgngagtgactcggtgtaaaaccatgttanttttaacagaaccnanaagggttgncctattggttaaaaaaaaaaaaaaaaaaaaacttngngcctttagaactattanngagnccnatttacnttaatccannct

SEQ ID NO: 412 - DNA, 774 bp, Homo sapiens
  misc_feature 2, 4, 5, 14, 20, 41, 625, 672, 674, 687, 689, 716, 719, 757,758: n = A,T,C or G
gnannccggattcntagcgntcgtggaagtgcatcggctgntaacaatttgctaatgcttggagttccaattccagagaaaatgagtgaatgggcacctcgacctcccccagaaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttcttccccgcaaggaccccgcttacccgctggatggagagcaaaggagacccccttccgagcccgntcacagtcctgtatttggcaaggtttgggaacctgaaggggccaatntnccttgacacttanangcacttgcctttcagacaccattccgngcntctggtaaaaggggacaagaaaagccttaaccttggcnncatattttgacagggg

SEQ ID NO: 413 - DNA, 773 bp, Homo sapiens
  misc_feature 2, 3, 5, 6, 7, 8, 9, 10, 26, 27, 28, 29, 30, 31, 35, 40,50, 55, 154, 192, 509, 541, 567, 589, 647, 665, 692, 727,729, 731, 752, 770: n = A,T,C or G
gnngnnnnnntttctaatgcttgggnnnnnngtcnatgcntaagagccangcggntcgaattcggcacgaggcgggcccggccagcggaagcccctgcgcccgcgccatgtcaaagaaaaaaaggactgagtgcagaagaaaagagaactcgcntgatggaaatattttctgaaacaaaagatgtatttcanttaaaagacttggagaagattgctcccaaagagaaaggctttactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgttgaaacggaagagcgaccaggcttagcaaaagactttcttcacttcgagaccaaangggaacagctaaaggcagaagtagaaaaaatncaaagactgtgatcccgcaagttgtnggaagaaatcgccaagcaaatnaagtagcccaaggaactgcttacagatggactgattacatattcgcaataaaatcttnggcccaaagaaaaatttngggtttgaaggaaaattaaattggttngaaccttttggaatttcccgaaagacttttgcctncntngacttaaaatatttccatggnggtgaaaggttgtccaanctt

SEQ ID NO: 414 - DNA, 755 bp, Homo sapiens
  misc_feature 2, 5, 6, 7, 8, 9, 10, 11, 27, 28, 29, 30, 31, 32, 39, 43,44, 47, 49, 56, 72, 82, 95, 102, 115, 120, 154, 171, 185,215, 239, 616, 646, 652, 710: n = A,T,C or G
gnagnnnnnnnttctaatgcttggggnnnnnngtcaatncctnngancnaggcggntcgctcatccagaaangtcagatcancaaagaagtccangaaaaantgcgacccagctngaccntttgatcccaggcttagcacacgattgcatggcntcccctttagccacttnaaccactgcagacntccaggaagctggactctctcctcagtccntccagacttctggccaccacagantgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagactatcagagtatggagaaacacaccaaactacctggggacaaatgctgtcagcccttaggcaagactaaattggaaagaaaggtgtctgccaaagaaaacaggcaggcccctgtcctccttcaaacatacagggaatcctggaatggagaaaacatagaatcagtgaaacaaacccgtagtccagttctgngttttcctgggatatgaaaagaatgaccanggactnctggagtcaacttttcacttgaagaatctcaaggccaccggtcattggccacacactngaactcctttttaagatgtacccattactggaattgggcttaggg

SEQ ID NO: 415 - DNA, 852 bp, Homo sapiens
  misc_feature 2, 5, 8, 9, 10, 25, 26, 27, 28, 29, 30, 31, 43, 44, 53, 56,88, 111, 123, 194, 444, 450, 471, 491, 499, 507, 540, 541,551, 556, 575, 576, 581, 609, 632, 649, 706, 719, 733, 764,785, 786, 793, 797, 803, 806, 813, 817, 835, 842, 843: n = A,T,C or G
  misc_feature 849: n = A,T,C or G
gnagnaannnttctaatgcttgggnnnnnnngtcaaaccttannaacctggcntgncgaattcggcacgaggtcacaggcaggtttantggccagtttaaaacttatgctntctgcggggccnttcgtaggatggtgagtgtttccctgggctttgctcatcacttcgggacatcgtggactttaccgtgcgcnttggagtgtgtgatggtgcctgagtagatctgctggcagagtagtttgagccagctggactgggctggccgcctgccgcttcttgagggtggaagaggggtgctctgagaagacactcaggcagcagactctgcctctcactaggaggtgcccccccgaccccgttccaccatagtcaaggctgcaggctgccccgggagaagtggctccccttcttgcgcctgtcttccattcgcttcaccgggggganaagacnttgggcttggttggcacagcntgacccttctgcccatcttnaaggcagncccggaantgggaaaaatatttctttaaatggtggcctttnntttttttttnctttnaaaggggttgaagttccannaatgnatttcccaatttccttcccgaattgggncccaaagggccccaatggggcantcggtcctttaaaaagnaacctttttggacctgggaagaagaaaatcacccagattgttgggaaatattttggncattaaaataaantaatggaaaacctnaaaaaaaaaaaaaaaaaaaaactcgagcccnttaaaaacttttagtgagtcnnattaccnttanatccanacnttgatangaanctttggataattttgggncaaaccnnaacttngat

SEQ ID NO: 416 - DNA, 754 bp, Homo sapiens
  misc_feature 3, 4, 5, 6, 7, 8, 9, 12, 22, 25, 26, 32, 43, 94, 157, 160,185, 194, 383, 439, 535, 550, 590, 592, 607, 622, 648, 664,675, 720, 722, 727, 738, 753: n = A,T,C or G
ggnnnnnnngtnaaaccttccnaannaggctnggcgtcactgnccccggtcaacaaacccacttttatgacagttttcttccgcagcttggctnttaaattttactggcaggtgtatggttgttggagggttcctagtgagttgggggacctggcantanagctgcttggttggaggaagtgaanctggcttantaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtangcaagcttgcacataaataacccccgtcagtggagtgttcgggatgcagggggcantatagtgttcttggactttgtccgtcctggggcagtttttaagttctttatatttaagtggggtcagtgccaagtgctaccactttcccaataaangaatgggggacccanaaggctggggtccctggctaccttgttatgaaggttttgntntttctctgacaaganttgctttggaaagancctgtttttaggggattattttttgnataccccgatgggganccagggttctnctcaaaacccttacaacccttaggatcatagggaaaaggggcccntnttttnctgctggcttncccaacttaaaaacnt

SEQ ID NO: 417 - DNA, 755 bp, Homo sapiens
  misc_feature 1, 4, 13, 24, 27, 38, 50, 66, 111, 171, 181, 463, 498, 506,519, 550, 575, 576, 586, 625, 636, 667, 676, 679, 689, 699,717, 727, 745, 747, 751: n = A,T,C or G
ngtntatagcttnctaatgcttcntancgaattcggancgagagaagccntgagcagcaaagtctntcgcgacaccctgtacgaggcggtgcgggaagtcctgcacggganccagcgcaagcgccgcaagttcctggaaacggtggagttgcagatcagcttgaagaactntgatccccanaaggacaagcgcttttcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaggaataaaaactggtcaagaagcttggccaagaagtatgatgcgtttttggcctcagagtcttttgatcaagcagattccacgaatcctcggcccaggtttaaataaggcaggaaagttccctttcctgtnacacacaacgaaacatggtggccaaagtggatgangtgaagtncacaatcaagttncaaatgaagaaggtgttatgtctggctgtancttgttggtcacgttgaagatgacnngacgatgaancttggggtataacattcacctggctgtcaacttcttggnggtcaattgcntcaaagaaaaaacttgggcagaaatgttccnggccttatnttntcaagaaccnccatggggcnaagccccaacgccctttntttaaaggcncatttggaattaaattcntntttncccg

SEQ ID NO: 418 - DNA, 757 bp, Homo sapiens
  misc_feature 6, 7, 9, 10, 11, 35, 37, 63, 67, 475, 633, 706, 708, 736,757: n = A,T,C or G
tggggnntnnnttctaatgctgggatgttctaaangntgggctactcgttctttccgcaggancccntcgattcgaattcggcacgaggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgnttatgtgaaaatgcagattcactgagccagactaaggcatcagtgactgttcctctactgcctctcacatggagattgtgtattcagtgaaaggctgatcaaagaccccaaaggaatgcaccagtttatctcttatctacctatgacctgcgagctgnccaccacccccagttgttgcgcctttccagacagaaccagtgtcatcttacacgtattaattggatgtcctgngncttccttaatatgtatcaaaacaagctngccttgaacaccttgggcacn

SEQ ID NO: 419 - DNA, 738 bp, Homo sapiens
  misc_feature 2, 3, 4, 6, 12, 17, 20, 23, 24, 32, 36, 38, 39, 41, 42, 44,45, 46, 52, 54, 527, 608, 684, 687, 693, 729: n = A,T,C or G
gnnngncgttcnaattncgnggnntctttctngccnannannannngcgtgngngaattcggcacgagactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggcagcggcaaacttgttttctttgagcgtaggactttccaaagggtgtatgaaatagacatcacagatgcgagtgttgttcgctgcctgtggcatccaaagctgaaccagatcatggttggaactggaaatggattggctaaagtctattacgaccccaacaagagtcagaggggagcaaaattatgtgtggttaaaacccancggaaggcaaaacaagctgagactctactcaggactacatcatcacccctcatgccttgcctatgttcccgtgagccccgncaacggagtacaaaggaaacagctggagaaggacagactggatccctgaagtcgcattaacctgaacctcctgtancangcccangtcgtggtggccgatttggaacccacgggggcactnttttttcct

SEQ ID NO: 420 - DNA, 739 bp, Homo sapiens
  misc_feature 4, 6, 7, 24, 33, 36, 39, 41, 42, 44, 50, 633, 666, 739: n = A,T,C or G
gcgntnntattagcgtgggctcgntctcgctcnacncancnngngctggncgaattcggtacgagaatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattccctttcacctacctcagcaaaacaaactttcaagtcttgatagacttagcctagtaattttatagtgagagtttcaaactatatatcaagtgtctatagcatcaaaaacttctgggggcgtgggggaaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgancccagacagcagccataggcagataaagatttnggttcacccttggtggtgggaggcatcgtgtgtgcctttttttcctctaatatcaattttacagtccgggaan

SEQ ID NO: 421 - DNA, 727 bp, Homo sapiens
  misc_feature 10, 23, 25, 28, 35, 36, 38, 46, 49, 513, 597, 598, 631, 658,660, 703, 705: n = A,T,C or G
gtgatctttntgagtgggggccntnctngctctannanataggttnggngggctagcgatttctacctgcgctactacgtagggcacaagggcaagtttgggcacgagtttctggagttcgaatttcggcccggacggaaagcttagatatgccaacaacagcaattacaaaaatgatgtgatgatcagaaaagagcttatgtgcacaagagtgtaatggaagaactgaagagaattattgatgacagtgaaattacaaaagaagatgatgctttgtggcctcccctgatagggttggccgacaggagcttgaaattgtaattggagatgagcacatatcttttaccacatcaaaaataggttctcttattgatgtaaatcaagtcaaaggatcctgaaggccttcgagtattttactatttggtacaagacttgaaatgtttagttttcagtcttattggattacacttcaagattaaaccaatttaaattgtatgttttcaagctggttgnatatttaattaaagggatgggaaggggttatttgtcatttacagtattggggttttatgaatgtgaagcaaccaaaaaaaattnnaatgtaaaactggaaaataggaaaattcattancagcttaatgggtatccttacttgatncnctgggtttggaagtccccacacacattaaatctgtaatgaaancncttttggttaaaatttctctat

SEQ ID NO: 422 - DNA, 753 bp, Homo sapiens
  misc_feature 3, 5, 7, 8, 9, 11, 12, 16, 17, 27, 31, 34, 35, 39, 41, 42,44, 46, 48, 54, 99, 579, 708, 714, 716, 720, 753: n = A,T,C or G
gtntngnnngnngttnnattatatggntcgnctnnctcnannancnangcttgngctgacaacttgattgggttctccttcaggtttgaagcgccctcnagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaataggggaaactattcagagaaaacttaagccactaagttttatggtgttttgttcttgtagccagaagcataggcatactggccaatacaaaccgaaatccttctaacgtantggacccttttcaggccagcattttttcccttgaaaacctgggagccttgtattccatcttattagcagaagatcactttcaccaatggtttgggctcttgatttggaattgatgatgtaatgagcctntattcnanatgngacttaatacctctgcgaattgactggattccn

SEQ ID NO: 423 - DNA, 844 bp, Homo sapiens
  misc_feature 1, 4, 5, 6, 9, 10, 11, 12, 13, 14, 15, 18, 21, 31, 43, 50,51, 52, 53, 93, 106, 171, 299, 368, 370, 382, 421, 450,454, 462, 481, 496, 513, 558, 565, 577, 582, 589, 609, 614,627, 636, 649, 652, 663, 672, 677, 686, 692, 711, 714, 736: n = A,T,C or G
  misc_feature 741, 752, 754, 782, 805, 807, 815, 824, 835, 844: n = A,T,C or G
nggnnnttnnnnnnnatnccntgatcgtgtntcgttctttctncaggatnnnntcgtttcgaattcggcacgaggaaaagggagccgcgcagngcctacgggagtncggcggcagcagccggtaccggcaaccacgggcagctctcagggaatctccgtcgttgaggccanaggctccagtccccgcgagtccagatgcctgtccagcctccaagcaaagacacagaagagatggaagcagagggtgattctgctgctgagatgaatggggaggaggaagagagtgaggaggagcggancggcagccagacagagtcagaagaggagagctccgagatggatgatgaggactatgagcgacgccgcancnagtgtttcagtnagatgctggacctggagaagcagttctcggaagctaaanggagaagttgttcaagggaacgacttgantcanctgccggnttgcggcttggaaggaaantgggggggcttgaanaagaagcccctggaatnccaccggaagcccccttttgggggggggccttgcaaaccgggaanccctttnaaaggaatttcngccantttcaanggttgggccaaggggaatcntaccnaaggggccttctnggccttggnatggtgaatccanggnaaattaaggtncccaattgntgaanccttccaangggaancccaaaccagcacccttgnaanaagttgagaaaacttgcttgcntcttntgacacccctncnagggggaacttcaaggaaccggttcctnaggcttggaaggaggacccccananccctggancctaaattnttaaatgggtnggaccaccn

SEQ ID NO: 424 - DNA, 799 bp, Homo sapiens
  misc_feature 5, 6, 7, 8, 10, 11, 15, 20, 21, 22, 27, 28, 29, 30, 31, 32,33, 40, 41, 44, 456, 480, 556, 670, 672, 752, 771, 783,785, 798, 799: n = A,T,C or G
ggagnnnngnntccnaattnnntgggnnnnnnngtcaaannctngctactcgttctttccgcaggatcccatgcgattcgaattcggcacgagcccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaacttttttttttttttttgagacggagtcttgctctgtcgcccaggctggagtgcagtggcgcgatctcggctcactgcaagctccgcctcctgggttcacgccattctcctgcctcagcctcccgagtagctgggactacaggcgcccgncaccacgcccggctaattttttgnatttttagtagagacggggtttcaccgtgttagccaggatggtctcgatctcctgacctcgtgatccacccgcctngggcttccaaagtgctgggattacaggcgtgagccaccgggcccgggccaaaagccaactctttatgcctagaaaatattgtgcaccctatgacccaagcccattgaatttttncngggaaatttatggtaaattattgaaatggatggtacctttaaaaagttatttggcacattccccttgggttacctttggnatggtttgccagggaattnaaaactttgggntnaaaccttttttann

SEQ ID NO: 425 - DNA, 750 bp, Homo sapiens
  misc_feature 3, 18, 21, 26, 31, 35, 36, 41, 58, 61, 466, 616, 678, 681,682, 683, 684, 685, 686, 687, 688, 689, 690, 693, 695, 696,697, 698, 699, 700, 702, 703, 715, 730, 734, 745: n = A,T,C or G
gangccggattccaattntcnggctnctctnaaannctgtntaatgcttggtccgcangancccatgcgattcgtggaggtctcctttcgccccagcccaggtggccaagcccatcctggcctcagaacatgctgagcacattttgtagggtggcacctttttatccaagttactagctacacatcagtgtttaaagagaaaaaagtgacctttcatttttttttcttgaaacttgaggaaacaagatacatactactgattttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgcctggcgccgtttanagctgggagcccgtggactccggcctgtttctaccttctattcaaccactctgacgtggggagacaagaagaaatagaactttttgatagtgtggtaaaaacattggattttgaactattttagtaaaaggagttaccaacaagaatgtnataggtgctactttgagctagataaataaaggctctttgtgagcctcctgaaaaaaaaaaanttnnnnnnnnnnatnannnnnnannaaaaaaactggncctttaaaactttangggncgtttacctanaccct

SEQ ID NO: 426 - DNA, 819 bp, Homo sapiens
  misc_feature 2, 5, 6, 10, 28, 32, 37, 38, 53, 58, 59, 62, 65, 66, 67,68, 69, 75, 76, 420, 528, 574, 595, 637, 647, 733, 739,743, 774, 812: n = A,T,C or G
gnagnncggnttcttatgatcgtggctnctcntctannggttgtgtaatgctnggtcnncangannnnntgcganncgaattcggcacgaaggggggttcccaatagtagaaaagggtccccattcctgctcagcaccgcacctctctacccccccacagacacacatgcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgcagatcacatgcacacacacatacacacactggcccctgtttttctgtggtgtcactgggtgccagcaactcggtatctnccaccttccactaaaacctgggccttaatttctctcccgtccccacccctaaattcctgatggatgaacctagagctgtcctgtccactccaggccggactgacgtancctatgggcccagcaggtccagggcccacgttttaatttctttttnaaaagctttaggtcttggccnggccgccggtggttcacgccttgggagttcccagcatttttngggaaggccnaaggccgggttggattcacaaaggtcaagcaagtttcaaggaaccaagccttgaaccaggccattgggtgaggaaccctgggcttnttactngggnaaattcccaaaaaaaaattggccttgggccnaagggtgggcaagggcacccttgttggggtccccaaantttacct

SEQ ID NO: 427 - DNA, 750 bp, Homo sapiens
  misc_feature 4, 5, 6, 12, 17, 25, 33, 34, 38, 55, 58, 61, 62, 588, 605,680, 707, 716, 740: n = A,T,C or G
gagnnngattcnaattnctgggctnctctcttnntatntaatgctgggtccgcanganccnntgcgattcgaattcggcacgaggtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaactggatgactccagatggaagccttgcagtttgctctcacaagggaactggctattattcaaggaccttctggaacaggcnaaacctatgtgggtctnaaaaattgttcaagcccttctaccaacgagtcttgtttggcaaaattaaccttcagaaattcccatcttggttgngtgtatactaatcatgctttggaccanttctggaangcttttccattgtcagaaaaccanatttggccgg

SEQ ID NO: 428 - DNA, 943 bp, Homo sapiens
  misc_feature 2, 3, 5, 22, 27, 38, 40, 49, 62, 68, 69, 72, 73, 96, 130,137, 191, 236, 240, 242, 246, 249, 250, 255, 256, 272, 283,297, 316, 317, 319, 324, 327, 332, 334, 339, 381, 391, 430,438, 446, 473, 475, 477, 480, 481, 484, 487, 494, 495: n = A,T,C or G
  misc_feature 497, 501, 511, 515, 521, 524, 529, 530, 534, 537, 541, 542,548, 552, 560, 561, 563, 566, 569, 577, 580, 581, 583, 585,586, 589, 596, 602, 606, 608, 609, 610, 613, 615, 616, 619,623, 624, 627, 633, 635, 637, 639, 640, 641, 643, 644: n = A,T,C or G
  misc_feature 645, 646, 650, 651, 652, 658, 659, 660, 667, 670, 671, 676,678, 679, 683, 684, 687, 692, 694, 696, 697, 698, 701, 702,704, 715, 718, 719, 724, 725, 726, 730, 734, 735, 737, 738,739, 741, 747, 748, 749, 751, 752, 753, 755, 758, 759: n = A,T,C or G
  misc_feature 760, 761, 764, 766, 767, 768, 769, 771, 773, 775, 777, 779,780, 781, 783, 785, 787, 792, 793, 795, 797, 799, 800, 802,804, 806, 807, 808, 809, 814, 820, 825, 826, 827, 828, 829,830, 832, 835, 838, 842, 843, 846, 849, 850, 852, 853: n = A,T,C or G
  misc_feature 856, 857, 861, 862, 863, 865, 867, 868, 869, 870, 871, 872,874, 877, 879, 880, 881, 882, 883, 884, 886, 891, 893, 894,895, 897, 898, 903, 904, 906, 907, 908, 909, 911, 912, 913,914, 915, 916, 918, 919, 922, 924, 928, 930, 931, 932: n = A,T,C or G
  misc_feature 933, 934, 940: n = A,T,C or G
gnngnccggtttcctattctcnggcanctctcttcctncnacctattanctggactctaaanaaaagnntgnngcggttggctcaagggccaccanaacatttctttattattattattttttaacctgnacatgcnttaaagggtctattacctttctttccgtctgtctcaacagctgaaatggggccnccaaggagtgccttccttttgctccctcctactgggactgacggntggnantgtntgnncccanntgggggtgtctcctgnctgggaagganggaaagggaggcanagttttgccggggttgcanntngacancangctgnanagganatggctaataactgtttaatggaaacctgcttgggcttgganggaacttagnctgaattttcccgacttcctctgccagttattgacacantctctttntaagacangaaataaactaaaccccaccccaaggnantnatnncangcngaaaacnncncatngcccacattncctnatcccntancaccnnctcnttntttnncccaanactncttcccanntntcnccntttacccntanncntnnttntatcccnctaatncctnannnccntnnttntccnnatncttacncncncnnntnnnncccnnntctttnnncccaaanctnncctcncnnttcnnctnaaccntntnnncannanacacccttctnatnncccannntctncacnntnnntntctccnnntnnncnccnnnntcntnnnnanancntntnnnanancnatctnntncncnncnantnnnnttcanttcacnctctnnnnnntntanccnattnnccntcnntnnccnnttannncntnnnnnncnaantnnnnnnanctctncnnncnnctcanntnnnntnnnnnncnntcnanaccntnnnnntctatnccc

SEQ ID NO: 429 - DNA, 775 bp, Homo sapiens
  misc_feature 2, 4, 6, 7, 8, 9, 10, 11, 12, 20, 22, 29, 30, 31, 32, 33,34, 39, 40, 45, 46, 57, 63, 65, 71, 74, 480, 481, 482, 483,484, 485, 486, 487, 488, 489, 546, 577, 609, 616, 622, 640,667, 687, 688, 690, 716, 717, 725, 727, 728, 732, 741: n = A,T,C or G
  misc_feature 753, 756, 758, 760, 775: n = A,T,C or G
gnangnnnnnnntttctaantncttgggnnnnnngtcanngattnngctaaaggttnggatcncncgcagnaangctgtggcgctccattgtgaaagatccaggcatttttccgagccaggaaaagcccaagatgactacaggatattagtgcatgcaccccaccctcctctcagtgtggtacgcagatttgcccatctcttgaatcaaagccagcaagacttctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcattnnnnnnnnnntttttttgagctcaaagaaagttctcattttccctattcaactaatacccatgccgngttttttaccttggatttaaaggcaccttangttggggcaacagattctcactcatgtttaanacctggnattcancttcataagaccaaaganggagctttccctttctctttacccctnaggattctcatcctttacanntngactttttccaggccaatttcccatnnaatctgcnanncccngccttttgncccaagcttttntgntngnccccccatttacccn

SEQ ID NO: 430 - DNA, 763 bp, Homo sapiens
  misc_feature 1, 7, 8, 9, 10, 11, 12, 21, 28, 29, 31, 32, 34, 35, 36, 38,39, 40, 41, 51, 58, 75, 80, 81, 82, 83, 496, 717, 721, 754: n = A,T,C or G
ngggtgnnnnnntttctaatnctggggnncnntnnncnnnntttcctaatncttaggngctcgttctttctccangcagnnnngcgtttcgcgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcangaaggggtgtgctgagttctataatataagctgccatatattttgtagacaagtatggctcctccgtatctcctcttcctaggagaggagtgtgaacaaggagcttagataagacaccccttaaacccattcccttttccaggagacctacccttcacaggcacaggtccccaaatgagaagtctgctacctcatttctcatctttttactaaactcaaangcantgacagcagtcagggacagacattcatttcttnataccttcc

SEQ ID NO: 431 - DNA, 761 bp, Homo sapiens
  misc_feature 8, 9, 10, 11, 25, 26, 28, 29, 30, 34, 36, 37, 64, 69, 72,73, 74, 77, 78, 85, 507, 620, 639, 716, 720, 723, 756, 760: n = A,T,C or G
tggtgttnnnntcctaatgcttggnngnnnggtnanncttctaattactttggggctcgttctntctcnacnnngcnnggcgttncgaattcggcacgagcttgaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaacgagactcgtgccaaacttgatgagctttctgctaagcgagagactagtggagaaaaatccagacaattaagagatgctcancaggatgcaagagataaaatggaggatatcgaacgccaagttagagaattgaaaacaaaaatttcagctatgaaagaagaaaaagaacagcttaatgctgaaagacaagaacngattaagcagaggactaanttggagcttaaagcccaagatttacaagatgaactaccggcaatagtgaacaaaggaaaccgttttttaaaagaaangccnaanctgcttgaaaaaaaaaaaaaaaaactcggcctntaant

SEQ ID NO: 432 - DNA, 748 bp, Homo sapiens
  misc_feature 2, 3, 6, 8, 9, 25, 31, 35, 36, 46, 57, 622, 648, 686, 695,705, 732, 734, 746, 747: n = A,T,C or G
gnngantnngtcttattatcgtggngctctnactnnctctaaatanaattgtgttgngggaattcggcacgaggccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaagcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagcttccaaaatccatatcctcactctgagtcttggtatccaggtatttgtttcaaactggtgtctgagatttggatccctggnattggatttcttaaggacttttgganggctcttgacaccatgcttcacagaacttgggcttcanaagcttcanttttttgcanaggtgccccaggttaggaaaacagttntncttgttttgtannt

SEQ ID NO: 433 - DNA, 769 bp, Homo sapiens
  misc_feature 4, 13, 14, 15, 17, 18, 19, 23, 26, 27, 28, 29, 31, 33, 34,38, 67, 73, 75, 76, 77, 82, 84, 87, 575, 591, 683, 689,691, 719, 737, 760, 763, 769: n = A,T,C or G
gggnaaaagtttnnnannngggnagnnnngntnnaccnttcctattactttggagctcgaactcgcnccacanannnagtgncntgngctgttttgcagatgaggaaaactgaggtacagaattcttagggaacttacccaaaatggcttttctgcactctgccctttggtattgtcccatgtgaattgtttaaaacttatgtgtatagtggcatgagtaggtgatttcagaaacagaactcacttttgttgtttggtcttaaaattaggaacttttcttcatctgggcttcatttccctgcaccttcccagctttctagtcatgcaagccacatgtctccacgtgaggggttcattggaaagcagccacagagccaccccctggctgggttcttccccagctctgcttcctccttccccaagtcctgcagctgctctctccatggcagaaccacttctccccttactggaggggaggtccactgaacaaatccaggagaggaatcattgtgttttccacagaagagaaagtacactggactttctgtgcaacctgttactacattttcacaganactcatatttgtgcantgtaactcaatttgaaacccagcaaaattaggctcccgtgtctccataaaaggccaccatgatggtaaccgttggacttcaccttgtgtttnggacanangctgattggattttacccatcatcacanccgtgtcttacattctcntttcctgggctttggacccctgntanaaaaan

SEQ ID NO: 434 - DNA, 764 bp, Homo sapiens
  misc_feature 4, 15, 16, 19, 29, 37, 38, 40, 43, 44, 46, 47, 48, 55, 437,452, 548, 598, 625, 628, 685, 690, 695, 719, 735, 736, 739,754, 755, 758, 763: n = A,T,C or G
ctanccttcctaaannctnggctactcgntctttctnnanganncnnntgcgatncgaattcggcacgagcaccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttcttttttttttttgagatggagtctcgttctgttgcccaggctggagtgcagtggcctgatctcggctcactgcaacctctgcctcccaggttcaagcgattcttctgcctcagcctccagagtagctgggactatagacatgcaccaccacgcccggctaattttgtatttttggtcgagacggggttttgccatgttagtcangctggtcttgaactnctgacctcaagtgatccaccactcggcctccaaagtgttgagatgacaggcacgagccaccagcccaacctgagtggtattttctttagggaccangtagactttaaaacgagggtaagagaaaaagcccagtggtcttttctganggtaaataaatttctgcccaggaaacnttnccaagccccaaccagcaagccaacccttaaaaaaaaaatcacttcgtgttccccaanggganctttnttaaagctttgggggcttccaggnaaaatcatttccagtnnaantttggaagaattcannagnatttnt

SEQ ID NO: 435 - DNA, 755 bp, Homo sapiens
  misc_feature 2, 3, 4, 5, 6, 19, 20, 21, 22, 24, 25, 26, 28, 32, 33, 41,48, 62, 68, 71, 548, 576, 612, 618, 626, 631, 638, 655,660, 663, 750, 755: n = A,T,C or G
gnnnnntttctaatgtggnnnngnnngntaannttctaaancttgggntctcgttctttctncagatnccntcgattcgaattcggcacgagggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagggtgcctggggaagagccactgcgcatgttatctttggtgttactccagtgttgaacanagagctggtcagaggcagtgcatcgcanagagacattaataagggaatcctttgaatccctaancagcancagctttnctganggggccnatgatgccagtgacctnttcanggnaagtctgggacattgggaccaccctggggggaagaacttgtgggatgtggcttttcttttatgaataaagtactttgagttggttgnaatcn

SEQ ID NO: 436 - DNA, 760 bp, Homo sapiens
  misc_feature 9, 10, 11, 12, 13, 15, 16, 17, 21, 22, 23, 24, 29, 35, 49,57, 59, 60, 61, 64, 65, 71, 74, 451, 456, 537, 545, 603,644, 658, 676, 679, 695, 697, 708, 727, 731, 737, 738, 739,750, 753, 756, 759, 760: n = A,T,C or G
aaggctggnnnnngnnntgcnnnncttcntattantctgggggctcgtnctctctcnannnagnnaggcgntgngaattcggcacgagctcaagaaaaggagaaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtcccaagtatttaaaaatgactctcttaagccttaaaaagtcatagatttgtgctgctgccagaattatattaattattattaatggtattattagaaaaaaaatttctggagtgagagtnaagangcttaattagtttgtgggcagttttcatatgctctgtgaaatgtgtccagatgtgacataagtttttttttttaatatggnggaaatgncttctctttcccattcttttctcctaaaaatcatatatactgggaatatatgcctctnttacctctattaccctcctcacatttaccctttcccagttnggttttgctttttnaccaaaaagattccaatnccnaggtattggcaagttntnaaaaccgcccnttaaacatccctaatttcncagnattccnnncttgccaaatnttngtntcnn

SEQ ID NO: 437 - DNA, 748 bp, Homo sapiens
  misc_feature 3, 4, 5, 6, 7, 9, 10, 11, 13, 15, 16, 29, 35, 41, 45, 50,52, 53, 54, 56, 58, 59, 67, 603, 613, 668, 685, 686, 687,689, 698, 705, 708, 713, 736, 738, 739: n = A,T,C or G
ggnnnnngnnngntnncgttccctattantcaggngctcgntctntctcnannnancnnggcgtgtncgaattcggcacgaggattttcgaaactcttcagctacttgcccttttttatctgaaaccatcataccttctgaaagaaaaaagcatatcttcattgacataacagaagtgagatggcccagtcttgatacagatggtccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggaggggaagaactgccttcgcctggtacaaagcacacatgtgtatacacatgggtcaagcagtgctggtctgtggctgnctgtccagangaatggaaatatccttggctttagcacttcattttcataataaaatcagcaattntgtctaaaaaaaaaaannnanaaaaaactngagcctntanaactntagtgagtcgtattacgtagatncnnacatgataa

SEQ ID NO: 438 - DNA, 823 bp, Homo sapiens
  misc_feature 9, 10, 16, 26, 28, 32, 37, 42, 43, 44, 46, 52, 364, 388,440, 445, 501, 532, 535, 538, 554, 565, 569, 605, 607, 616,631, 640, 649, 704, 709, 710, 715, 722, 752, 803, 809, 821: n = A,T,C or G
taatccttnntattgntcgggtactngntctntctcnaagannntntcgttncgcccaggtagctgagactacccacaccttggtcccagctacttgggaggctgaggtgggaaaatcactttgcccaggaattcaaggccgcagtgagctatgattgcaccactgcactccaggcaacagagtgagaccctgtcttaaaaaaagaagggagaaagtgtcagatggtgatgaggtctgggggggaaatagagaatggggatcaggagtgtggatggtggtattccctcaccaagaggtgacatgttgagcagggaacttgggaggtgagggtgtgacccgtgtggaaatcagggaaaagcattncagcctgagggacagccaatgcanaggccgtgaggtggccagtgccactgagcagtgagcttgggatagggggcangtgangaggctggagagcggggtcagacaaaccaatatgcttatttaaaacaaggttgttncagcacccttgccttaaagccttgagcctgnaanctngaaaaatttgggcacnttcaaaagcangganggaaaccaaaagaagattgggagggaaaagcccttncnttcccttancaggaaatgaagttnccacccttnaaaacaggnccaggacctttttgggacccttttggccttttggttccttagaatcctcttggtngcttnngaatnaaaaggnaaaaggggcctttaaggggggatcccattntttccaaaattcaaagggggctttccctgggcttacccaaaatttcttggncttaantaaaaaaatttntt

SEQ ID NO: 439 - DNA, 767 bp, Homo sapiens
  misc_feature 2, 3, 4, 5, 6, 8, 21, 22, 23, 24, 25, 26, 27, 28, 57, 65,68, 70, 75, 76, 235, 252, 408, 627, 712, 745, 762, 763,766, 767: n = A,T,C or G
gnnnnngnttctaatgctggnnnnnnnnggtaccctttccaaaacctgggctctcgntctttctncangnagccnngcgattcgtctgtctggtgatttttattttaagtgaacctttggatctatctttaactctctttattgtgagtctaaattccaattctgcagcagatcagtaaactcacagtatttttcctgtggaaatctattcaataaggaaaccaagacaggatantaaaatttaaaaaaaancaactttgaattcccctgcctaggtcttccagttgttttccagcgcatacctcaggtatgactttgctagccggggacaaaattagcaccttccgattctctagtccaaatgaactttggctaaataaaaaattattatactacataataaagttncagatagcaggaaatgcaagagctaggagattcctagattatatctggccaagccaaataccttaaacatccacctggaaatcctctaccccctcttctgagataatttgcccagccctttcttcccacacactcactcaatgtcacccccttctaatccccaaaactgtttttgtggccttggtagcctatagtagtttctcacatcttttcccctanacttttctgttttcagtttcagaccaaaaaaactcttcaacttttttccagtggggtcttccttaccagtaactttaccacttgnaatcttatttcattgaaaaaaccttaaatgggntgggaaaaggcttgccnncann

SEQ ID NO: 440 - DNA, 752 bp, Homo sapiens
  misc_feature 1, 4, 5, 6, 7, 8, 23, 24, 25, 26, 27, 28, 29, 30, 33, 48,52, 73, 75, 76, 80, 82, 568, 584, 590, 599, 625, 680, 692,741: n = A,T,C or G
nagnnnnntttctaatgcttggnnnnnnnntcnatgcttccaaaagcngggngctcgttctttctccaagatncnngcgntncgaattcggcacgaggatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaattcatcagcaccagaaagtttgggatgtttttcagatgagtaaaggaccaggtgaagatgttgacctttttgatatgaaacaatttaaaaatcgttcaagaaaattcttcagagagcattaaaaaatgtgacagtcagcttcagagaaactgaggagaatgcagtctggattcgaattcctggggaacacagtacacaaagccaaaccagtacaaacctcctacgtggtgtctactcccagactncgtacgccttcacgtnctcctncatgctgangcgcaatacaccgcttcttgggtcangaattagaagctactgggaaaatctaccttccgacagaagagatcattttagatntaccgaatgaanaaagcttgcattagtgacattgaaagggaaataaaaattcctacagtcnaaaaaaaaaat

SEQ ID NO: 441 - DNA, 775 bp, Homo sapiens
  misc_feature 2, 7, 24, 25, 40, 59, 60, 64, 67, 69, 71, 75, 78, 82, 103,217, 242, 262, 285, 339, 366, 368, 379, 389, 435, 514, 537,539, 540, 542, 545, 561, 570, 572, 574, 582, 589, 592, 598,602, 622, 625, 630, 644, 645, 653, 654, 686, 690, 701: n = A,T,C or G
  misc_feature 706, 712, 717, 719, 723, 724, 725, 726, 736, 738, 740, 741,749, 758: n = A,T,C or G
gnagccngattccaaaacctgggnnccgatccaatgcttnccaattacttgggagctcnnactngcncnancaanctngccntgcgaattcggcacgagaagnaggcggagcttgcagtgagctgagatcgcgccactgcactccagcctgggcaacagagtgagactctgtctcaaaaaaaaaaaaaaaaaatggaacgcagggcaagaactcgtntttggaaggagatgggggaaaggancggtattatacctatgttgnatttgcaggcaaatgagatgganccctctctgtaaagaagagtcatttgtgcaagtagacggggtctgtgggtgcangccctggaggggcacacaattgcctgnangcttctgtganatcgggaganggaggagaagcagtctcttgacaaaataaagtatttttattcattngtatttattaaatgaaaaaacaatcccatggtgtcccttgtgtgtggtggaacctaatgactgttgaaataaagtctgngttttcccttcaaaaaaaaaacncnnanaanaaaaactcgagccctntaaaacctntngngagtccgnattaccntanatcccngacnttgataaggatccattgatnaantttgncccaaccccaactnngaatgccnngaaaaaaaattgctttatttgggaaatttgcnaatnctttgctttantttgnacccantttancntcannnnccaagttacnancnncaattgcnttcatttanggttcaaggttcaaggg

SEQ ID NO: 442 - DNA, 804 bp, Homo sapiens
  misc_feature 4, 5, 6, 8, 22, 23, 33, 37, 56, 57, 66, 69, 70, 75, 80, 212,216, 309, 380, 425, 431, 447, 480, 517, 544, 549, 550, 564,566, 570, 574, 581, 602, 608, 613, 652, 654, 657, 694, 698,701, 704, 706, 723, 725, 747, 753, 785, 798, 799: n = A,T,C or G
gagnnngnttctatacctgggnncgatccaaancttncctattaccttggatcttnngctatctcnaannaaaangcttncgaattcggcacgaggccacctgcactgaggtctgggcccggggacagggtgctttagccaggcttgtctgcgcctcagggaagggtgagcagcccagggaccagatgcaagttggtgggcccctccacccntccnacgccactccccagtgtgctgggtcctaaccagtcgtcctatgggagcagtcagccttcctctcctcctcagggcagctctcccacctgctgntccccgcacacagaacctcattgctctgagcagttgcttattacccagttgttgaaaaactagcatgtganggccgggcgcggtggctcacgcctgtaatcccaacgctttgggangccaangcgggtggatcatgangtcaggagatcaagaccatcctggcttaacacngtgaaaccctgtctctactaaaaatataaaaaagtanccaggcgtggtggtggcccctgtagtnccaanntacttgggaagctnangcangaanaatggcntgaacccaagaaggaagaacnttgcantgaancttaaaattgcgcccactggaatttcaaaccttgggccnanaanaattgaagaatcccgtcttaagaaaaaaggaaaaaantttnccnttntnaaaggcccggccacaantnggctttaacgccctggtaaatncccaancactttttggggaaggcccaaaggcaaggccnggattcaattttnnaaggg

SEQ ID NO: 443 - DNA, 786 bp, Homo sapiens
  misc_feature 2, 23, 24, 27, 44, 46, 54, 61, 62, 69, 70, 72, 73, 74, 78,83, 351, 522, 550, 691, 707, 727, 733, 746, 747, 752, 758,766, 775, 784: n = A,T,C or G
gnagccggatcttattattggcnncgntttaatgctggctaatntntcgtaatncttggtnnccccaannannnaggnggggngaattcggcacgagcaccatttttattttgatgcttacactcatttattctgtttttgtaaaacagtttcaagaatttaaaaatccttccagttaatagagcttttgttattatattataattttgtaaacccactttgtttttcccactttaaagccacagggtcgactcatggatgatacctctattgctgctgcatgatgttcaagaccggcccttggctgttgttacagagatgttgggcagagctatgcaggtgtttcattgngaactctagctttgatcatggtaaaaagttaaccctttctattttttaatggatgttataccaactattcagaggactcatacttcaaaaatattaggaaaatctgtcttatagttctctaataaatatctgaaatctcaagtacgacatgaaagaatgtcagaccattgntattggtgaaagtcatttgatgaatggnaaattctatgaaaagtaagtggatttgcatggattaatatcagggaaaatttaagccttcccaagtgtgactgggccaaagagagccagatgcccccagtgcctgtgcccataaagttcccgaatcccccaatggggtctnttttcaaaaacttggnccagacccggaaaataaaancattcntcataaattcaannggggncctcangaaacacnttcccccancaacccttngg

SEQ ID NO: 444 - DNA, 760 bp, Homo sapiens
  misc_feature 2, 5, 13, 14, 16, 19, 21, 26, 27, 49, 52, 54, 63, 70, 71,74, 225, 489, 494, 513, 549, 559, 566, 573, 600, 622, 684,703, 706, 709, 714, 750, 755, 760: n = A,T,C or G
gnagnccggttcnnangcntnggctnnatccaatgctggctaaagttcnaananctggcaacnccagganncangcgttgcgaattcggcacgaggaggaattacaggtagcaaattatggagttggaggacagtatgaaccccattttgactttgcacggaaagatgagccagatgctttcaaagagctggggacaggaaatagaattgctacatggctgtttnatatgagtgatgtgtctgcaggaggagccactgtttttcctgaagttggagctagtgtttggcccaaaaaaggaactgctgttttctggtataatctgttgccagtgggagaaggagattatagtacacggcatgcagcctgtccagtgctagttgcaacaaatgggtatccaataaatggctccatgaacgtggacaagaattcgaagaccttgtacgttgtcagaattggaatgacaaacaggcttccctttttctcctatnggtgnactcttatgtgctgatatnccatttcctagtcttaactttcaggagtttacaatngctaacactncatgatngattcantcatgaacctcatccatgttcatctgnggcaattgcttaccttgggggntcttttaaaaagtaccacgaaatcatcatattgcattaaaacccttaaaagttctggtgggnatcacagaagacaaggccnaanttnaaagnggaggaattttattatttaaaagaaccttttgggtnggatnaaaan

SEQ ID NO: 445 - DNA, 761 bp, Homo sapiens
  misc_feature 16, 21, 51, 53, 66, 70, 76, 78, 83, 84, 87, 89, 91, 93, 583,600, 605, 619, 637, 664, 666, 678, 761: n = A,T,C or G
tggtgccggttcttantctgngctctcgtcttccttcttatacctgggcancncttggcggccccnaggntcccangnagccnngcngngncngattcggcacgagattccaaaggtttcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtggtcattgatggcctttagtaaattggagctgcttaatcatattgatatctaatttcttttaaccacaatgaattgtccttaattaccaacagtgaagcactacaggaggcaactgtggcattgcttccttaaccagctcatggtgtgtgaatgttataaaattgtcactcagatatattttttaaatgtaatgttatataagatgatcatgtgatgtgtccaaactatggtgaaaagtgccagtggtagtaactgtgtaaagtttctaattcacaacnttaattcctttaaaatncacanccttctgcctctgnatttggaagttgtcagtncaactcatcaaagaaaactgcctaatntnaaaatcatattntgggaataatttccctcttttgtagtctgcccaagatccttaaagattggatttttattactatttaaaccagtggattaatn

SEQ ID NO: 446 - DNA, 770 bp, Homo sapiens
  misc_feature 5, 6, 7, 9, 10, 13, 16, 19, 25, 26, 27, 42, 50, 51, 59, 60,72, 74, 75, 78, 88, 363, 516, 533, 537, 583, 592, 602, 605,607, 609, 621, 651, 653, 662, 663, 673, 675, 677, 694, 700,726, 733, 737, 740, 749, 751, 752, 757, 759, 761, 765: n = A,T,C or G
  misc_feature 766: n = A,T,C or G
tgggnnngnnccnaangcnggggannnggtccccgttccaanactggaanncttggcanncgaactcgctcnannagnaaggccgggngaattcggcacgaggccccgctccatgagcagtgactccccagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattggntatgtgaaaatgcagattcactgagccagactaaggcatcagtgactggtcctctacctgcctctcacatggagattgggtattcagtgaaaggctgatcaaagacccaaaggaatgcaacagtttatctcttatctacctatgacctgcganctgccaccacccccagntggngcgcctttccagacagaaccagtgtacatcttacacgtattaaatngatgtcccnggggctcccnaanangnatcaaacaagcngggcctcgaccaccttgggcacatatcccnanggacatcannctggaggctngngncactggcattggccctnaccctnggcaaaataaaccttctaaaattggnaaaaaanaaanaanaaaaacctngnnccctntnanaacnntacg

SEQ ID NO: 447 - DNA, 757 bp, Homo sapiens
  misc_feature 7, 8, 12, 15, 21, 22, 24, 25, 26, 30, 42, 49, 51, 71, 73,131, 567, 584, 589, 656, 696, 700, 739, 747: n = A,T,C or G
tggtatnntttnaangctggnngnnnggcnccgttccaatgnctgggancnttggcaatcgctctttccgnangatcccatcgattcggtctgatgcaggagaattgctaaaacccaggagggagaggttncattgagccgagattgcgccactgcactctagcctgggcgacagagcaagactccgtctcgaaagaaagaaagagaaaggaaattccccagggaagtacctcggcttatttcataaacaggtactgaaggaagcagaggcatgtggaggacttccccacctcgtgcagctatttgggccgtggcatctgaaatttcttatttcagagtcacccctttgatgaccttggcagtgaactgcagtcatctgtttaggcctttccatggcccacgtcaatgccggtatttctgtttgttgcacatttgatttccttgttgttggcatttagaaggccccccgtttcccagatcacaccacgggcatggaccacagagattgcatcttgtgagtctgtagaaatggtcaaggccttgtcctctcttaagtccagagctcangttaatgcaaaattttnccggncatctgtgctgaaatccctttggggaagctcctggctggtttcctgtaggtaggacagctacacgtnctgccctttattggcttcttttcatgaagctcctgccatntacnaaacatgtctcccttcttgaatcacatctctggtattgnaactctanaatcgcccgg

SEQ ID NO: 448 - DNA, 770 bp, Homo sapiens
  misc_feature 6, 7, 8, 9, 26, 28, 29, 31, 34, 37, 40, 57, 72, 80, 83, 85,91, 97, 585, 739, 746: n = A,T,C or G
gggtgnnnngtttctaatgcttggtngnncnggnccnacntttctaatgttcggaanggcttggctactcgntctttctncangnagcccntcggtncgaattcggcacgaggtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctncattcaggctgttttttcagatgcccaaatgcatatttgggcattagaaaggtctgtcgcacttagtagcagcatcattttacagaggatagatttggagttgtccagacgacactaccagctatccttaatactttgttgacacttgcaagangcagtcngacaagtactttaacttcctcatg

SEQ ID NO: 449 - DNA, 792 bp, Homo sapiens
  misc_feature 1, 8, 23, 24, 25, 26, 28, 29, 32, 36, 63, 64, 72, 75, 77,84, 85, 87, 90, 91, 110, 112, 113, 117, 120, 123, 129, 132,135, 139, 148, 151, 154, 164, 166, 172, 187, 193, 194, 196,203, 204, 205, 223, 224, 225, 226, 227, 232, 242, 246: n = A,T,C or G
  misc_feature 249, 250, 251, 255, 257, 262, 264, 265, 266, 267, 271, 275,279, 283, 297, 298, 302, 305, 308, 310, 312, 314, 319, 352,363, 366, 374, 378, 389, 408, 409, 413, 420, 448, 453, 461,463, 474, 485, 493, 503, 504, 511, 512, 526, 527, 528: n = A,T,C or G
  misc_feature 530, 531, 541, 548, 550, 551, 552, 553, 557, 559, 565, 566,567, 569, 579, 592, 601, 604, 606, 609, 624, 625, 633, 641,644, 645, 646, 648, 649, 650, 651, 656, 659, 661, 662, 663,665, 666, 672, 674, 676, 685, 692, 693, 694, 696, 703: n = A,T,C or G
  misc_feature 705, 709, 723, 731, 733, 737, 741, 743, 744, 748, 749, 750,751, 757, 762, 765, 767, 777, 786, 787: n = A,T,C or G
ngagaaangtttctaatgctggnnnngnnagntcancctttctaatgttctaatacttggganntcgaactntcncnacacagnnangcnntgcgaattcggcacgaggncnnctcnatnatnacttgntcncancggnctggcatcnacncgncacacctacntnagcgcnttgtagcgcaatatncacctnntnaaacccnnnagtcccagggctctgccnnnnnactgntcaactgacnaacnacnnnctancncaacntnnnnttangccnctgnctgnctctatggcacctnncctnccntcncncntnacccnctacgctcagggctatatacaatgggaaccttnccaacagtaanccntggatctnaggnatggcccttgnctggcggatcacagccttnnagcntatcagnatcttgaggaagacaccattccgtcccngattntgaccaancnctcggatgtgnctatgggctcnattgaggnacaacaactnncactgcnnataggccatcctcnnnannctacacatgngactttncnnnncatntnaaatgnnnanatgtctctcncaagcatcacccnctgtccctncgncntcntggaagaccttctgnncaactganctccttcntgnnncnnnngattnttncnnncnnaatatncntnccccaatgnccttgtnnngnatttatnangggntttccaatttgggntaattcantncccnccgnannctannnncccatnaaccntcngngccttcttgnaaccttttnncctgg

SEQ ID NO: 450 - DNA, 848 bp, Homo sapiens
  misc_feature 2, 6, 29, 30, 31, 32, 33, 34, 35, 42, 43, 53, 62, 63, 69,71, 81, 85, 87, 92, 97, 100, 128, 203, 233, 299, 317, 332,339, 349, 380, 382, 386, 428, 446, 461, 480, 498, 502, 503,504, 507, 509, 510, 514, 522, 523, 524, 528, 529, 530: n = A,T,C or G
  misc_feature 531, 534, 535, 536, 539, 540, 542, 544, 548, 549, 551, 552,555, 558, 559, 560, 563, 567, 568, 570, 571, 577, 578, 579,582, 583, 585, 588, 589, 591, 592, 593, 597, 598, 599, 600,601, 602, 603, 604, 605, 606, 610, 617, 618, 619, 620: n = A,T,C or G
  misc_feature 622, 623, 624, 625, 626, 628, 629, 630, 631, 632, 633, 634,635, 636, 637, 638, 640, 641, 642, 643, 644, 646, 647, 648,649, 650, 651, 652, 653, 655, 656, 658, 659, 661, 662, 665,666, 669, 670, 671, 672, 673, 674, 676, 677, 678, 679: n = A,T,C or G
  misc_feature 684, 685, 687, 688, 692, 693, 695, 698, 699, 700, 701, 704,707, 708, 711, 712, 713, 714, 715, 716, 717, 719, 720, 722,723, 724, 725, 729, 730, 731, 732, 733, 734, 736, 738, 739,740, 743, 744, 745, 746, 747, 748, 749, 750, 753, 754: n = A,T,C or G
  misc_feature 755, 757, 758, 760, 762, 763, 764, 765, 766, 769, 770, 771,772, 773, 774, 775, 777, 778, 779, 780, 781, 782, 783, 784,785, 786, 787, 788, 789, 790, 791, 793, 794, 796, 798, 799,800, 803, 804, 805, 806, 808, 810, 811, 812, 813, 814: n = A,T,C or G
  misc_feature 817, 818, 819, 820, 821, 822, 823, 824, 825, 826, 828, 831,832, 833, 834, 835, 837, 838, 839, 840, 841, 842, 843, 844: n = A,T,C or G
gnatgncccgatttccttaatgatggggnnnnnnngagcganncttccgaaanttccaatannctgggngntcgcaactcnctcnanacagnaaggncgngggctttgctctctccattccaagttgntctctgttctagaaagcagatgtagtagacatctactgttgttgcctgaacagaatccctttgtcctttttttgntaaaagtactcatccctaatattcattgtnctggaaggactgaaaatacagaactcacaccatgatcggccgggacaatcagattatttcattccncagcaaacggagatcganccgaaaagtggaaanatgagcncttctttggngttggcatatggaccctgagagaaagaactntnattntttctcttggactgcaataaagtatagctgcctaaaatacgnttcctgacacttggaggnttgtccacaatcggngaaataaaggcgagaccgnacactggatgaaaaaaanaagnnnccngnngaanacccactnnnccannnnccnnnccnntncnccanngnnganccnnntanccgnnannaggccnnngcnntngcnncnnngccnnnnnnnnnngggnaaacccnnnngnnnnncnnnnnnnnnnncnnnnnannnnnnnncnncnngnnggnnctnnnnnnannnnccccnncnncccnncnccnnnnggnaannccnnnnnnnannannnngggnnnnnncnannnccnnnnnnnncannncnncncnnnnnggnnnnnnncnnnnnnnnnnnnnnncnngngnnnacnnnngngnnnnnccnnnnnnnnnncnggnnnnncnnnnnnnncccc

SEQ ID NO: 451 - DNA, 765 bp, Homo sapiens
  misc_feature 2, 3, 4, 5, 6, 7, 8, 26, 27, 28, 29, 30, 31, 32, 33, 37,39, 40, 41, 44, 46, 47, 58, 65, 69, 79, 83, 86, 91, 92,93, 94, 100, 102, 525, 652, 676, 693, 730, 742, 760: n = A,T,C or G
gnnnnnnntttcctaaatgcttgggnnnnnnnngagngnnnttncnnagtttcctaantagcttnggcnactcgttctntctncangcagnnnntgcgtngncgaattcggcacgagcattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgcagaagcttcagttctggtaaaagagaaggtggggactttgtttgctgtgccctctctcccgtggtgaatggatctactgtgtaggggaggactttgtgctctactggttcagtcagtcactggcaaactggagagaactttgacagtgcacganaaggatgtgattggtattgcacatcaccctcatcagaacctgattgctcctacagtgaagatggactcctaaagctctggaaaccataattcaacttttcttttttaaatcaactcgaaagcatgtncttaaatgaacatattcatgtaangggctttttttttttgncacttttctaagcaaatagatggctgaattagtcacngaataaatttgngaaaatcatggttaaatnccaac

SEQ ID NO: 452 - DNA, 765 bp, Homo sapiens
  misc_feature 1, 2, 3, 5, 6, 7, 8, 9, 10, 11, 30, 31, 32, 33, 34, 35, 36,38, 40, 41, 42, 43, 44, 45, 50, 60, 61, 64, 65, 66, 69,79, 83, 88, 89, 93, 102, 239, 491, 509, 640, 644, 725, 730,739, 763: n = A,T,C or G
nnngnnnnnnntttcctaaatgcttggggnnnnnnngngnnnnnnttctnatgttcctanngcnnnggngctcgttctntctncacgnngccngtgcggtgncggtctgattgaaagctgttcaggtttatcatgcaaatcctcgcctctggctacggctggctgaatgctgcattgctgccaataaggggacttctgaacaagaaactaaaggccttcccagcaaaaaaggaattgtncagtctattgttggtcaagctatcatcgtaaaatagttttggcatcacagtctatacagaatactgtttataatgatgggcagtcttcggccattcctgtaccagtatggagtttgcagccatatgtctcagaaatgccttgttgctgctcctgaagaacagcaagatccaaagcaggaaaatggggctaaaaatagtaatcaattaggtgggaacacagagagcacgaaagcagtgaaacttgcagcagtnaaagccatgatggagatnaattcattccagcttcaccttcttctccattgagaaaacaggaattagaaaacttaaagtgctccatacttgcttgcagtgcctacgtggctctggcttttgggtgatacctcatggctttgaatcatgcngatnaacttcttcagcagcccaagctgcaggatctcttaagttttgggacatttatatgctgcagaacccttatcttcttcgacngaatntctgtgccnttctcacttgaccccgagaatgtnct

SEQ ID NO: 453 - DNA, 833 bp, Homo sapiens
  misc_feature 2, 5, 6, 7, 8, 9, 17, 22, 28, 29, 30, 32, 55, 61, 459, 502,520, 560, 579, 609, 627, 662, 671, 673, 691, 721, 723, 728,748, 783, 786, 808, 815, 825, 831, 833: n = A,T,C or G
gngtnnnnntttctaangttcntaatannntnggctactcgttctttctccaggnatcccntgcgattcgaattcggcacgagagaaacgttctcaggttgaccagctgctgaatatttctttaagggaggaagaacttagtaagtcattgcagtgcatggataacaatcttctgcaagcccgtgcagcccttcagacagcttatgtggaagtcaagaggctacttatgctcaagcagcagatactatggagatgaatgcactgaggacccatagaatacagattctacaggggattacaagaaacatatgaaccttcttgagcaccccaggttttggcattagaaaatgggtaccccttggttcaaaaatgaacaaagaaagccttagatttggatgggggaacctgatctgtccagtctagaaggattccagtggggaaagtgtttccatttccttngtcccctggcttggccaaggaaagcgaaagccctttcttgaanagcaaccgtggatcattngaccaggaacttccttctggggtattaagcttctttcaantggaagggaaaggttccanggccaaaggaaaaatggaagcccccaaccngatgggtttcaccctaantaacctcaattggaagggcttggaccaagaacccnggaaaggcnanccattgcacccttaaaancaaggaaagtggaccacctttggggcttgncnttccnttccgaaccaggttgaaaangggcttgaaaaatggttgcttacccaaaagggcgnacnttaatggcaccaattattcctntggaccntttttaatancctttngn

SEQ ID NO: 454 - DNA, 737 bp, Homo sapiens
  misc_feature 2, 5, 6, 7, 8, 24, 35, 50, 210, 562, 656, 679, 697: n = A,T,C or G
gnggnnnnttctaagttcctaatnctgggctactngttctttctgcaggnatcccatcgattcggcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatncaaatcagattctggaagccttactattataattctcaaaacaaaagaatctcgcttgggccaacctaaagaacttgaggatcttgaagcaatgatcaaagcttgaagaaagcagtaagcaagaagagtgcaccacaacatcaacagccccagtccctacaacagaaattccgaccacaatgagcaccatggctgctgcccgaagcagcagctgctgttgttgcagcagcagcagcggcagcagcagcagcagctgcagccaatgctaatgcttccacttctgcttctaatactgtcagtggaactgttccagttgttcctgacctgaagttacttccattggtgctactgntgtagataatgagaatacagtaactatttcaactgaggaacaagcacaacttactagtacccctgctattcaggatcaaagtgtggaaagtatncagtaatctggagaagaaacatnttaaccaggaaactgtanctgattttacttccaaaaaagaagaagaggagagccacct

SEQ ID NO: 455 - DNA, 718 bp, Homo sapiens
  misc_feature 3, 4, 5, 6, 7, 8, 12, 13, 14, 16, 20, 22, 28, 29, 50, 53,55, 61, 68, 606, 619, 638, 658, 682: n = A,T,C or G
ggnnnnnntttnnncngttncntaaaannctgggctactcgttctttctncangnagcccntgcgatncgaattcggcacgaggatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaattgatccagttggagagattttaaaaatgcaggatgagctcttaaagccaatttccagaaaagtaccagaattgcccttaatgaatttagaaaattctaaacagccttctgtttctgagcaattgtctggtccttcagactcctctagttggcccgaaatctggatggccttctgcatttcagaagccaaaaggacgattgccatatgaacttcaggactatgttgaagatacatcggaatacctagctcctcaggaaggaaattttggttataagttatttagcctgcaagacctgttgttctcgtcgctgcagtgtncagaggatagagncagaccacgttctaaaacngagaaatcagaagacatttncagttatgtctccaaaagtgagtntcagctgtatgagttgactctgctgaaagtgacttg

SEQ ID NO: 456 - DNA, 739 bp, Homo sapiens
  misc_feature 5, 6, 7, 8, 13, 14, 25, 27, 45, 46, 53, 54, 55, 195, 505,561, 565, 578, 590, 612, 632, 654, 662, 681, 682, 690, 692,695, 697, 699, 700, 701, 702, 703, 706, 712, 716, 725, 732,734: n = A,T,C or G
gtggnnnnttctnngtttccaatangntgggtctcgttctttctnnacgatcnnntgcgattcgcttgggaggctgagtcaggagaaattgcttgagcccaggagatggaggttgcagtgagccaagatcatgccactgcactccagactgggcaacagagggagactccgtctcaaaaactaaaaaaaaaaatncatttagtataccggggggtgggggggagaaataatgttatttcctatgcgaaatgacgtgtatccctgtacccatgggtaaatgtaaatatactgtgtctcttttgggagagccttttagtagaggagtcttatatgaagtctctcataagtagttcacttgagttttgcagtttgaaatcttaaaggagctttaattgacatttattataccaattaagcttggaatggggcaatggatgcatttccaaaacgtgtgaaagcctaacagcttatattgctgaatgagaatctcctgggtgtaatttancacttagggaactgcgtgaacactcccagccattatgatgctggtaccagctttantgtntaaatgccatgantattctttctgntctgttttgtgctctcttggtncatttattttaccctttacngaataatttcttgtaaaatccntaaaaatntttggcatttaaaagtccnntcttggantnaananannnnnaanaaaaancttncccctttanaactttngngggct

SEQ ID NO: 457 - DNA, 743 bp, Homo sapiens
  misc_feature 4, 5, 6, 8, 9, 14, 15, 16, 28, 35, 50, 52, 53, 55, 56, 57,58, 60, 67, 84, 85, 87, 92, 102, 103, 105, 109, 111, 114,116, 117, 128, 133, 134, 137, 138, 139, 140, 171, 173, 175,176, 179, 184, 185, 187, 193, 194, 197, 198, 201, 208: n = A,T,C or G
  misc_feature 209, 213, 226, 248, 252, 260, 279, 281, 283, 287, 290, 293,295, 296, 297, 327, 330, 355, 363, 366, 380, 391, 397, 399,404, 406, 409, 417, 422, 437, 438, 440, 443, 446, 449, 454,479, 484, 489, 506, 508, 515, 522, 523, 530, 539, 542: n = A,T,C or G
  misc_feature 546, 556, 572, 598, 614, 619, 626, 630, 639, 644, 650, 670,678, 687, 689, 690, 693, 699, 704, 709, 713, 719, 720, 723,724, 735: n = A,T,C or G
gtgnnntnnttctnnngtttccaattantctgggngctcgttctttctcnanncnnnnantggttgncgaattcggcacgaggnnanagggnagctacatgnntnaccntnttngnnctctcagccangctcnnctnnnnctggtcctactgctacatagaacacttgttntncnnggnaactnntntatgtnnccnngantctctgnnactngtttaaatgctanttgataacaggctatgcaaggnctgnaagtgganagcgtcatcattcatcatncntnttanctngantnnntgtatcctacatgctttgattggtaaatgngcntcagactgggactctcaataaatgnatatagangancttgctgtggaaanctgtcctctcntatctntncatgngnaanttccactncagtntgaactccaaatgcnntnatnggnganccctncttgtatagtggtgtccattccaanctgcnagggnctagaaaccgtcggctntnggaaacnatggtgnnagttganctggtacangcngttntcacctgcanctaccataaaatgggnttacccaagctttatcatggaatggntataaaaaacgcattnattgngcctttntaancccattatntgttnaatttnacttatggttccccccattnaaattatncaattgggnanngangcttcnagtcnccatntttnaatggnnttnncaaaaaaacgntttttttt

SEQ ID NO: 458 - DNA, 906 bp, Homo sapiens
  misc_feature 2, 3, 5, 6, 7, 8, 9, 10, 11, 14, 27, 28, 30, 39, 40, 41,42, 43, 44, 45, 46, 47, 48, 51, 52, 70, 76, 77, 80, 88,89, 92, 93, 94, 95, 139, 147, 152, 160, 166, 168, 174, 183,188, 198, 207, 210, 213, 215, 218, 221, 239, 249, 250, 251: n = A,T,C or G
  misc_feature 255, 256, 257, 261, 264, 265, 268, 274, 275, 276, 279, 284,288, 292, 294, 298, 299, 300, 311, 313, 318, 320, 321, 323,324, 326, 327, 328, 330, 331, 332, 335, 338, 340, 341, 343,345, 349, 350, 353, 356, 357, 359, 361, 362, 363, 364: n = A,T,C or G
  misc_feature 365, 366, 372, 373, 375, 379, 384, 385, 386, 390, 395, 401,402, 403, 404, 405, 406, 409, 410, 412, 419, 420, 421, 425,431, 437, 441, 442, 446, 447, 448, 449, 450, 453, 460, 461,463, 485, 488, 489, 492, 494, 501, 502, 505, 511, 516: n = A,T,C or G
  misc_feature 525, 526, 532, 543, 545, 546, 547, 548, 552, 556, 557, 558,568, 572, 576, 578, 585, 586, 589, 590, 591, 593, 598, 599,600, 606, 608, 609, 615, 624, 625, 628, 635, 636, 638, 641,645, 648, 649, 650, 652, 654, 657, 658, 659, 664, 668: n = A,T,C or G
  misc_feature 672, 675, 676, 681, 684, 687, 690, 692, 693, 694, 695, 698,700, 703, 704, 706, 707, 708, 715, 716, 717, 718, 720, 721,726, 727, 733, 736, 737, 740, 741, 742, 746, 747, 752, 756,758, 760, 761, 764, 765, 769, 774, 775, 780, 781, 783: n = A,T,C or G
  misc_feature 784, 791, 794, 795, 796, 797, 798, 799, 800, 801, 802, 803,805, 808, 811, 812, 813, 816, 822, 823, 824, 825, 826, 827,831, 832, 834, 836, 837, 839, 840, 849, 850, 852, 853, 856,858, 860, 866, 867, 868, 869, 871, 873, 875, 877, 881: n = A,T,C or G
gnngnnnnnnnttnctaatgcttgggnncncgtttctannnnnnnnnnaanntttcctaattggttaggngctcgnnctntctccacnnagnnnngcggtgcgaattcggcacgaggctgaatcaaggatcacaaactncacatttngcacnttggtctncacatncntggttngggcagtcncagtnaacatggctntggaaactnatnttngnctngcntcaaccatctcgttcccnggggacccannntccnnnatcncgnnttncctcgnnnatnggagngctncttngnccannnatgggctcccnanaatangnntnncnnngnnnatncancnncngncaannggntcnncntnnnnnngccctnntncctnatggnnngctncatgncccatnnnnnnggnnancaataannnaaanggtctnttcccncganncccnnnnnccnctaacanngnacctcgcaaagggccccaggcnttnnctngnaaaccannttngccaanggtanttcaaaggnngccttngggacctcccnannnngccntggnnntaccccgggnaaanggtngnaaacccnnccnnngntgccnnncccggncnnggaaanaaatttccnnggnacccagnntnccnccgnaannnanantannncccancccnaacnttnngcccncanccnttngnnnntgnantcnncnnnccctttnnnntnnccaanncggccnggnnacnnncttnnacctntttncncnnaanngacnccaanntcctnnannaaagggnggnnnnnnnnnncnttnccnnnggnagcccnnnnnncctnncntnncnnaaaaattcnncnntgnancncccctnnnntnangngncccnatnnnnnnnnnngnaaancnnaccc

SEQ ID NO: 459 - DNA, 765 bp, Homo sapiens
  misc_feature 2, 3, 5, 6, 7, 8, 11, 19, 27, 31, 35, 36, 37, 38, 39, 40,41, 42, 43, 44, 45, 46, 47, 48, 58, 66, 72, 76, 88, 90,225, 274, 278, 360, 401, 429, 528, 591, 603, 614, 627, 646,654, 671, 676, 680, 682, 687, 690, 692, 720, 721, 723, 725: n = A,T,C or G
  misc_feature 732, 765: n = A,T,C or G
gnngnnnnggnttcctaangctggggnccgntctnnnnnnnnnnnnnngttcctaaanacctaggngctcgntctngctccacgcagncngggcgtgggcgaattcggcacgagcttctgttgattggtttgtttaaagtacctaagtactaccctttgactccctaccaaaagttcttttgttttttaaacaacttttatttgtgacttactttcttgagaagngttcttaatgaattgcataaaatagtggtagcagcttatttcttaagtncttnattattggggctttaccattcaggtcttatctttaacccttatttactcagttttccatctgaatgatcctatctctaaatnaaggatttaataaatgctgcaaattgtccactttgcaaatngtccaaaagctttagttttggaccttgngaactttttttttaataacacattatttgggcccggtcgtggtggctcaagcctgtaatcgcagcactttggaatgcctaggcagacagatcacttaangcctggagttcgagaccagcctggccaatgtggtgaagacctccggttctattactaaaaatnctaaaaaattancaaggcatggnggtgcacgcctgnaatctcagctacttgagangcaaatcnggagaaatgcttgaccngggangcananatganccnanattgcaccactgcattccacctggggannanantgagaanctggctcaaaacccaaaaacccaaaaaaaaaan

SEQ ID NO: 460 - DNA, 677 bp, Homo sapiens
  misc_feature 5, 610, 649, 677: n = A,T,C or G
gtttncgctgggagccaccaacatagcagattaccatgtgaagttgccactgctgcatctcctgaaacctggctgatgggagaggtctcattttgtgtctgagaatgtccaggttgtctgcagaccacagcactgatttcccattagcagttattatttcctggccatttcttcctgaaggttttgtggttaaactccctgtcctcaatattttatcagcagtagggctgtcattcttctggttatcaacctctacattatgaagtaaggttcaacccttctgcttttctcaggcccccaaaacggttcctatccaatcgaacacaaaaacgggtattgagaaggaattggcagggctcagtggctgtttccgttgctcctacctcatggagactcttactcatgctggatttattgagagaacttctaactgaccactcacccccacccactcttatgcagtctgttcattcctgaaaacaccactttcatccctcctgcacacaacccatgagggattgctacttcctataagattcctcagtgagccttatagagttgctgcgagaattacatttggtcatgatgtcaagtgtctggtatgtagctnatgcttattgaacacatagtaatttattggaataattgncatgatcactggatgagaatatagcccn

SEQ ID NO: 461 - DNA, 787 bp, Homo sapiens
  misc_feature 2, 3, 4, 5, 6, 7, 8, 13, 14, 15, 16, 18, 27, 37, 40, 61,66, 69, 73, 74, 82, 86, 99, 119, 120, 167, 174, 175, 176,177, 179, 185, 200, 208, 213, 217, 218, 227, 228, 229, 230,238, 245, 254, 259, 260, 261, 262, 282, 283, 284, 300, 302: n = A,T,C or G
  misc_feature 303, 307, 308, 309, 312, 319, 328, 329, 338, 340, 342, 347,350, 351, 352, 357, 358, 363, 366, 369, 371, 379, 380, 390,399, 404, 405, 409, 415, 419, 425, 437, 441, 450, 459, 460,462, 465, 468, 471, 480, 481, 483, 484, 485, 486, 488: n = A,T,C or G
  misc_feature 497, 503, 509, 518, 524, 533, 536, 543, 544, 545, 557, 559,562, 563, 564, 567, 572, 574, 577, 580, 583, 586, 593, 597,600, 601, 602, 607, 609, 621, 624, 629, 632, 636, 638, 639,641, 644, 652, 654, 656, 662, 663, 666, 669, 676, 678: n = A,T,C or G
  misc_feature 681, 689, 702, 704, 708, 709, 710, 713, 714, 728, 729, 731,732, 751, 754, 760, 761, 767, 769, 775, 778, 779, 781, 782,783: n = A,T,C or G
gnnnnnnnagggnnnngnggggcctcncaaagcccgngcnacaggtccccgttccaaagcntgggngancgcnncgccccancagnaaggcgggggaangcggcacgaggacatcatcnncttattctagtaagagaaagtacacagattcaactttagagaggacnggggggnnnncnggagcnaaatcaaggaaggantatcacgnggccncccnngaatataannnngaagctgngaacagnaccatcagnaacannnnatggacagctctgatggggnnnataccacggcactctncnnaccnnnggnggaagcnatccggagnnatgactgangngnaaagnggnnnactgnnagaanccnggngngctaggannctgggagagncactttcangaagnnaccnggcgangagncatcanaagaacccgganaagngagaagacnggaaaaagnncncancgnacngagcccagnnannnncnctgagccangggctncgaaangccccaccngaagcnccatcacanggnacaaggnnngggaaaaggaancnacnnngcngacangnccnccnaanagngccaaancacngcnnngcccncncgcccaaagaanacnggacngcnggcncnnancanaaggagcncnanggcccnnggnaangaaactncnagnagcccaancccaaaggccccnanggannnccnncaaggggaaaacannanncacccaaggggcctgggcnaanaaggcnncccacncnggcccnccnncnnnaccg

SEQ ID NO: 462 - DNA, 747 bp, Homo sapiens
  misc_feature 13, 14, 15, 16, 17, 18, 19, 21, 22, 23, 24, 28, 39, 47, 48,57, 64, 65, 66, 69, 70, 71, 72, 79, 534, 594, 640, 700,707, 722, 723: n = A,T,C or G
ctaatggcttggnnnnnnngnnnnccgnttcttaattgncttgggcnnctcgctctntctccannnagnnnntgcgttngcgaattcggcacgagcctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttctnctctcttttctttccttctccctttcttctttgccttctaaatatactgaaatgatttanatatgtgtcaccaattaatgatcttttattcaatctaagaaatggnttaagtttttctctttagctctatggcatttcactcaagtgggacaggggaaaaagtaantgccatnggctccaaagaattnntttatgttttagctatttaaaaaa

SEQ ID NO: 463 - DNA, 750 bp, Homo sapiens
  misc_feature 2, 12, 15, 16, 17, 19, 21, 22, 25, 26, 30, 40, 42, 52, 53,60, 64, 67, 68, 72, 74, 75, 455, 457, 469, 516, 531, 576,588, 594, 615, 632, 636, 654, 664, 665, 671, 680, 713, 715,741, 750: n = A,T,C or G
tncctttctaangcnnntngnnaanngtcnccgttctaantncttgggcagnncgctctntctncanncagncnntgcgttgcgaattcggcacgaggcgagatgaagctacactgtgaggtggaggtgatcagccggcacttgcccgccttggggcttaagaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgttngnggaagattctgnctgaactctttcattcaaggaactactaccatgaatctgcattctgntgcccacactgaggncttagtagataattgggtggtctgaaacacctattatctcttatntctggtctctangctggnatgttaattcctctgaaatgntaaaagtaatgggtganaccngaaaaagaaatttcaatnacagatcaanntggggngcatgtatnattttcaagcgtcaaaatggaataagggaagantnctggatacctgcttggaaaaggaagnatgtgtatn

SEQ ID NO: 464 - DNA, 748 bp, Homo sapiens
  misc_feature 2, 3, 13, 29, 30, 32, 34, 56, 68, 69, 396, 481, 627, 685,692: n = A,T,C or G
gnngtgtctttgnaaagcctttggggaanngncnccttctaatgcttggctatcgntctttacgcagnncccatcgattcgaattcggcacgaggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggttggntgcttctttcgttctctcctctgggggctctgaagtttcaccaggtggacgctggggagcgggctcccgagcacttgtctacctnccgccagtcctgacaacttttctggccaacctacccagcttcgcttggctggcgagcgcatctgctgctggggttcgcggtgcaaatggagacgcagtggtggccagagggtgatggagaagacgggaaaagcgacagccacgctnctggcttgaagccgcaggacgcaaataacttactttggacctgacagttctacgttgntgtggangccctgtttcctggaaataaaactcaaaatggtggttttttggaaaaaaaaaaaat

SEQ ID NO: 465 - DNA, 863 bp, Homo sapiens
  misc_feature 4, 5, 6, 7, 8, 9, 10, 13, 16, 17, 18, 19, 20, 23, 24, 25,26, 27, 40, 45, 46, 54, 55, 57, 65, 79, 153, 162, 178, 180,181, 185, 186, 190, 197, 202, 226, 229, 230, 235, 240, 243,250, 257, 261, 268, 283, 285, 298, 326, 346, 355, 359: n = A,T,C or G
  misc_feature 364, 367, 374, 376, 385, 386, 391, 406, 410, 413, 431, 435,436, 437, 438, 439, 440, 441, 442, 443, 444, 445, 446, 447,448, 449, 450, 451, 452, 453, 454, 455, 456, 457, 458, 459,460, 461, 462, 463, 464, 465, 466, 467, 468, 469, 470: n = A,T,C or G
  misc_feature 471, 472, 473, 474, 475, 476, 477, 478, 479, 480, 481, 482,483, 484, 485, 486, 487, 488, 489, 490, 491, 492, 493, 494,495, 496, 497, 498, 499, 500, 501, 502, 503, 504, 505, 506,507, 508, 509, 510, 511, 512, 513, 514, 515, 516, 517: n = A,T,C or G
  misc_feature 518, 519, 520, 521, 522, 523, 524, 525, 526, 527, 528, 529,530, 531, 532, 533, 534, 535, 536, 537, 538, 539, 540, 541,542, 543, 544, 545, 546, 547, 548, 549, 550, 551, 552, 553,554, 555, 556, 557, 558, 559, 560, 561, 562, 563, 564: n = A,T,C or G
  misc_feature 565, 566, 567, 568, 569, 570, 571, 572, 573, 574, 575, 576,577, 578, 579, 580, 581, 582, 583, 584, 585, 586, 587, 588,589, 590, 591, 592, 593, 594, 595, 596, 597, 598, 599, 600,601, 602, 603, 604, 605, 606, 607, 608, 609, 610, 611: n = A,T,C or G
  misc_feature 612, 613, 614, 615, 616, 617, 618, 619, 620, 621, 622, 623,624, 625, 626, 627, 628, 629, 630, 631, 632, 633, 634, 635,636, 637, 638, 639, 640, 641, 642, 643, 644, 645, 646, 647,648, 649, 650, 651, 652, 653, 654, 655, 656, 657, 658: n = A,T,C or G
gggnnnnnnnaanggnnnnnggnnnnngtcccgttccaangaccnngagatcgnngncgctccanaagaaaggcggtgngaattcggcacgagacctgtaccgcctggccactggctgtcaccggcgtgatgagctgccggtgtttgaacgcngcctatgcngggactttcccggcanannggcnngaanatggccnccatncaggaagccgcccagaacctcctnggnnacacnacttnagngccttcnagtccgntggnacccggnccaagccccggcaancnctgccccgggtcnccgttcccaaggccaaccagccctgggnacccccggggagccgaaacnctggggctngganaccgngantgagagncncacttttcnntgtanacacgggcccagganacanctntgctcgtggccccggggnaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 466 - DNA, 713 bp, Homo sapiens
  misc_feature 1, 13, 17, 19, 27, 32, 34, 35, 37, 46, 123, 635, 645, 691,698, 710: n = A,T,C or G
ngtctttcgagcntggngntcgttctngctcnannanattggttgngggaattcggcacgagcctcagccccacaccagctctatttcaggggtgagagtcagagagcactgcaatatgtgcntcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttatcaatctaagaaaatggtttaattttttctctttactctatggcanttcactcaantggacaggggaaaaaagtaattgccatgggcttccaaaagaattgntttatgntttagctatttnaaa

SEQ ID NO: 467 - DNA, 732 bp, Homo sapiens
  misc_feature 2, 3, 4, 8, 9, 16, 21, 22, 23, 24, 25, 26, 27, 28, 31, 44,48, 53, 56, 57, 60, 63, 65, 67, 73, 151, 506, 626, 646,653, 700, 732: n = A,T,C or G
gnnnggtnntctaatncttgnnnnnnnntcncccttctaagccntggnctcgnctnnccnacnancnggcttncgaattcggcacgaggcgagatgaactacactgtgaggtggaggtgatcagccggcacttgcccgccttggggcttangaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgtttgtggaagattctgtctgaactctttcattcaaggaactactaccatgaatctgcattctgntgcccacactgtggtcttagtagataatttgggtggtctgaagcacctattatctcttatttctggtctctaggctggtatgttaatcctctgatatgttaaaagtaatgggtgagaccngaaaaagaaatttcaatacngatcaantttggggtgcatgttgaatttgcaacctcaaattggagtaagggaanattctggatacttgctggaaaggaggaatgtn

SEQ ID NO: 468 - DNA, 748 bp, Homo sapiens
  misc_feature 2, 3, 6, 7, 15, 22, 23, 24, 25, 26, 27, 28, 29, 41, 42, 50,57, 63, 67, 69, 70, 73, 219, 578, 667, 682, 697: n = A,T,C or G
gnnagnnttctaatngcttgtnnnnnnnnagacgttctaannctttggcnatcgttntttctncagnannccntcgattcgaattcggcacgaggccggccggcgacgctggcgacgctttcgcccctgaggtagtttggcgaccgcgaagaaggaaaaagggcgggcgggcggctgtcctctcaccgtcctcaccccgcgaggcccggcccgctcctncgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggttggttgcttctttcgttctctcctctgggggctctgaagtttcaccaggtggacgctggggagcgggctcccgagcacttgtctaccttccgccagtcctgacaacttttctggccaacctacccagcttcgcttggctggcgagcgcatctgctgctggggttcgcggtgcagatggagacgcantggtggccagagggtgatggagaagacgggaaaaagcgacagccaagctcctggctgaaaccgcaaggacgcaaaataacttactttgnacctgacagtttctnacgtttgttgtggangccctgtttcctgggaaataaactcaaattggtggtttcttggaaaaaaaa

SEQ ID NO: 469 - DNA, 776 bp, Homo sapiens
  misc_feature 4, 6, 18, 19, 20, 39, 42, 47, 53, 59, 69, 71, 243, 401, 411,436, 439, 440, 442, 444, 445, 446, 447, 448, 449, 450, 451,452, 453, 456, 457, 458, 464, 468, 470, 471, 473, 474, 476,477, 478, 479, 480, 483, 486, 487, 488, 494, 496: n = A,T,C or G
  misc_feature 497, 499, 500, 501, 503, 504, 505, 506, 507, 510, 511, 512,513, 514, 515, 516, 517, 518, 519, 522, 523, 524, 525, 527,528, 531, 532, 533, 534, 538, 539, 540, 541, 544, 546, 547,548, 549, 550, 551, 552, 553, 554, 555, 556, 557, 559: n = A,T,C or G
  misc_feature 561, 562, 563, 564, 567, 569, 571, 572, 573, 574, 575, 576,577, 578, 579, 581, 582, 583, 585, 586, 587, 589, 590, 591,592, 593, 594, 595, 596, 597, 598, 600, 601, 602, 603, 604,605, 606, 607, 608, 609, 610, 611, 613, 614, 617, 618: n = A,T,C or G
  misc_feature 619, 620, 621, 622, 623, 624, 626, 628, 629, 630, 631, 632,634, 635, 636, 637, 638, 639, 640, 641, 642, 643, 644, 645,646, 647, 648, 649, 650, 654, 655, 656, 657, 658, 659, 660,661, 662, 663, 664, 665, 666, 667, 668, 669, 670, 671: n = A,T,C or G
  misc_feature 672, 673, 674, 675, 676, 677, 678, 679, 680, 681, 682, 683,684, 685, 686, 687, 688, 689, 690, 691, 692, 694, 696, 697,698, 699, 700, 701, 702, 703, 704, 705, 706, 707, 709, 710,711, 712, 713, 714, 715, 716, 717, 718, 719, 720, 723: n = A,T,C or G
  misc_feature 724, 725, 726, 727, 728, 729, 730, 731, 732, 733, 734, 735,738, 739, 740, 741, 742, 743, 744, 745, 746, 748, 749, 750,751, 752, 753, 754, 755, 756, 757, 758, 760, 761, 762, 763,764, 765, 766, 767, 768, 769, 770, 771, 772, 773, 774: n = A,T,C or G
gggngntctaatgcttgnnntgattctccgtctataacnggntaatncttggncctacnaaaaggctangngaattcggcacgagacctgtaccgcctggccactggctgtcaccggcgtgatgagctgccggtgtttgaacgcaacctatgctggactctcccggcagactgcctggatatggtcgccatgcaggaagccgcccagcacctcctcggcacacacgacttcagcgccttccantccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtacngaggatgacngctgtgctggtggccgtggggcttnaanntnannnnnnnnnnccnnnaccaantctncnnannannnnnccnacnnntaaaantnncnnncnnnnncannnnnnnnnnccnnnnannccnnnncttnnnnaancnnnnnnnnnnnnancnnnncancnannnnnnnnnannncnnncnnnnnnnnnncnnnnnnnnnnnnannccnnnnnnnnantnnnnnannnnnnnnnnnnnnnnnaaannnnnnnnnnnnnnnnnnnnnnnnnnnnnnnnnnnnnnncncnnnnnnnnnnnncnnnnnnnnnnnnccnnnnnnnnnnnnnccnnnnnnnnntnnnnnnnnnnntnnnnnnnnnnnnnnnnc

SEQ ID NO: 470 - DNA, 765 bp, Homo sapiens
  misc_feature 5, 6, 10, 18, 20, 28, 37, 47, 50, 53, 58, 71, 77, 80, 86,89, 93, 94, 95, 142, 149, 423, 475, 505, 547, 557, 558,620, 643, 646, 692, 703, 708, 725, 740, 747, 756, 764: n = A,T,C or G
tatgnntttnctaaaatncntgggcaanacgtcctcnctttcctaanagnttnggcanaacccttggcaanacgccngtnacccanacncagnnnggccgtggcgggcgagcgggcaacagctcttgaggagtgagactgcnggagatntgggccgtgccaaagagatggatgagactggtgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttntcagatgagtaaaggaccaggtgaagatgttgacctttttgatatgaaacantttaaaaattcgttcaagaaaattcttcanagagcattaaaaaatgtgacagtcagcttcagagaaactgangagaatgcannctggattccaattgcccggggaacacagtacacaaagcccaaccagtcaaacctacctacgngggggactactccagactcccgnacnccttcacgtcctcctccatgctgaggcgcaatcaccgcttctgggncaagaagttanaaacnctgggaaaaactacctncgacaagaaggggancatttanatttacccnaaatgaana

SEQ ID NO: 471 - DNA, 820 bp, Homo sapiens
  misc_feature 2, 3, 4, 5, 6, 10, 11, 12, 13, 15, 20, 22, 26, 30, 43, 47,48, 49, 63, 66, 68, 73, 75, 77, 84, 91, 95, 101, 102, 103,108, 109, 110, 112, 113, 116, 118, 119, 120, 122, 123, 125,127, 153, 178, 188, 190, 216, 226, 235, 236, 237, 251: n = A,T,C or G
  misc_feature 254, 263, 264, 266, 269, 272, 276, 279, 286, 289, 300, 302,303, 306, 308, 310, 311, 312, 314, 315, 316, 321, 323, 325,326, 327, 329, 336, 339, 341, 346, 347, 355, 360, 375, 376,380, 397, 416, 436, 440, 442, 443, 451, 469, 476, 478: n = A,T,C or G
  misc_feature 481, 483, 487, 492, 494, 497, 501, 506, 508, 511, 512, 514,515, 523, 530, 532, 533, 535, 538, 539, 541, 547, 550, 551,554, 556, 558, 560, 562, 563, 564, 575, 576, 577, 582, 583,591, 592, 593, 594, 605, 610, 611, 612, 614, 622, 625: n = A,T,C or G
  misc_feature 628, 631, 634, 636, 637, 640, 644, 647, 648, 660, 663, 672,676, 677, 678, 680, 689, 693, 694, 695, 699, 700, 710, 711,715, 717, 719, 723, 732, 733, 737, 748, 750, 751, 756, 765,767, 768, 770, 775, 779, 780, 781, 783, 785, 787, 790: n = A,T,C or G
  misc_feature 791, 796, 801, 803, 804, 805, 808, 810, 811, 812, 814: n = A,T,C or G
cnnnnngggnnnngnggcgncntccnaaanccggggcgacagngccnnngttccaacagaccnggngngccgncngngccccanacagcangggnggggcnnnggggnnncnncgncnnncnnancnacaaagaactcaacaagaaaaaaacnaaccccacaagcgggcaaaggacgngaacagacantncccaaaagaagacatacaagcaaccnaaaataatcnaaaataagnnncaaaaagaaaaaangcnagacagagnngnganagnactnagnaaaaagnganatctagcggcnannagnangnnngnnnacggncngnnncnaagaaanagncnctggnncccaagcnggagnacagcggcgcaagcnnggcncactgcaaccgcgaacncccgggctcaagcgaaccnccagcctcagcctcccaagnagcngnnaaaggcangcaccaccacacccgacnaaaatancngcnancaanaacananaanggcnccccngngcnnanncaggaaanaaacacncnnangcnncngaaaanaannaancncncncnnnacaaaaaaacnnnagccnnagaacaannnnggaggcggaanacggnnnancccgacanganaanganacnanngangganganngggaccaaaccncancccgggaanggcnnngnaaaaaaaangccnnnaaanngggggaaaanncggngnangccnaaagggccnnaaanggggaaacccnannaaaangccgggcanannanaaccnagcnnnancnanccnnccaanggggnannnccncnnncnaggccg

SEQ ID NO: 472 - DNA, 738 bp, Homo sapiens
  misc_feature 2, 3, 26, 43, 60, 61, 77, 78, 81, 82, 83, 86, 87, 89, 113,116, 139, 142, 145, 149, 154, 155, 164, 167, 173, 180, 181,183, 192, 193, 198, 203, 215, 224, 232, 234, 235, 236, 245,249, 250, 252, 258, 262, 263, 264, 266, 271, 279, 285: n = A,T,C or G
  misc_feature 286, 287, 288, 290, 296, 298, 299, 303, 309, 311, 315, 316,319, 320, 321, 327, 328, 329, 333, 341, 345, 346, 347, 349,352, 360, 362, 365, 366, 374, 376, 380, 382, 384, 391, 392,399, 411, 412, 419, 421, 423, 424, 428, 431, 441, 451: n = A,T,C or G
  misc_feature 454, 455, 456, 458, 460, 466, 468, 472, 479, 489, 493, 499,508, 511, 515, 521, 523, 539, 548, 549, 551, 563, 569, 573,582, 589, 596, 597, 598, 612, 618, 621, 634, 635, 638, 641,645, 651, 676, 677, 681, 683, 692, 699, 708, 710, 715: n = A,T,C or G
  misc_feature 726, 732: n = A,T,C or G
gnngtgtctctaatgcttggctactngttctttccgccgaacncttgctaatgcttggcnntcgttctttctccacnnacnnngcnntncgaattcggcacgaggtcacaganatnaaagtccaatcataggggctggnccnacntctntgctnntccctgcangantcatangatcagnnanaccgtgcgnntttgnaagcntttcaaatgtgntaccatcgngttacttncnnnggcacctgntganntnggttgnactnnncnggatnctccaaanccaccnnnncnatgggntnngtgngcatgngntggnncannnacagannnaganactttaangaannngnttntgcaaccntnggnnctagcaancntganantnccagggnnggccacnaagctgaaaatnnatgttanancnnatgntgnaatctctagnatgacttccncannnancnaaactnangcanggctgcnatgttagaanctanaggccnaatttcttntcnatgnaaccantntatgcttttaagaccntcaactgtnncnatgaagcccatntacatnattncggtaatanggctatncttaaannnaactgctgaaaatnatgatncanctacgaaatcctnncanccncatntggctnaatcattaccaaccatttgacaccnncatngnctacccacntgcattnccatgaccnantccantgccacccgcncagatntacctt

SEQ ID NO: 473 - DNA, 752 bp, Homo sapiens
  misc_feature 5, 6, 8, 14, 21, 24, 25, 42, 46, 56, 73, 77, 81, 85, 86,87, 88, 95, 471, 583, 592, 601, 647, 648, 663, 705, 723,736: n = A,T,C or G
tatgnntncctaanagagttntgnnacacggcccgccttctnaaancttcctaatncttgggcgctcgttctntctncacncagnnnntgcggtncgaattcggcacgaggtccttttgaaccaccccaaagaactcaacatggcaaagcaaatggtaaaagcttcccgactgttctactttgggtccgcgcgaagcccactcacgtgtgatctgtgttgcccctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtntatttttggttctcaaccactttataacgtattttttaatttattttgtaatgtcttgttttgaagtattgctgctatccttggtatccttcccactggttttatcactganttattttgngaaagttgncactaatgttctatgtcaaaatcaaaagtatttaatgaaatactanntctatttaatgtggntatggaaccagctggaaacacaaaacaaacagtgattgacancaagctgggcccaagagncaggtcattttgnacatatgccaataaac

SEQ ID NO: 474 - DNA, 752 bp, Homo sapiens
  misc_feature 6, 9, 10, 15, 32, 33, 40, 53, 57, 65, 69, 77, 80, 81, 82,83, 90, 100, 104, 499, 512, 547, 564, 573, 579, 595, 605,612, 624, 632, 640, 642, 656, 658, 665, 669, 683, 685, 687,693, 698, 704, 706, 709, 712, 719, 739, 745, 751, 752: n = A,T,C or G
ttgcanacnnaatanttgctgtaaaagtcccnnctttttnccctttctaatgnttgngcgctcgntctntctccacnagnnnntgcgttncgaattcggntctnagcccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcancccggaagggaangggagatgctttgtctctgcagcagaactacccgnccgtccaagagcaccancagaaagancctcanccccagacagcacggnctacacgcanctcgtgnacctggatgacntggaacanaatggtancnaatgtgggaccacngncttgtancccnaggacaaggccctncnangcttgntggangggtcnantcnganaaatggnggccactgcccaacccgcangaaganaacaann

SEQ ID NO: 475 - DNA, 742 bp, Homo sapiens
  misc_feature 2, 8, 14, 20, 21, 25, 29, 30, 31, 38, 44, 46, 47, 50, 52,68, 69, 71, 72, 73, 74, 75, 80, 91, 406, 431, 484, 628,630, 632, 657, 660, 662, 665, 681, 683, 697, 702, 706, 720,722, 723, 726: n = A,T,C or G
gntttctnttaatncttttnnaaangcgnnntttaccnttctangnntgngnctcgttctttcccacnnannnnncggtncgaattcggcncgaggtgaaacagaaagtggagatgctttccttgacctgaagaagcctcctgcctccaaatgcccccatcgctatacaaaagaagaactcttggatataaaagaactcccccattccaaacagagccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttanatgttgttctcagccctcagagacngagctttggagggggctgccacgtgacagccgctgtcagctcccggcgctcangaagtccattagagaaagatagtgatgggcttcgtctgcttggtggacgtaggattggcagtgggaggataatctctgcccggacctttgagaaggatcaccgcttaacgataaggacctgcgggacttgagagacagagaccnananaaggacttcaaggacaacgtttcangananaanttttggagaaagtaancntgtcttttggtgancgtanaaanaaatgattcttacncnnaanaagaacccgaatggtt

SEQ ID NO: 476 - DNA, 1122 bp, Homo sapiens
  misc_feature 2, 3, 4, 8, 9, 10, 25, 26, 27, 28, 29, 30, 31, 32, 33, 38,39, 48, 77, 86, 87, 88, 92, 93, 94, 169, 178, 250, 254,256, 261, 264, 265, 266, 267, 268, 269, 270, 271, 272, 273,274, 275, 276, 277, 278, 279, 280, 281, 282, 283, 284, 285: n = A,T,C or G
  misc_feature 286, 287, 288, 289, 290, 291, 292, 293, 294, 295, 296, 297,298, 299, 300, 301, 302, 303, 304, 305, 306, 307, 308, 309,310, 312, 313, 314, 315, 316, 317, 318, 319, 320, 321, 322,323, 324, 325, 326, 327, 328, 329, 330, 331, 332, 333: n = A,T,C or G
  misc_feature 334, 335, 336, 337, 338, 339, 340, 341, 342, 343, 344, 345,346, 347, 348, 349, 350, 351, 352, 353, 354, 355, 356, 357,358, 359, 360, 361, 362, 363, 364, 365, 366, 367, 368, 369,370, 371, 372, 373, 374, 375, 376, 377, 378, 379, 380: n = A,T,C or G
  misc_feature 381, 382, 383, 384, 385, 386, 387, 388, 389, 390, 391, 392,393, 394, 395, 396, 397, 398, 399, 400, 401, 402, 403, 404,405, 406, 407, 408, 409, 410, 411, 412, 413, 414, 415, 416,417, 418, 419, 420, 421, 422, 423, 424, 425, 426, 427: n = A,T,C or G
  misc_feature 428, 429, 430, 431, 432, 433, 434, 435, 436, 437, 438, 439,440, 441, 442, 443, 444, 445, 446, 447, 448, 449, 450, 451,452, 453, 454, 455, 456, 457, 458, 459, 460, 461, 462, 463,464, 465, 466, 467, 468, 469, 470, 471, 472, 473, 474: n = A,T,C or G
  misc_feature 475, 476, 477, 478, 479, 480, 481, 482, 483, 484, 485, 486,487, 488, 489, 490, 491, 492, 493, 494, 495, 496, 497, 498,499, 500, 501, 502, 503, 504, 505, 506, 507, 508, 509, 510,511, 512, 513, 514, 515, 516, 517, 518, 519, 520, 521: n = A,T,C or G
gnnngggnnnttctaaaagctgggnnnnnnnnngaggnncttctaatncttctaatggttggctctcgttctttctncacgcagcnnngcgnnncgaattcggcacgagcctgcagccactaatgcattgtgtatgataacaaaaactctggtatgacacattttctgngatcattgntaattagtgacatagtaacatctgtagcagctggttagtaaacctcatgtgggggtggggtgggggtgtatncctngnggganggnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnc

SEQ ID NO: 477 - DNA, 747 bp, Homo sapiens
  misc_feature 2, 3, 16, 17, 20, 25, 26, 27, 28, 29, 31, 47, 50, 53, 57,77, 79, 82, 94, 151, 154, 156, 157, 173, 198, 200, 201,205, 211, 218, 222, 223, 224, 226, 242, 245, 275, 281, 295,304, 312, 320, 324, 331, 338, 350, 353, 359, 360, 361, 362: n = A,T,C or G
  misc_feature 363, 368, 377, 381, 382, 383, 385, 387, 398, 400, 408, 426,427, 431, 435, 443, 451, 452, 453, 454, 455, 456, 464, 466,468, 469, 471, 473, 477, 481, 483, 487, 495, 499, 500, 501,502, 508, 510, 511, 517, 544, 547, 554, 567, 568, 578: n = A,T,C or G
  misc_feature 595, 603, 604, 606, 614, 616, 622, 625, 637, 641, 648, 651,653, 660, 664, 665, 667, 668, 670, 674, 675, 680, 685, 687,689, 693, 699, 700, 701, 702, 705, 708, 709, 712, 713, 714,715, 717, 722, 723, 724, 726, 727, 728, 730, 733, 735: n = A,T,C or G
  misc_feature 741, 742, 745: n = A,T,C or G
gnngtgcctttgaaannccntttgnnnnngnggcccttctaatgctnttncgntcgnggggtcgaactcgccccacncngcnaggcgggggctncaagcgattctaaaccacctatgagtatttcttttagggctcacttaaatacatgtntgngnntactgggggctagccngaataattttagatctgatcaggtngnngctnaaattngaaaaanaccnnntngatgcttaaagaattngcntccatttttgagtctaaatcttttaaaatntactgngatccacatctagngaaatgtcngtgtcaanatattctngatnatcgctnaaatccncattaatactcnttnggggtnnnnnatagnggaacttcntagnnntncnaaaagcacatngncttcctgnctccgctgctcccacagnnggtnttgnaactgggnaaatcagnnnnnngatagcgngngnntntnaganaaantngatncacacatncttnnnnctcagncnncacatngattgaacactctggccaagatgctgnggnggatgangttggagttcganngaagaagccngcgctggcctggcttgnaagacccnngnctttcccntnccctcnctngaaagctgcccngacngaggccnaangnaaatggntganngnncngtcnngcccncttcngncncttngaaccnnnnagnggnnctnnnngnacccnnngnnntncgngnaaccgnnccngc

SEQ ID NO: 478 - DNA, 746 bp, Homo sapiens
  misc_feature 2, 3, 4, 5, 6, 7, 13, 28, 34, 35, 38, 56, 61, 65, 66, 67,72, 84, 95, 686, 734: n = A,T,C or G
gnnnnnngcgcgnccttctaatgcttcntaattnnctnggatactcgttctttctncaggnatcnnntgcgnttcgcaaggagnagagtgatagnaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcaagaccaaaggcaggaaaaaattaangaggtgagatctactcaaggagagctcaaaaaaaaaaaaaaaaaactngggccctttaga

SEQ ID NO: 479 - DNA, 750 bp, Homo sapiens
  misc_feature 2, 3, 4, 5, 6, 7, 8, 9, 10, 11, 12, 14, 16, 17, 18, 19, 20,26, 27, 28, 32, 37, 38, 41, 58, 68, 597, 608, 635, 661,729, 735, 738, 750: n = A,T,C or G
gnnnnnnnnnnngngnnnnnttctannnttcntattnnctnggagctcgttctttctncaggatcccntgcgattcgaattcggcacgagggtagactggctagggatcctggacccagggttccacgtagcaacacctgctgagttctctgggttttcttcctgcctcatgtagcccagacttggagctgaagaagctggaaacatggaaacaccaacagctacagaccaaaaaaagtcccaacaaaggcctgtcagtctgccagcctgttctgtggatttccaactcaagattgcagcatcaactcacacctgaagttctggcttccctacaaactttgaacttgccagtccccacaatggcataagccaattccttaaaatgaatgtctagttctagataatgtgtgtattctactggttctgtttctctggagaagcctactaatagatcatttgtcttagtcaattcaagctactggtacagattaccatagactgggtggttaaaactaccaatcttattactcacagtttttggagtctggaaagtctgagatcagggttccagcaggattgagttctttggtgaacatnctctttctggnctacagaatactgggttactttaagtnggaaaaagtagggtgaagctgggtcntttggcctcttcttttaagggggactaattcatgaagggttccacccttattgacctattttaccttnccaaanggnttccattttccn

SEQ ID NO: 480 - DNA, 714 bp, Homo sapiens
  misc_feature 2, 3, 4, 5, 6, 7, 9, 10, 11, 12, 14, 17, 18, 19, 23, 33,42, 47, 49, 51, 52, 55, 58, 59, 71, 147, 447, 588, 594,614, 644, 645, 646, 647, 648, 649, 650, 651, 671, 677, 678,689, 695, 712: n = A,T,C or G
gnnnnnngnnnngnggnnnttcnaccgttcttntgacctagnctcgntntnnccnacnnagctaggcttgngaattcggcacgagataacacacatcacagtatgctctcagaaatttctttatttgaaccctataccaatatctgntgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcancaaacggagatcgatccgaaaagtggaaatatgagctcttctttggtgttggcatatggaccctgagagaaagaactttaattttttctcttggactgcaataaagtatagctgcctaaaatacgtttcctgaccttggangtttgnccacaatcggtgaaataaangcaagacgtacacttggatgaaaaaaaaannnnnnnnaaaaaaaactcgacctttanactatnngagtcgatacntaatcngactgatagatcattgnta

SEQ ID NO: 481 - DNA, 742 bp, Homo sapiens
  misc_feature 5, 13, 17, 22, 25, 26, 28, 29, 34, 42, 43, 45, 54, 61, 75,89, 90, 91, 517, 644, 667, 684, 691, 725, 742: n = A,T,C or G
agccnttctaaangccntttgnctnngnnccccnttcctaanncntggctaatncttggcnactcgttctttctncacgcacccatcgnnncgaattcggcacgaggcatgaaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagancacaagaagcactgagtatgggcaatgccactttttatgaagttgagagcatccttaaaaacctcagagagtttgacctgcaggtggacaacagaaaacagaactgaagaaccatgaagagactctnctacatcaccagaaggttcaganccaatgacaagacccancaagcanaagagccctggggagccctctgctgatcccaaanggcaaaaaatggggccn

SEQ ID NO: 482 - DNA, 752 bp, Homo sapiens
  misc_feature 2, 3, 4, 6, 11, 12, 26, 36, 38, 39, 46, 54, 58, 61, 75, 569,604, 744: n = A,T,C or G
gnnngnggagnnttctaatgctttgntctagagtcncnnttctaanggcttggnaatnctngctcttgttctttntgcaggatcccatcgattcgaattcggcacgaggccaagcctcggcctccactgcacctgctgcggagtggcacctttgcctgcaaggccctctaccccatggcccagtgtcatctcagcagggtctttggccactcaggaggcccttgtggtgggttgctcagtctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcaaangtggcaggatcattccagcccaggagtttcaagancagcctggcaacacagtgagtgagaccctgtctctatttaagaaaaaaattattaagaaattttattaaaaaaggaagaatcaggaaaccaaagtcaaccccaacttaaccctcaatgaaccagccctaacacagatgangggatttg

SEQ ID NO: 483 - DNA, 849 bp, Homo sapiens
  misc_feature 2, 3, 4, 5, 6, 10, 17, 22, 25, 27, 32, 50, 54, 70, 76, 79,80, 88, 89, 114, 129, 143, 144, 146, 153, 172, 189, 210,212, 229, 233, 235, 237, 272, 286, 407, 415, 472, 478, 512,518, 523, 525, 545, 561, 564, 567, 573, 578, 589, 594: n = A,T,C or G
  misc_feature 615, 625, 638, 643, 670, 671, 675, 680, 683, 690, 695, 701,704, 711, 717, 726, 727, 738, 742, 746, 757, 763, 768, 778,781, 782, 783, 787, 801, 804, 806, 816, 817, 818, 841, 847: n = A,T,C or G
gnnnnnattnccctttnaaatnccncngaaancccttggaagcactaccnctcngacccctttggaacgncgactnctnnatatatcnnggatataataggtgataagttctgncaattagtaacatcnggaaaaaacagctnngncctgggngaaaaaggatgccaaaatngcctggaaaagagcagnggagaggagtccgggagatgngngatgcatcgggacgcancatngntnaacattcactgggtctgccaaaaatgtggatttgngggctgcttagatngttacaaggcaaaaggaaaggaaagagttctagagataaaagaactatatgcttggatgaagtgtgtgaagggacagcctcatgatcaccaacatttaatgcccaacccaaaattataccnggttctgntttgacagacttctagatgccatgcacactcttagggaaaaaatattgggattaaancccatnggcattggactaacaaacaggaatttacaaggtnggaaanttttncnaccaatgaaaggggggatcncaaggttttccagaanggntcntaatcncaggnaataaaaattnctctngggcaagccctgagtcttaancagcaaaaanactcctcccgaancctgnagaaaaaagggggggcagccaggcccnnaaanggaangtnaggcccnagatnaacaangtnacctccncccagnaaaccccannccccaactggnaccngggnaacccacaacntttgcngaagnccaaaaaagnccnnnaganggaaaaaaaaaaanaananaaaaaacctnnnagcccctaagaaaccttaggggnggcccncc

SEQ ID NO: 484 - DNA, 1098 bp, Homo sapiens
  misc_feature 2, 3, 4, 5, 6, 7, 8, 9, 13, 14, 15, 16, 17, 24, 29, 41, 46,48, 57, 63, 75, 81, 127, 133, 139, 166, 228, 234, 236, 246,250, 341, 368, 633, 682, 683, 690, 700, 773, 793, 811, 816,847, 856, 871, 876, 877, 887, 891, 896, 901, 906, 909: n = A,T,C or G
  misc_feature 921, 934, 939, 948, 961, 973, 1006, 1009, 1015, 1039, 1042,1064, 1081, 1090, 1092: n = A,T,C or G
gnnnnnnnntttnnnnntttttgnaaaancccccttttgcnaaatngnccctttttntggcangggatccccatntttatntcggacattttcgggccaccggaaggggccgggggcccccgggccnccaggnccgggnaaaggccccccttgggcggcccccggncggccccaatgggttccaaaaagggaaaaaaaaaaaagggggaacctgggaagttggcccangaaaangnaaaaaaaggnaagnaaaccttccgccaatgggaatggggaaaaataattttttcttgaaaaacccaaaaaaggaatggttatttttcaaatttaaaaaaggaacnttgggaagaaagaattggcttcccacncgcagaaagggcattactggctatgtcaagtaaaagaagtccttcaaagcttagttgatgatggtatggttgactgtgagaggatcggaacttctaattattattgggcttttccaagtaaagctcttcatgcaagggaaacataagttggaggttctggaatctcaagttgtctgagggaagtcaaaagcatgcaagcctacagaaaagcatttgagaaagctaaaattggccgatgttgaaacggaagagcgaaccaaggctntgcaaaaagagcttttctttcactttcgagaccaaaggggaaccagctnnaagggcnagaaaagttngaaaaaaattccaaaggaactggtggaatcccccaaaaggtttggttggggaaagaaaaattcccgccccaangccaaaatttaaaaggtttngcccccaaagggaaaagncttgncctttaacccaggaattggggaccctggganttaaaaccnataattttcccgccnaattnnaaaaaattcntttnggggnccccnaaaanggnaaaaaaattttnggggggttttggnaaggnaaaaatttnaaatttggatttngaaacttttttngggaattccccagaaagaacttttgaccttccnttngacctnaaaaattttcccttgggggggtgnaanggatgttcccaagctttgtggnatattggtaaaattttnaaccttttntncttacc

SEQ ID NO: 485 - DNA, 798 bp, Homo sapiens
  misc_feature 2, 3, 4, 5, 6, 7, 9, 11, 12, 13, 14, 18, 27, 28, 42, 52,57, 64, 200, 220, 458, 635, 675, 691, 696, 729, 740, 756,772, 797: n = A,T,C or G
gnnnnnnantnnnntttnaaatccttnntgaatcctttgaantaccatcccnttttncgaattnggcacgaggaaaggtggcgcgcttctcacggctgagttgctgcgccttgcagacggaagctccccacaggcagagctgcttggatgtgtgagtcatgaaccagagaagccccgctccatgagcagtgactccccangccctgtgacctccctcctncttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgnttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgaactggccaacaacccagttgttgncgccttttcagacagaaccagtgtcatcttacacgtattnaaatggatgtcctggngtctncctaatatgtattcaaaagcaagctggggcctngaccacccttnggcacatattcctcanggacatcattcctgangctgtgtcactggcatgtccttaanc

SEQ ID NO: 486 - DNA, 785 bp, Homo sapiens
  misc_feature 2, 3, 4, 5, 6, 7, 15, 23, 27, 38, 597, 709, 711, 717, 735,741, 780, 784: n = A,T,C or G
gnnnnnntttgaaanccctttcnaatncttggcattgntctctttgcaggatccctcgattcgctgacaacttgattgggttctccttcaggtttgaagcgccctcgagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaataggggaaactattcagagaaaacttaagccactaagttttatggtgttttgttctgtagcagaagcataggcatactgacaatacaaaccgaaatccttctaacgtagtggaccttttcangccagcattttttccttgaaaacctggagcatgtatccatcttatagcagagatcactttcacaatggttgggctcttggatttgaattgatgatgtaatgagccctctttncngattgnaacttaattactctgggnatttgntggattcccaaccttctaatatttacttttcctctttantaanc

SEQ ID NO: 487 - DNA, 797 bp, Homo sapiens
  misc_feature 5, 6, 7, 8, 16, 21, 32, 36, 40, 47, 76, 77, 78, 89, 97, 101,109, 120, 125, 130, 138, 168, 173, 176, 179, 189, 190, 194,197, 213, 214, 217, 219, 221, 223, 224, 225, 226, 227, 231,233, 236, 240, 241, 242, 250, 253, 255, 261, 263: n = A,T,C or G
  misc_feature 267, 273, 281, 284, 285, 292, 297, 299, 303, 305, 307, 313,315, 342, 345, 346, 354, 368, 372, 374, 381, 384, 385, 393,413, 435, 443, 444, 473, 481, 484, 490, 491, 506, 518, 539,540, 565, 570, 576, 582, 583, 601, 604, 607, 613, 614: n = A,T,C or G
  misc_feature 616, 624, 631, 635, 638, 643, 644, 652, 664, 666, 678, 693,696, 699, 723, 729, 731, 734, 748, 756, 757, 771, 775, 779,787: n = A,T,C or G
ttgtnnnncccttttnaaatncctttggctanttgntctntttgctngatcccatcgattcgaattcggcacgagnnnggactaccttncaaaaccnggtngggaagcntgttacagaantgatntctantcccctgnattctggatgctgcagaccaacacctgccnacaanacncanacacacacanncaancantatcatgtaagacagnncgntnantnnnnnattntnatncttnnncatttacncantnttgtanantggntcatgngtctatanatnnttgtaantattntntgananangacganantctgaatcttaagcatatgctccatcnttnnatatgctntggtggagaggctngccntnattcatnttnncatggagncaagtttaatgcctctagantacattctgggcttcaagcatncttatttnnaactccctgagtgatgggtggataaatcnaacattgnctnagtggnntcaagacaactttgntggtggttttgntcacaatcatgaaaatggttnngccagataaatattttgatattagntttcntttttnatatanngcggtaggtttgaattgnacnttnaaatgnntngggttgtnaagacantggnttncaatnnaatttatnacatgaattggngnctcccctttggngaaaccttaaagaanttntgnatacttcttcataaaagggtgtgngatttngnaantttcgggggttttnaatttttnntgaagcttatttcntganaatntacttggnttaccaagcc

SEQ ID NO: 488 - DNA, 762 bp, Homo sapiens
  misc_feature 7, 8, 16, 182, 185, 186, 617, 639, 655, 690: n = A,T,C or G
caaatcnnttgctctngttctttttgcaggatcccatcgattcgcgacagctctccaatactcaggttaatgctgaaaaatcatccaagacagttattgcaagagtttaatttttgaaaactggctactgctctgtgtttacagacgtgtgcagttgtaggcatgtagctacaggacatttntannggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttccccacaaacccaagggcaggggccactcttagctaaatccctccccgtgactgcaatagaaccctctggggagctcaggaaggggtgtgctgagttctataatataagctgccatatattttgtagacaagtatggctcctccgtatctccctcttccctaggagaggagtgtgaagcaaggagcttagataagacaccccctcaaacccattccctcttcaggagacctacccttcacaggcacangtcccccaaatgagaagtctgntacccctcatttcttnatctttttacttaaactcaagaggcagtgacaggnagtcaggggcaagacattacatttttcatactttcccacatctgaaaagatgacaggggaaactgcaaagcc

SEQ ID NO: 489 - DNA, 822 bp, Homo sapiens
  misc_feature 3, 4, 5, 6, 7, 8, 11, 12, 13, 16, 17, 22, 26, 38, 207, 209,423, 662, 683, 687, 690, 702, 711, 715, 722, 724, 725, 736,737, 744, 776, 788, 799, 807, 809, 811, 812: n = A,T,C or G
ttnnnnnnctnnnggnntttcnaatncttgtttctcgncctttctgcaggatcccatcgattcgaattcggcacgaggattttcgaaactcttcagctacttgcccttttttatctgaaaccatcataccttctgaaagaaaaaagcatatcttcattgacataacagaagtgagatggcccagtcttgatacagatggtaccatcntntatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccangacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatgggaaatattcctttgtctttagcacttcatttttctaaataaaaatcanccaatatgtctaaaaaaaaantttnttnataataaacctngaagccctnttanaaccttntnntggaggtcctnntttaccntatgattcccggaacttggataaggaatcccntttggattgganattttgggccnaaaacccncnanncttggaatcc

SEQ ID NO: 490 - DNA, 789 bp, Homo sapiens
  misc_feature 1, 7, 33, 80, 91, 92, 102, 105, 107, 114, 116, 118, 119,124, 129, 132, 137, 140, 149, 150, 152, 154, 160, 163, 190,204, 206, 221, 250, 275, 368, 377, 414, 419, 420, 444, 449,451, 456, 461, 463, 464, 473, 477, 509, 522, 524, 529: n = A,T,C or G
  misc_feature 531, 534, 536, 545, 546, 548, 550, 563, 565, 582, 591, 611,612, 613, 617, 628, 639, 643, 651, 654, 668, 680, 681, 682,687, 690, 692, 693, 695, 703, 710, 714, 733, 742, 761, 771,782, 783, 787, 788: n = A,T,C or G
ntgtaanccttttcaaatcccttggctacttgntctttctgcaggatcccatcgattcgaattcggcacgaggccggacngtgactctggnnacgcttgcgnccntnacgtagntngnngaccntgcanganggaanaanggctggccnncngntgtacnctnaccgtcctaaccccgcgaggtccaggnccgctcctttcggngnggattctcgcggaanatccctccggcagctctttgcaaagctgnttagaaacttctcccaaactcggcntggatacgactgctatagggctcgctgctgcttttgtggagctcttgctcctctatccttggcctctcctgggatacggcccaaggccaagtnttcacgcangttggtacgcttatttcgttctggactctgggggctntgaannttcaccacgtggactgctggggancgggntnccgancactngnntaccttacnccanaatctgacaacttttctggacaacctacccancttcaattggctngngagcncntcngntgctggggnntncngtgcaaatggagncncaattggtgggcaaatngttgatggncaaaacgggaaaaagcaacnnncaangcttttggctnaaagccgatangacncaaattanttnctttggaccttganaatttcctcaannnttttnagnanncncttttttncttgganaaanacttaaaagtgaacgattnttgggaaanaaacaaactataataactnaaagcttttntaaaaaaaaannaatnnt

SEQ ID NO: 491 - DNA, 790 bp, Homo sapiens
  misc_feature 9, 18, 20, 31, 46, 48, 57, 62, 64, 66, 96, 126, 613, 639,768, 777, 790: n = A,T,C or G
tccaaaatncccttggantnattcccccttncaatacctttccttngnacactcccngtttngntngatcccatcgattcgaattcggcacgaggnaacaaagaaggaatgtcttcctcatgtttnggtctatagaagacgttaaagaaaacttccagaaagtgggtttgaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtcgtttatgcttttcactgttgtggtaggggctttggaaagtnaatgccatcaacaatggatacagaangacctggatttggaataagggcaaaaatttattttgatggggctgaattgctctgccagggagcattttgggtattgagatgaaaatggcctctctttgagactgagctgccacctggcaaattattgnctgcttaanggttctctttatn

SEQ ID NO: 492 - DNA, 804 bp, Homo sapiens
  misc_feature 3, 16, 17, 20, 24, 26, 41, 44, 49, 539, 651, 662, 700, 715,747, 759, 764, 779, 780, 781, 782, 783, 784, 785, 786, 793,799: n = A,T,C or G
tcnaaatcccttttgnnagnttcncnctttgtttccctttnctnggctncttgttctttttgcaggaatcccatcgattcgaattcggcacgaggtccttttgaaccaccccaaagaactcaacatggcaaagcaaatggtaaaagcttcccgactgttctactttgggtccgcgcgaagcccactcacgtgtgatctgtgttgcccctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgntatccttcccactgtttttatcactgatttattttgtgaaaagttgtacactaatgttctatgtcaaaatcaaaaagtatttaatgaaatactagttctatttaatgtgggntatggaaccancttggaaacacaaaacaaacaggggattgtacaagcangcttggggcccaagnaaggtcaaggttcatttggttaccatatgccnataaaacctcancgaanttttaaaaaaaaaannnnnnnnaaaaaancttggngggct

SEQ ID NO: 493 - DNA, 800 bp, Homo sapiens
  misc_feature 3, 4, 6, 7, 11, 38, 42, 46, 54, 60, 79, 702, 713, 752, 755,784, 798: n = A,T,C or G
ggnncnntttnccccccttttgaaaaccccttttgggngaancccncttctttnaaatcncttggctactcgctctttntgcaggatcccatcgattcgaattcggcacgagtatataacaacttttgctttcaaagttgggtgggactagaacacacaatggaaggatggagtcaggagacctggattcttgtgcccgctctggcttttacagtctgcctaactctatgcagtcacttcctgccagcctgtttccttacctacaagagggagagacactccctggccagcctagttctcagggtgaacgaaaggtcattatcactgcatcctctagtcatttgcttcttcgctaattaacacatcttgagcacctgcgatgttccaggaacaggagatggcagcgtgcaagataaaagtccctgacttctagagactgcatgttagtggcaatcggcgtctacccggccttcaataaactactgaatgaaggaaaattctacctagcaccagacacaattactgggtttctaaaatggaattattcccccggccccctgcatccagcagcctgctgcagggaagctcctccgaagctgtaggcaggagcgggacaaatgcttgctatcagcttcacagaatgttacctaagtactattcctacacagcgccttacagaacaaacagtaaaaaccaaatggnaagcatgcacnggcttaaaaactcaaacttcctaactactcagtaattanganggtcattttaccccaaaatagaattttcnatttatccaataanaa

SEQ ID NO: 494 - DNA, 757 bp, Homo sapiens
  misc_feature 1, 4, 8, 9, 17, 22, 26, 29, 35, 41, 47, 526, 621, 664, 669,707, 719, 747: n = A,T,C or G
nggnttcnntctaactnaaacngttnggnaactcncctctntctgtngatcccatcgattcgctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgangttggagttcgaaaagaagaagcaagcgctggcctgccttgaaagaacccgaaagtctttcccattcacttctctagaaagctgccaagacagangcagaaaggaaatggatgatagttctgtcaagcacacttctgntctcntagaacttagaaatggttctaagagaacagaagttatngagaacagttcntgtggaattcaacatcttgggtgggacncattggcttt

SEQ ID NO: 495 - DNA, 756 bp, Homo sapiens
  misc_feature 3, 4, 5, 6, 7, 8, 16, 38, 474, 689, 690, 706, 713, 733: n = A,T,C or G
ggnnnnnntcttttcnaatgcttggctctcgttctttntgcaggatccctcgattcgcaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatnacggaaggaagaataacggagaaggagataagagatcatatttcaaaagagactttgttctatatttgtggccaccttcaatgacagactttttctccaagcaactggaaaacaaccatgtcccaaagaacacatttgctttgagaagtggtggtaggaggcagacaaaggcagaaaaaattaagaggtgagatctactcaggagagctcaaaannaaaaaaaaaaaaactnggacctntagaactatagtgagtcgtnttccgtagatccagacatgataa

SEQ ID NO: 496 - DNA, 744 bp, Homo sapiens
  misc_feature 5, 25, 28, 620, 621, 622, 623, 624, 625, 626, 643, 709, 733,740, 744: n = A,T,C or G
ctttnaatcccttgcactcgtcttntgnaggaccttatcgattcgaattcggcacgagataacacacatcacagtatgctctcagaaatttctttatttgaaccctataccaatatctgttgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaataccgtttcctgacacttggaggtttgccacaatcggtgaaataaaggcaagacgtaacactggatgaaaaaaaaaaannnnnnnaaaaaaactcgagcctntagaactatgtgatcgattcgtagatccagaatgatagatcattgtgagtttggacaaccacactngatgcagtgaaaaaatcttattgngaattgngatn

SEQ ID NO: 497 - DNA, 772 bp, Homo sapiens
  misc_feature 2, 6, 7, 10, 14, 18, 32, 34, 39, 87, 110, 465, 688, 706,720, 771: n = A,T,C or G
gnttgnngtntaantttntaaggatccctttntntgaanccctttctgcaggatcccatcgattcgaattcggcacgaggcaggagnaatcacttgaaccctggaggttncggttgcagtgagcacagatcatgccactgcactccagcctgggcaacaaaacgagacttcgtctcaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgntttactttgaatatagaatagtttttttaattagggcttattttgaaaaattctgagtttaattcaaatgtatgccaataccttccaaagtaaggtaatattcagagacagttgttggtgatcagatggcttagagaaaatttctggaatattcacattcgaagatccttattatgaatgtctttgacttaaatctaaccaaaaactgcacattattctttgnacattttcattatatagngttaacaagcttanttgcaaaccaataaatacttaagctatttaaaaaaaaaaaaaaaaaactcnc

SEQ ID NO: 498 - DNA, 773 bp, Homo sapiens
  misc_feature 1, 4, 8, 11, 12, 23, 32, 152, 258, 351, 482, 524, 574, 605,742: n = A,T,C or G
nttnagcntannagccgttgtantgaagcccntttgctacttgctctttttgcaggatcccatcgattcgaattcggcacgaggacccaggtagaccagctcaagagttcatgttctttgtcatcctcctgtgagctctctgtaagtctctntcttgcccatcaccacatccctagtactgggtatcagtctggccacttggctttctggtttgccccaatgtggtctattcttgatgcagctaccaaagtaatgttntaaaaccattataccaagttactatccttgtcaaaacccccagtaactgccaatctcacttagaataaaatccggactcctgtgaagcacagnataaactggcactgcctatgcagcaacctcatctttaccgtttctgccttgctcactcccttcagcgccggtattcttcctgatgcccctagtacacaacaactccttcctgctccaagagtaggaaaatnactgtctctctgccagtgagattcctcttctggtattacctntgcttcattgctgaatcttctgcaatatcatcttctaaaaagagcctttnaaaatcaccttttctattatgccctactcantttccagtccctgaatggccattccccactttcatagccacttaattgctatctgaaattacacttaaaatggtcaccttcatgatgggaaggcaattaattgcctttgtcactggtatgtctagagaacaagcagnttggctcatagtaggcactcaacaaaaattt

SEQ ID NO: 499 - DNA, 735 bp, Homo sapiens
  misc_feature 10, 21, 71, 73, 78, 85, 87, 88, 90, 97, 113, 128, 131, 156,157, 165, 166, 175, 180, 183, 193, 204, 233, 246, 275, 325,434, 437, 446, 451, 480, 511, 521, 539, 541, 547, 558, 565,570, 592, 609, 613, 618, 619, 621, 625, 651, 657, 673: n = A,T,C or G
  misc_feature 691, 692, 693, 694, 696, 698, 703, 713, 715, 720, 722, 730,732, 734: n = A,T,C or G
gcttcaatanctttttctaangctctttttgcaggattccatcgattcgaattcggcacgagagtacccananttgcnaggagtntnntnactgatntagccaggtggcaatnatgagtgaatggatnaanaaaggccccttagaatggcaagatnncatttacnnagaggtccnagtgncanccagtgacangaatgagtttnaagggatgggttttaactacagacccagnctctgccaatatngaccttgtgaacttccttgaagatggcancatgtctgagaccggaattatgggacatgctgtgcagactgttgaaactntgaatgaaggggaccatagagtgagggataagctgatgcattttgttcacgtctggagactgcaaagcatacagcccacaggatctggaagagagaaagaacagcctanagnaaatggctngagangaaccacattcccatcactgaacaggganacgcttcaaggactctctgtgtggctggggncctgactatngacccaccatatggtcananaaattncaccagctctnatgagantattntgtcgcgtgttcaggatcttantgaaggacatcttacantttnccaannanaagncatgaaatgtgacattctgcttgaanaagacnatattttatcctcatnaatgtttaaatgtaaaannnnananaaaanactcgagctntnaaatntngtgagttnanang

SEQ ID NO: 500 - DNA, 926 bp, Homo sapiens
  misc_feature 18, 40, 229, 259, 273, 311, 372, 382, 423, 425, 432, 449,450, 451, 456, 457, 459, 462, 467, 471, 476, 482, 483, 488,490, 499, 501, 503, 505, 507, 508, 509, 512, 517, 518, 521,523, 525, 526, 529, 532, 534, 538, 540, 542, 543, 546: n = A,T,C or G
  misc_feature 548, 563, 569, 583, 585, 587, 588, 591, 598, 614, 617, 621,624, 628, 629, 633, 638, 644, 645, 646, 652, 654, 656, 663,664, 666, 669, 675, 676, 677, 679, 680, 683, 685, 686, 690,691, 693, 694, 705, 709, 710, 716, 717, 722, 724, 725: n = A,T,C or G
  misc_feature 728, 739, 744, 745, 748, 752, 754, 757, 761, 766, 767, 768,773, 776, 777, 779, 785, 793, 794, 796, 798, 802, 810, 813,815, 821, 825, 827, 828, 829, 830, 836, 837, 838, 839, 840,843, 845, 849, 851, 852, 853, 854, 856, 859, 865, 868: n = A,T,C or G
  misc_feature 873, 875, 882, 883, 884, 885, 886, 887, 889, 891, 895, 898,902, 903, 904, 907, 908, 912, 913, 915, 920, 921, 924: n = A,T,C or G
tttaagccctttctactnctcttttgcaggattccatcgnttcgaattcggcacgaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagncccagtgtataaggagatcatattccaaanggttgtcagttggntgtttgcaacctggaatgtattttcctttagagaccangttatccatggtggttaggcccctagagcagctggaaaaagatgatcaaaccaataggttngctgacatcnaataatgtaataagtttgctaaaggaatctaccatcaaatntnatattgnttccagggaaggttgtnnnttaanntnccntcttngtgncatantggacnntcccntnccagtcatntncntnannnctngggcnngtntngnnttngtntntttngncnnctnancaatatttcatatcncccctngctaaaattctttnanannaanttctcantttctccctttactanaantttngtntttnntccntttantatttnnncctatntntntcgttcnnanatntcattnnntnnttntnngctnntnnatcacccttanctcnntctcanntatcntnntcntattatctctntattnntcncttntnatnatcnttccnnnttgtntanncnattatntcttgttnntntnctcncatctctntcntnttctcngctnannnnactccnnnnntcncnctcntnnnnanatncatatnctnctttngntatatannnnnntntntacntanctcnnnatnncatnncnatatnnttngt

SEQ ID NO: 501 - DNA, 706 bp, Homo sapiens
  misc_feature 1, 5, 23: n = A,T,C or G
naatncttggctcttgttctttntgcaggatcccatcgattcgaattcggcacgagaatgcaaagggctgcagttctcattcaggctactttcaggatgcacagaacatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctattgtaatacaaggcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcacagtagtttctattcaaagaagatacagaaaactaactgcagtgcgtcccaagcagttatttgtatcagtcttattacagagctttaagtccaaagatatcaaatatgcacgggctgcacactaatcagtcttctatca

SEQ ID NO: 502 - DNA, 784 bp, Homo sapiens
  misc_feature 3, 4, 28, 31, 601, 603, 605, 606, 608, 609, 610, 611, 614,621, 623, 625, 627, 629, 637, 644, 656, 657, 658, 660, 662,663, 670, 682, 692, 700, 705, 713, 721, 725, 745, 757, 782,783: n = A,T,C or G
ttnntttttttggttaccctttgctctnggnctttttgcaggatccctcgattcgaattcggcacgagccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggtggagtagttgtgggctggacaaatcaatcgtgtggaaattgttaggagttttattacattaaacttgttaacctaaaataccatcaaaaaaaaaaantncnnannnnccncccaccnancntncnaaaaaaancctcgancctttaaaaacnnntngnngaggccntatttacgttanattccagacnttgaatanggatnccatttgnattgaaantttngggccaaacccccaaccttngaattgccattngaaaaaaaaatgccttttattttgnnt

SEQ ID NO: 503 - DNA, 764 bp, Homo sapiens
  misc_feature 3, 4, 6, 16, 29, 30, 32, 47, 101, 660, 665, 677, 708, 711,712, 720, 746, 752, 753, 757, 763: n = A,T,C or G
ttnntnttccttgaancctttttctacanncncctttgcagatcccncgttcgaattcggcacgagagacaaagaaaaggtggcaatcatagaagagtttntagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaattaaatttggtgaagcacttaagaaatgtcattgagattgagagacttttataggaaatcactgatgacccagtttgactttcatacatactgtatganggaanattacccttagnatcttatggtgggactttatttaaaaacttncannaatgttcnttcgacagccttccattttaacttcnaaggcnncaangaattnt

SEQ ID NO: 504 - DNA, 795 bp, Homo sapiens
  misc_feature 7, 15, 16, 23, 25, 45, 478, 491, 518, 524, 567, 578, 597,611, 639, 645, 670, 679, 686, 690, 705, 723, 733, 755, 756,771, 773, 777, 793, 795: n = A,T,C or G
ttgtacntctttttnnaaacccntngctacttgttctctttgcanggatccctcgattcgggaatctcctagaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactcctcctgangaatggtctggtngttgcttctaatacacgattgcagctncatggngcaatgtatggaagtggaatctatcttagtccaatgtcaagcntatcattttgnttactcagggatgaaccangaaacagaaaggtntcagcccaggacgagccaccttcaagcngttaanaagccagcaattacattcacagtcnccaggaaanaaaaggncagncctatcccccctttncctggcaaaaggcccgtnaaccttaaanaaactgcctttagccctttatnntggaaagtggattcncncttnattcttggacccctgncn

SEQ ID NO: 505 - DNA, 774 bp, Homo sapiens
  misc_feature 2, 3, 5, 7, 8, 11, 13, 15, 25, 101, 513, 586, 600, 609, 662,682, 689, 706, 724, 732, 753, 755, 757, 760, 773: n = A,T,C or G
tnntntnnttnantngaaccctttnctcttgctctttttgcaggatccctcgattcgaattcggcacgagcacaaggagaagaagttaattaacattgaangatgagaagacatcttggaagaacttgaattgggccttggaagaagaacagccattcaaatagatagaattgtggtagcaaaggcatagaggtaggaaagtatagatctccagggacagtagtcatggggttggggcactgttggaatttaaggttggaaggatatattggagccccttgaatacggtaacaaggcacaccttgggcagtggagagttatcagagtgtttgaaaaggagggttattgagtaaataaatagactggtactttaggaattttaaaatgtggatcattgtactactaataactatttattttatatttactatctactaagtaatttacatgtattttcttgtactgactgtaaaccttctgggtgtgggtgttttaagtgccattttactgatnaagaaactgaggcttaaatagttgaaataagtcaccctgttagtgagtggccagaatgacaagtcagatctanggtttgtctaactnccaaagatnatataaaaataatggatctctccttttcccttatgcataaaatatggggagcntttttaaatcattacccatncgattgnccaaaaaaatacctttngggaaaactgattattantattccanaataaatttcaacggcctgcntngnctnctttacaactttnt

SEQ ID NO: 506 - DNA, 796 bp, Homo sapiens
  misc_feature 4, 9, 10, 14, 16, 40, 41, 43, 45, 48, 49, 52, 61, 87, 435,479, 495, 552, 556, 564, 617, 628, 638, 642, 643, 654, 663,664, 666, 679, 681, 685, 691, 697, 700, 704, 708, 713, 718,720, 724, 732, 739, 740, 744, 750, 753, 761, 766, 767: n = A,T,C or G
  misc_feature 771, 773, 774, 776, 778, 780, 781, 788, 791, 794, 795, 796: n = A,T,C or G
gccnccccnntttngntctcaacttgtaccctttttgcannancncgnnctncttgcaggntcccatcgattcgaattcgccacgangttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtanatcagaaatgacaaatgaattcaaaacctagcaggtgcattgtnaatgtgtgcccagttntgttttggaaatggcagttccttggggtcatgtttctactggcaaaatttgcaatantgtnctattgtntgtaatttcaaaatttataagattatcccccgttcgcccaagtaaaacctgtnctgcccaatanaatcctggantcgnngagaaatcgcntccattcgnngntcaactcgggatncntcgncttaanaaaatnttntccngganccccntcatnangaanaacaccanactattnngggnacctgnaangctcaatngcccnngccncnnangncnnttttccnggnaannn

SEQ ID NO: 507 - DNA, 774 bp, Homo sapiens
  misc_feature 3, 4, 8, 13, 17, 22, 605, 621, 711, 714, 720, 730, 737, 738,772, 773, 774: n = A,T,C or G
ctnntttnttttngaanccttngctcttgttctttttgcggatcccatcgattcgtgaagaggagacggtgacctgggctccttatgtgcctgaaagagtttgagtttcctgttaactccaaatcaacagtattttcaacaagaaatgtgcaattgaaatcaagtgctgtttaagtgcagctaggatttccacaggaagacacttgcagtgaacagagttatggagcagcaaaaacacagatctatttggaaaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaagagaagatgaagtcaagagattggtttagaggctctagcagaagcttagtcatatttcaaaatgatcaaatatcaagaaaaattctgagctgcataacttgtataaagtaattttcagtgattttttcatggttatgatnaaagaactggatttanccagaaacctttacctggattcaagatttaatttttcctttgagcctcatccttaaaggattttcgggaaaacattaaggggagccaaanccnattggntggttgggcntgccctnnaattgcctttggacttttttaaccgggcttttgnnn

SEQ ID NO: 508 - DNA, 724 bp, Homo sapiens
  misc_feature 15, 27, 460, 461, 462, 483, 486, 488, 505, 510, 517, 521,524, 526, 531, 537, 538, 540, 543, 549, 561, 563, 569, 570,579, 581, 586, 587, 599, 604, 606, 607, 610, 611, 612, 615,616, 619, 622, 623, 624, 628, 630, 632, 638, 639, 640: n = A,T,C or G
  misc_feature 641, 642, 645, 653, 656, 657, 659, 663, 664, 667, 669, 672,674, 675, 677, 678, 682, 684, 697, 698, 701, 703, 709, 710,714, 717, 719, 721: n = A,T,C or G
cttgcctttgaaaancgttggctactngttctttttgcaggatcccatcgattcgaattcggcacgaggcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgnnntggggcccgtgcccacaccangcnancccctgtatgggatcanaggcncgaagangcantgnangctgntggcanntnaantactgnctgggctggaanangaactnntaaaagtcntngcccnnatccaccttggnacccnannttnnnccnntantcnnngggntnangtggtnnnnnctngggacagntcnntntggnntgncnatngnncnnatgnanacttggggttcannaancntttccnnatgnaancngngtc

SEQ ID NO: 509 - DNA, 803 bp, Homo sapiens
  misc_feature 2, 3, 4, 5, 6, 15, 24, 26, 582, 634, 680, 695, 702, 746,757, 762, 771, 774, 780: n = A,T,C or G
tnnnnntttatttcnttcgttctngnttttattacatcagctcttttctttttgcggtccctcgttcgcaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagaagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaaccgagagcgagaacgagaacgggagccgagagagagagcgagagagggaaccgggagcgagaaagagaaaaagacaaaaaacgggacccgagaagaagatgaagaagatgcatacgaaccgaaaaaaaaaaaaaaaaaactcgagcctnttaactatagtgagtcgtattacgtagatccagacatgataagatacattgntgagtttggacaacccccacttgaatgcagtgaaaaaaatgctttntttgtgaaattttgngatgctnttgctttttttgtaaccatttttagcttgcaataaacaagtttnccaccaaccanttgcnttcattttnttntttcangttcaaggggaagtttttggaag

SEQ ID NO: 510 - DNA, 789 bp, Homo sapiens
  misc_feature 2, 6, 7, 8, 9, 11, 12, 20, 29, 369, 420, 704: n = A,T,C or G
gntttnnnncnnttttaatntacatacanctacttgttctttttgcagggatcccatcgattcgaattcggcacgagggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtttgggcctgtcacctcctgaaaggctgctttagctgtggatgcccttgattaagggagagagcgcctaggagctgcctgccccanctggggtgacggctgtagggctgggtctatgttgcaagccctatatcctancatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggggtagttctgagttgttagaaatgtttctgaatcaagtttgtttgaaaacacgttgtgcctttgtacccattataagatggtcataanacccaagaactgataagctttgggttttttttggtttggtttggttttttgcttcattttacccattcatgcctagggtttccat

SEQ ID NO: 511 - DNA, 776 bp, Homo sapiens
  misc_feature 5, 8, 22, 28, 346, 372, 423, 509, 548, 571, 607, 618, 637,640, 673, 674, 679, 680, 681, 685, 686, 688, 689, 691, 692,696, 697, 698, 701, 705, 707, 709, 710, 714, 716, 718, 719,725, 726, 732, 735, 737, 738, 740, 741, 744, 745, 746: n = A,T,C or G
  misc_feature 747, 748, 749, 750, 751, 752, 758: n = A,T,C or G
catanagntcttgcctttttgnaggacnctcgattcgaattcggcacgagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggatgtaaattatagttcaataacatagttacaaaagataatcaaaagcatgaaagcactgttgatgtggnttggatctgtgtcctcaccgagtctnatgttgaaatgtaagccccctggtgggaggcgatgggattatggggcagantcctcacaaacgggttagcccacccgctcaggctgttctcctgatattgagtcctcatcacatctggttgcttcaaagtgtgtggngccttccctctatctcctactgctctggccatataagangtgcctgcttctccttcgccttntacatgattgtaaagtttcctgagcctcctagaacnaaagctgctgngctttctgtccatctacangancgtgagcccaattaaacctcttttttttttttnngaggnnntttnntnncnntccnnncantttnananncctngnannggtttnnaaaaanaananngnnaannnnnnnnncccccngcccttttaaaataaaaa

SEQ ID NO: 512 - DNA, 917 bp, Homo sapiens
  misc_feature 412, 413, 415, 418, 421, 424, 427, 432, 434, 444, 461, 467,471, 480, 492, 501, 507, 517, 522, 525, 526, 527, 528, 529,537, 541, 551, 555, 560, 564, 566, 569, 572, 576, 578, 583,584, 587, 588, 589, 593, 595, 597, 598, 599, 600, 601: n = A,T,C or G
  misc_feature 602, 606, 608, 611, 617, 621, 622, 623, 627, 630, 632, 633,641, 646, 649, 650, 664, 665, 668, 671, 672, 674, 691, 695,697, 699, 706, 708, 712, 713, 714, 716, 720, 721, 723, 725,732, 733, 735, 737, 745, 746, 748, 756, 761, 764, 765: n = A,T,C or G
  misc_feature 766, 767, 769, 770, 771, 776, 777, 778, 780, 781, 782, 783,791, 795, 796, 797, 805, 806, 807, 808, 809, 811, 812, 814,815, 817, 819, 825, 826, 828, 831, 836, 841, 844, 845, 846,847, 848, 849, 851, 856, 857, 864, 865, 867, 868, 869: n = A,T,C or G
  misc_feature 875, 876, 877, 878, 879, 880, 882, 883, 884, 885, 886, 887,888, 890, 891, 892, 894, 898, 899, 903, 905, 906, 907, 909,912, 913, 914, 916, 917: n = A,T,C or G
ttatttcataaactattgttctttttgcaggatccatcgattcgaattcggcacgagggctgcgaggttttcggctttggctcctgatatgcagcgacagaattttcggcccccaactcctccttaccctggtccgggtggaggaggttggggtagcggaagcagcttccggggaaccccgggcgggggcggaccacggccgccctcccctcgagacgggtacgggagtccgcaccacacgccgccgtacgggccccggtctaggccgtacgggagcagtcactctccgcgacacggcggcagcttcccggggggccggttcgggtctccgtcccctggcggctaccctggctcctactccaggtcccccgcggggtcccagcagcaattcggctactccccaaggcaggannanaancanccncanggttntncaaggacatntacaccatttggatcanggcgtnttanaaaaaaaanaatgttaatganttggaaaantatttnaaagcctttnaatgnttnnnnnaatccttngggnttggccttanaaanccaanattntngtnggngggntnttaannccnnncaantncnnnnnnattncnttnaaaacntttnnnccanggncnnaaaaaaanggggnaannaaaaaacttttttnnttnaannantttttttggaaaatttnaaancntnggaaaancntttnnntngttnntnangggaaannantnttttgggnncnaaaaaacnttttnaannnntnnnggttnnnannnnttaaaaantttnnncccccaannnnntnnanngnancttttnnanttngggantaaanttnnnnnnanggggnnttttttnngnnnaatttnnnnnnannnnnnnannnangggnntttngnnngnaannntnn

SEQ ID NO: 513 - DNA, 780 bp, Homo sapiens
  misc_feature 2, 3, 4, 5, 6, 7, 249, 258, 266, 294, 295, 301, 309, 331,345, 418, 431, 487, 530, 533, 539, 556, 648, 682, 735, 766,770, 778: n = A,T,C or G
tnnnnnntttaaatccattagctacttgttctttttgcaggatcccatcgattcgtgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaanaacccgtangtggtccncggcggcgcggggaggcccagggcaatnngacagnccctccgnttgactccgccagtgctgcagnccctactctttcanagttgggagccctgggacccaggcaccaattgttcttgcaaactcaccctgcggcacatcaacaagtgcccanaacacgtgctgangcacacccaaggccggcggtaccagcgagcttttgtgtaaatatgaagaatgtctnaagcaaggggtggagtacatgcctgctgcctggtgcacccgangangaaganggaaggacaaatggacngtgaacggccttcgcccgcgggaaagcttctgggagcccacattcaatgatgaagggggagctgcaagtgatgacagcatgacagacctgtncccctgacttttcaccagaaggaccttgaacacngaggatggggatggactgatgatttttgacaacaaagaggttgaaaggcaaanccccaaaaaaaaggccttgtgaaggcagganaaanacaacctntc

SEQ ID NO: 514 - DNA, 793 bp, Homo sapiens
  misc_feature 4, 5, 6, 7, 9, 14, 15, 16, 29, 241, 265, 378, 637, 761, 770: n = A,T,C or G
tttnnnngntttannncattttgctactngttctttttgcaggatcccatcgattcggaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattanacaaacttacgaatgcttaacttntttacacagcataggtgaaatcatatttgggctattgtatactatgaacaatttgtaaatgtcttaatttgatgtaaataactctgaaacaagagaaaaggtttttaacttanagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaactttnccccctgtgtaaagttactatggtttgggggtacaacttcattctatagaatattaagtgggaagtgggtgaattctactttttatggttggggtggaccaatggctatcaagagtgacaaatnaaggttaanggatgattcccaaaaaaaaaaaa

SEQ ID NO: 515 - DNA, 770 bp, Homo sapiens
  misc_feature 7, 11, 12, 675, 703, 749, 753: n = A,T,C or G
cttattncatnnagctcttgttctttttgcaggatcccatcgattcgaattcggcacgaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatatttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccacactgattggactgccctacaccaatcagaactcagtgcccaatgggccactgttttgactcggaatcatgttgtgcactatagtcaaatgtactgtaaagtggaaanggatgtgccaaaaaattaaaaaaaaccnccaaaaaagcttccaaaaaaaaacctttaaactatagtgagtcgtntacntagatccaacatgataa

SEQ ID NO: 516 - DNA, 825 bp, Homo sapiens
  misc_feature 13, 22, 28, 33, 34, 47, 85, 101, 112, 123, 128, 130, 135,141, 142, 151, 154, 155, 177, 178, 189, 191, 193, 197, 202,208, 210, 213, 214, 218, 219, 234, 238, 263, 270, 276, 278,304, 319, 334, 344, 345, 352, 364, 375, 382, 383, 384: n = A,T,C or G
  misc_feature 394, 396, 404, 407, 444, 459, 460, 468, 472, 480, 483, 500,503, 512, 528, 534, 536, 538, 557, 561, 575, 577, 584, 589,592, 597, 599, 601, 623, 627, 630, 636, 642, 647, 656, 659,666, 668, 671, 685, 686, 702, 706, 707, 717, 720, 721: n = A,T,C or G
  misc_feature 725, 727, 728, 734, 746, 747, 748, 751, 752, 767, 770, 779,795, 796, 810, 813, 821, 822, 823, 824: n = A,T,C or G
tttccagttttanttttttcancttttngatcnntttgcaggatccntcttttcgaattcggcacgagattctccctaaattgtngatcccactgtttacnaaactgttctnttgtgctggcntgctnantgctntgtagnncctttctgnacnntaggcattgctcttggagaacnngatgtgctttntntnaaanggcanaccagngntgnnctgnntttaatgatgcagancctnactttatccacacctggcccgtttnacatttnagtaangnacgatatttggctgatggctgaacantttctgaaatacacntttagtgtatggaantacaagaccnntaaaggnctgccaggttancatctcatctngcattcnnntcctttggcnanaaaggganatntcagaattatatttcttgatggggtcttttcaatcantgtatctgtcgaaanntcttaganaaanctatgtgntcncggtgttgtctaaaaanatnctttcaaanatgacccctggaattncctgananangcttaaacgtgagaagacnggtnggcaaaacaccctncnaaggttnttggnaangcccnantntgttttgtctggcccatataancttngcnccattnaagccncgggngagctttgnatntatattngnggngttactttctttgnncctttgcggggaacancttnnataatgcttntcnncccnanntggacntttgctttttgnnnccnnacccccccaaagggngcncacctccantgaaaaagtctttttnnaaaagggctccttnctnaaaaaaannnnt

SEQ ID NO: 517 - DNA, 1444 bp, Homo sapiens
  misc_feature 6, 8, 9, 11, 12, 13, 14, 16, 17, 18, 24, 25, 27, 28, 30,31, 32, 33, 34, 35, 37, 38, 40, 41, 42, 43, 47, 48, 49,50, 52, 53, 54, 59, 60, 61, 62, 63, 65, 66, 69, 70, 71,72, 73, 74, 75, 77, 79, 80, 82, 86, 93, 95, 97, 104, 106,111: n = A,T,C or G
  misc_feature 113, 120, 123, 129, 132, 134, 135, 137, 138, 141, 142, 145,148, 149, 150, 152, 154, 157, 158, 159, 164, 168, 169, 173,176, 182, 183, 185, 190, 193, 194, 196, 197, 205, 208, 212,227, 230, 231, 244, 257, 260, 262, 265, 269, 273, 274: n = A,T,C or G
  misc_feature 277, 281, 285, 288, 290, 298, 305, 309, 310, 314, 320, 324,326, 328, 338, 341, 342, 343, 348, 349, 353, 367, 376, 378,384, 385, 388, 403, 408, 412, 417, 423, 429, 435, 436, 438,439, 440, 442, 449, 450, 454, 455, 456, 458, 461, 462: n = A,T,C or G
  misc_feature 464, 469, 470, 473, 480, 484, 485, 486, 499, 500, 502, 504,505, 509, 511, 518, 519, 521, 523, 525, 533, 534, 537, 539,540, 541, 544, 545, 546, 547, 548, 549, 552, 553, 556, 557,560, 563, 564, 570, 574, 578, 579, 581, 582, 583, 585: n = A,T,C or G
  misc_feature 594, 596, 597, 602, 603, 605, 606, 610, 611, 612, 613, 617,622, 623, 626, 627, 632, 633, 634, 636, 639, 648, 651, 654,655, 662, 666, 669, 670, 676, 678, 685, 689, 694, 701, 703,705, 707, 709, 712, 717, 726, 731, 736, 741, 751, 752: n = A,T,C or G
  misc_feature 754, 775, 779, 781, 789, 790, 800, 801, 802, 804, 810, 813,820, 821, 822, 834, 836, 843, 844, 846, 875, 877, 891, 893,895, 899, 901, 904, 905, 910, 912, 919, 924, 927, 936, 938,944, 945, 948, 970, 978, 979, 980, 981, 982, 983, 996: n = A,T,C or G
ctctcncnncnnnncnnntctctnncnntnnnnnntnntnnnnctcnnnncnnnatctnnnnncnnctnnnnnnncntnncntccntctcttntntngctctcntntctcntncatcttnccnctattntcntnntnntcnntcntcnnnantnctnnnttctncctnnccanctntccatnntntactntcnntnntctggctnttntatntggggggtctatttnttnncttaaatcgactngttccaagtctcntancngcntctntctnnctntctntgcnctncnctggggcnttaattncccnngctnttatanaagngngnaattaaggtntcnnntctanngctntgcaaggctaatgnttagatccngntagaanncgntacatgttgggaacngacancttnctgcncaaagngggctnaggcanngnnntntgcaaannctcnnntntcnnancttgnntcncgtagancggnnncccctgaattttnnancnnggancnttaaatnntntngnggtacgannccncnnncgnnnnnncgnntannccncanngttaantgcncccnnannnantcaactctntnntcctnntnnaacnnnnttantctannatnnttacnnntnagnttttcctcnctnacnnctctgtncttnttnnatcttntncttctcncttnatttntatctcntntntntnctnccctnatctatctnctacnctctnttccncttctccctnncntctctcatcatatcccacgcnactnancccctctnnctcttacctnnntnctctcntcntatctcnnnaccctctttctntntcttatnncncctatcctctacttattctcctcctattntnccactcacccttcntntntctncnctnntcttntnctatttntactntcnctattcctncntctctnntgnctcccaccccctcttcctctcnctctcctnnnnnnactactctcaccntctcnnctntcnctctacnnntnnananntccttantttcctnctcatcacantactcttccctctcatnntcananctaanttntnctctcactctaccactctntnctccactcatatnanacttctatantnctaatcctatcttcttaaacntctcctcttatcnctctaanctcctcttcntcgctanctccnntncaactcgnaaatctctccaatnctnccccactctaaaaatnncncntcngantcccacttttcngngcanaatnnaacncnantccnctccctttagctatctctctanaaaccccntttctcaacaggnaccnccctntntctcnaaatcctcatnctnctactttatatntcnccaagcctcncctntgtaanagcatctcnctntccnccaatnnanatctccctnctccnatanatntnanat

SEQ ID NO: 518 - DNA, 706 bp, Homo sapiens
  misc_feature 12, 13, 33, 37, 42: n = A,T,C or G
ctaatggctggnngctcgttctttccgcaacancccngcgantcgaattcggcacgaggtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaat

SEQ ID NO: 519 - DNA, 734 bp, Homo sapiens
  misc_feature 2, 24, 25, 35, 38, 45, 66, 74, 115, 190, 397, 433, 447, 457,487, 490, 529, 532, 535, 608, 629, 644, 646, 653, 655, 656,667, 672, 679, 680, 691, 696, 699, 712, 715, 717, 722: n = A,T,C or G
tngtaccaattatctgctggctanntagcctaaanagnttggtcngggcgaattcggcacgagggnaaagcagnaagtaatgagcttgtccgtcagctggtagctttcattcgtnaaagagataaaagagtgcaggcgcatcgaaaacttgtggaagaacagaatgcagagaaggcgaggaaagccgaanagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccnaggacgctgagctctatgatgacctttactgtccancatgtgacaaatcnttcaagacanaaaatggccatgaagaatcacgagaagtcnaanaagcatcgggaaatggtggccttgctaaaacaacagctngangangaacgaagaaaatttttcaagacctcaaattgattgaaaatccattagatgacaattcttgaggaagaaatgngaaagatgcaccaaaaacaanaagctttctacacantnaaatccnannaactccatccntctanaactatnngtgagtccttnttacntcnatccagacatgantancnatacnattgatggaacc

SEQ ID NO: 520 - DNA, 701 bp, Homo sapiens
  misc_feature 13, 678: n = A,T,C or G
ctaatgctggctnttgttctttttgcaggatcccatcgattcgaattcggcacgagcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttanggccctgtcaggaaacacacggg

SEQ ID NO: 521 - DNA, 784 bp, Homo sapiens
  misc_feature 1, 9, 15, 16, 670, 716, 728, 749, 753: n = A,T,C or G
naacacttngctacnngttctttttgcaggatcccatcgattcgaattcggcacgaggagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttgggtaaggatttggggcacagtaccaggaggggggcttggtgccagacctcatgaggaagaaggattttcctatgtacagagaaggggacccctgtcctgttgggangtgctgtgcaaacctaaccaaagttactaacccctctggtttctgnggttacacaaanggggataaatacaaagctttncctnaactagccaattctatttgggtttcctgagt

SEQ ID NO: 522 - DNA, 719 bp, Homo sapiens
  misc_feature 10, 18, 23, 32, 669: n = A,T,C or G
ttctaatttnaatccttnaaatnggttctttntgcaggatcccatcgattcgaattcggcacgagagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtancatttgtgccaatttctggtttggaatggtgacaacatgctggagccaat

SEQ ID NO: 523 - DNA, 710 bp, Homo sapiens
  misc_feature 2, 3, 4, 15, 17: n = A,T,C or G
tnnncttcaaatcgntngctcttgttctttttgcaggatcccatcgattcgaattcggcacgagagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaaattgagagaaataaacactggccttggaaagaaggcaggcaaagctgctgagtaatagtcagaccctaggaaatgat

SEQ ID NO: 524 - DNA, 730 bp, Homo sapiens
  misc_feature 3, 4, 5, 6, 7, 13, 15, 24, 389, 662, 664, 666, 667, 668,671, 672, 673, 676, 677, 678, 680, 688, 690, 694, 695: n = A,T,C or G
ttnnnnntttaancnttcaaatcnctaggctacttgttctttttgcaggatcccatcgattcgaattcggcacgagcccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctncctctacccacccccttcccccgcatgctgatccccctgcccaggtaagggccctgccctggaagactggagggaggccccaagccacggggcatccccctctcccaggaagcagggagggggccgggaggttttcctctcaagccccaccctgggggcccgggggcgagggctgccccctcctcccctccccagtgagggacattttttggtaaaacctattttcattttggaaaatatttatgaataaatagttttatatgaaaaaaattntngnnnttnnnatnnnanaataaaancntcgnncctcttaaaactatagtgaagtcgtattaccttag

SEQ ID NO: 525 - DNA, 711 bp, Homo sapiens
  misc_feature 3, 5, 7, 10, 12, 25, 546: n = A,T,C or G
gcngntnttnantttcaaatcgctnggctacttgttctttttgcaggatcccatcgattcgaattcggcacgaggataaatacctcagcccctcgccttcctcaacccacctggcaagtcttcttaggatctgatcccagttttctggaagcaatcctaccccagcccaagcttcccagagtcgagccttaatccttctcacttctcagtgtcagagcagaaatgaatcctggggttgactgtgtccattcgggttattagcagctaagaagcccagacgagtagtgtgagctgccttgggagcctcagtgagggcactgggactggcctcactctcttgcccccagcctagtgggctttctcctctgtctctccggtggccccaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctnctgtctacctggatgtcctgggctagggggccggccaggggctgggagtggttagcccggaatactggggcctgccttagcatcccccatagcttccacagccccagggtgatctcaaagtatctaattcaccttaacatgtgggaagggacaggtggggcttgg

SEQ ID NO: 526 - DNA, 692 bp, Homo sapiens
  misc_feature 5, 659: n = A,T,C or G
tacangctacttgttctttttgcaggatcccatcgattcgaattcggcacgagagaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctactgggctcctttttgactgaggagtcacctgacaaggaaaaacttctatcagtactttgatatgtcacagtttcatgtttatccagttcaatgtatttttaaatttttccttgagacttctttgactgatagattattgtgaatgtgtttttaaatttccaaatgtttanggattttcatatctttcttatgctgatttccaa

SEQ ID NO: 527 - DNA, 769 bp, Homo sapiens
  misc_feature 6, 109, 114, 117, 127, 145, 147, 148, 162, 172, 185, 190,259, 350, 403, 435, 531, 599, 641, 685, 715, 731, 756, 769: n = A,T,C or G
gttctngttctttttgcaggatccctcgattcgaattcggcacgaggccaagcctcggcctccactgcacctgctgcggagtgggcacctttgcctgcaaggccttttncccantgnccaatggtantttaaccagggtttttgncnnttaaggaggccttngtggtgggtngttaatctggccnttccntattgaaaagctcctgttattgtccacagaccagaaggacttgtaaccttggtcccacagtctgacttnggcttttcaagcacccagaaaacttagagggaatcttatagattccagaacttaaggatacctcaagggatagggtcacagccaagaagtncaaaggaatcttcagtctggaacaaaaacagaaccctttcatgattgacaaangtcactttctgtttgcctggaccaagctactncagatcatctgaccaactcttaaaaatcacggccaggcacagtggctcatgcctgtaatcccagcactttgggaagcaaaagtggcaggatcattncagcccaagagttcaagaccagcctgggcaacacagtgagtgagaccctgctctatttaagaaaaatnattaagaaatttattaaaaaagaagaatcaggaaaccaagtncaacccaacttaacctcaatgaaccagcccctaacacagatgangggatttgggactgataagctctgtgctgngtccatggcccgtcanttatcaaggttgcacttttaaatgnggtatttttatgn

SEQ ID NO: 528 - DNA, 757 bp, Homo sapiens
  misc_feature 2, 45, 63, 69, 76, 92, 101, 121, 123, 146, 148, 151, 155,170, 182, 209, 249, 258, 261, 268, 295, 303, 334, 344, 399,404, 419, 499, 501, 531, 532, 535, 547, 572, 580, 582, 594,595, 604, 632, 635, 711, 746, 748, 757: n = A,T,C or G
tnaatatcagctcttgttctttttgcaggatccctcgattcgcangagggtgttcgactgctngagccnagcgaancgatgcctaaatcaanggaacttgnttcttcaagctcttctggcngngattctgacagtgaggttgacananagntaancaggaaaaacaagtngctccagaaaancctgtacagaaacataagacaggtganacttcgagagccctgtcatcttctaaacagagcagcatcngcagagatnatnacatgtntcatattgggaaaatgaggcacgttantgttcgcnattttaaaggcaaagtgctaattgatattanagaatattgnatggatcctgaaggtgaaatgaaaccaggaagaaaaggtatttctttaaatccanaacantggagccagctgaangaacagattctgacattgatgatgcagtaagaaactgtgaaattcgagccatataaataaaacctgtactgtctagttgntntaatctgtctttttacattggcttttgttnnctnaatgttctccangctattgtatgtttggattgcagangaatttgnangatgaatacttnnttttaatgngcattattaaaaatattgagtgaagctnatngtcaactttattaaggattactttgctgccaccacctagtgtcaaataaaatcaagtaatacaatcttaataaacntttaaactataaaaactcgacccttagacctatantnagtcggttn

SEQ ID NO: 529 - DNA, 821 bp, Homo sapiens
  misc_feature 2, 4, 5, 6, 8, 9, 12, 13, 14, 15, 16, 17, 18, 19, 20, 21,22, 23, 24, 25, 656, 704, 708, 725, 765, 799, 821: n = A,T,C or G
tnannnanncannnnnnnnnnnnnntttgaagccattgctacttgttctttttgcaggatcccatcgattcgaattcggcacgagagcaattccactcctagctccacccacaggaaattgaaagcaaagacgcaaacagatgcctgtgcaccaaagttcacgggcaagcatccttcggccttaatgggcagcattccgtcgtcacaagcgggcattcatcctttcatcaatagcgggcagcattccgtcgtcacaagcgggcagcattcctttcgccacaagcgggcagcatcttgtccgtcacaagcgggcagcatccttcgccaaagcgggcaagcatccttcgtcatagcggcagcatcctttgccatagcgggcaaggtggaaaccctgtccatccactgaggcgtgcatagactaaacatggccagtccaggcactggaatccaggcccgtagaacggcgcccacggtcaaaaggaatgagaccctgatgcactgggcgacacagacgggcgacacagacttggagacatcatgctaagtgaaaagccaggcacacggagcggacggcgtgatcctgctcacgtgatgtgtcccgaatgggcacgttcagagggaagaagggagatggcgcttgccggtgcccggggacnggggttgggagcgacggttgctggtttggggtttctttctggggtgangaantggttttgatatttggnccgttggtgatgtttgcatacctctgaatatgcttaaganccacagaattgaccactttaaatggatgaattgnatggtattgggaattacccaan

SEQ ID NO: 530 - DNA, 765 bp, Homo sapiens
  misc_feature 2, 3, 7, 8, 9, 10, 11, 12, 13, 14, 15, 16, 17, 24, 25, 26,188, 560, 651, 710, 727, 732, 739, 742, 751, 765: n = A,T,C or G
gnntttnnnnnnnnnnnttttatnnntacagctacttgttctttttgcaggatcccatcgattcgaattcggcacgagactaccccggctacggttcccccatgcctggcagcttggccatgggcccggtcacgaacaaaacgggcctggacgcctcgcccttgcccgcagatacctcctactaccanggggtgtactccggcccattatgaactcctttaagaaagacgacggcttcagcccggtaactctggcaccccggatcgaggacaagtgagagagcaagtgggggtcgagactttggggagacggtgttgcagagacgcaagggagaagaaatccataacacccccaccccaacacccccaagacagcagtcttcttacccgctgcagcccgtccgtccaaacagagggccacacagataccccacgttctatataaggaggaaaacgggaaagaatataaagttaaaaaaaagcctccggtttccactactgtgtagactcctgcttcttcaagcacctgcagattctgattttttggtggtgtgtctcctncattgctgttgttgcagggaagtcttacttaaaaaaaaaaaaattttgtgagtgactcggtgtaaaaccatgtagtttaacagaaccaganggttgactattgttaaaaacaggaaaaaaataatgtaaggtctgttgtaaatgaccaanaaaaaaaaaaaaactcngcctntaaactnttntgagtcgtnttcgtaaatccaan

SEQ ID NO: 531 - DNA, 768 bp, Homo sapiens
  misc_feature 2, 3, 7, 8, 9, 10, 11, 12, 13, 14, 15, 16, 17, 25, 370, 431,440, 452, 483, 500, 599, 615, 644, 645, 660, 670, 686, 713,734, 745, 768: n = A,T,C or G
gnntttnnnnnnnnnnnttttaagntactgctacttgttctttttgcaggatcccatcgattcgaattcggcacgaggttcttcaaagccaaccaagacaggcttagcagttttagagcttcagaacaaattgccaaaagccagagttgtttatgctagtgcaactgggtgcttctgaaccacgcaacatggcctatatgaaccgcttggcatatggggtgaggggtactccatttagagaattcaagtgattttattcaagcagtagaacggagaggagttggtgccatggaaatagttgctatggatatgaagcttagaggaatgtacattgctcgacaactgagctttactggagtgaccttcaaanttgaggaagttcttctttctcagagctacgttaaaatgtataacaaagctgtcaagctgtnggtcattgncagagagccggntcagcaagctgcagatctgattgatgctgancaacgaatgaagaagtncatgtggggtcagttctggctgtcaccagaggttcttcaaatacttatgcatagcatccaaagttaaaagggttgtgcactagctcgagaggaaatcangaatggaaaatgtgtngtaattggctgcagtctcaggagaagctnnaacattagaactttngaagaaggcnggggagaattgatganttggttcaactgccaaagtgtgtgcantcactcattggaaaacatttnctgctccagcngggaaaacttatggttacttggn

SEQ ID NO: 532 - DNA, 761 bp, Homo sapiens
  misc_feature 4, 9, 10, 11, 12, 15, 17, 18, 38, 106, 224, 670, 701, 739,755: n = A,T,C or G
cgtnttttnnnnccnanngaaagcccttggctacttgntctttttgcaggatcccatcgattcgaattcggcacgaggatcagcccacctcggcctcacaaagtgntgggattacaggcgtgagccaccttgcccacccacatcatacagttgaaatgaaactttgccacaaccagcctttgctgtacacacacatatatcactgaacctggttgaaataaagntttttttctttttcctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagtttatttccttttttggttgatgggcagtatgccatattatacccaaagttcttttaaaaaatatttccatcaccatttttatttaaaataaacatttgagggaagtaccaaggcagcttttttcctcaaaagtacctggtcctctttgggaatagcacattttangggcattgggtaatcctgagattttactcantaaatcctgatggtactgggtgtaaaatatctttagtnggattgaaggccttgnggggga

SEQ ID NO: 533 - DNA, 735 bp, Homo sapiens
  misc_feature 9, 396, 667, 682, 684, 691, 697, 716: n = A,T,C or G
taaacatcnggctacttgttctttttgcagggatcccatcgattcgaattcggcacgagacactgtcccactccatcacccaggctggagtccagtggtgtgatcatagctcgctgcatcctccagttcctgggttcaagccatccctcctgcctcagcctccccagtagctggaactacaggtgtgtgccatcacacctggctttacatttttctgtggggtcttactatgttgcccaggccggtctcaaactcctgagctcaagtgatcctctgcctcagcctccagagtatctgggattacatatgtcggctaccgtgtctggccgttcacatctttggccactatttgcttgtgaaaaggtataatgaggtggtacttatcatttttactgngtctcatgttttgtatatttttgtttcatcaactaagatgcactgtaacatctctgaaatctggatatattatcaatggtttatcatagttttgttagcaatacactgtcttttagtggtgcctaaaataatggtatagttgtgaggtgatcttagatttgatgaagcacagtatgcaggtaggcctaatgggggaagatggtaatataaaagcaagaagtattttttttttgtaatgactgaaagctgtctgtggatgacctaccctttnctttaaacacgattntntcacttncaactncaaacttgctcaactaatnctttaaaaataacttgagc

SEQ ID NO: 534 - DNA, 735 bp, Homo sapiens
  misc_feature 1, 4, 6, 15, 158, 160, 165, 167, 623, 668, 670, 688, 709,720, 723, 727, 733: n = A,T,C or G
natngnttgctcctngttctttttgcaggatcccatcgattcgagacaacccagaaacaaattcatacatctatggtgaccacttttgacaaaggaatgaagaacatacactgggggaaaagataatgtctttaataaatggtgctgggaaaactggntntccantntgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaaagcaaaagtggacaaatgggatcacatcaagttaaaaatcttctgcattgcaaaggaaataacaaagtgaagagacacccatagaatgtgagataatatttgcaaactatccatctgtattaggccatttttgaagtctacaaagaaatacttgagactgagtaatttataaagaagaggtttaattggctcacggttttgcaggctgtcaggaagcatggtgctaacatctgatcagcttgtagggaggcatcaggaagtttccacccatggtggangcaaaaggggaataagtttctccatggcaggtgcagggcaaaaanangggggaagggaagtgccncacaaccagatcttgtgagtnctcagatttgnggngggngcttgngg

SEQ ID NO: 535 - DNA, 735 bp, Homo sapiens
  misc_feature 2, 5, 6, 8, 662, 722, 727, 730, 735: n = A,T,C or G
tnaannanagctacttgttctttttgcaggatcccatcgattcgaattcggcacgaggtccatacatggagctccctggacccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaaggcaacagaaacaaggagagaagcccgagagacatgtctgcgtgctgccacgcatctgancgattgctcttgtgaagagtttgtcactgaacattttcaggggaggctgtttacccagcnatgtnctnaacan

SEQ ID NO: 536 - DNA, 785 bp, Homo sapiens
  misc_feature 8, 9, 10, 11, 12, 13, 14, 15, 16, 17, 26, 27, 30, 33, 34,35, 36, 37, 38, 39, 40, 41, 42, 44, 45, 46, 47, 53, 54,55, 56, 57, 60, 64, 65, 66, 67, 138, 144, 169, 171, 177,182, 190, 192, 196, 198, 204, 207, 215, 216, 221, 244, 249: n = A,T,C or G
  misc_feature 255, 276, 283, 284, 303, 304, 309, 315, 318, 321, 325, 327,330, 332, 335, 336, 338, 345, 346, 348, 363, 401, 410, 423,424, 435, 439, 445, 448, 453, 462, 467, 486, 497, 506, 514,517, 520, 525, 526, 527, 529, 535, 539, 542, 544, 549: n = A,T,C or G
  misc_feature 555, 560, 579, 583, 586, 597, 599, 622, 655, 656, 662, 674,691, 693, 713, 729, 752, 756, 757, 764, 777, 784: n = A,T,C or G
gccccccnnnnnnnnnnttttcaaannccnttnnnnnnnnnngnnnnttttannnnnttnttannnnacagctcttgttctttttgcaggatccctcgattcgattcggcacgagctaccttgggctggccctctatnatgctntgaggggagctgggacagatgatcntnccctcntcagngtcatggntnccangngtgagnttnatctgccnnacatngtgacggagtttaggaagaatgntgccncctctntttattccatgattaaggganatccatnnggggactataagaaaagcnnttttnctgctntgnggncaanangantnacnngncccgggnnanagctcctatgctgtntgcctgcaccaccccctgccttccttcatacctttccntggatatgnatgccagggcttnncacattgcctnattnatactnacntgctnatgaccaanacatncacgtgataacacaaacantgggtgcttgnttctgatcnctagaggnganctnttggnnngntggagnactnaantnttctnagtgtnacttnagttcaatgcctggccatntgcnatnaccttatatcntncaaagaggctactgtgcttttanccttttttaaaacctccatctgtattacattgnnaaccangtttctttaatnaggagcttgacctctanantgggaactcttgggaatggncttagtgaagttcgcnactaacttaacctgaaaattatnatgnnctgtttnacctatcatgttnataactnt

SEQ ID NO: 537 - DNA, 967 bp, Homo sapiens
  misc_feature 5, 10, 19, 20, 22, 23, 24, 39, 45, 52, 58, 68, 69, 81, 91,94, 95, 99, 105, 123, 136, 138, 139, 140, 141, 146, 155,163, 167, 168, 171, 176, 189, 199, 200, 225, 228, 230, 231,232, 240, 249, 251, 265, 273, 274, 280, 282, 283, 284: n = A,T,C or G
  misc_feature 287, 298, 301, 305, 308, 319, 320, 321, 328, 335, 336, 350,356, 358, 359, 361, 362, 365, 372, 393, 394, 408, 411, 412,413, 424, 425, 430, 440, 452, 454, 457, 458, 460, 467, 469,474, 479, 482, 484, 485, 492, 507, 509, 519, 520, 522: n = A,T,C or G
  misc_feature 525, 537, 540, 547, 554, 556, 559, 561, 563, 564, 575, 581,584, 586, 588, 595, 596, 599, 602, 606, 609, 610, 613, 618,620, 624, 635, 643, 648, 652, 657, 659, 665, 669, 670, 671,678, 685, 699, 701, 704, 707, 714, 715, 719, 723, 724: n = A,T,C or G
  misc_feature 726, 728, 731, 734, 736, 741, 745, 746, 752, 753, 756, 764,765, 771, 782, 788, 790, 792, 795, 800, 804, 811, 813, 814,819, 828, 833, 834, 841, 842, 843, 850, 851, 866, 871, 878,882, 883, 886, 887, 891, 895, 899, 902, 910, 911, 917: n = A,T,C or G
  misc_feature 919, 927, 934, 935, 937, 941, 951, 952, 953, 957, 965, 966,967: n = A,T,C or G
agtanggcgnttcctaatnnannnggctaagcgactttnaaagangaggctngcgtgntgaataccgnncgaggggggatnacaatagtanacnnggtnccaatncatgcttaacaccgcatntctttaccccccnannnncacanatgcagacncacacatngcanncgnacacncagacacacacangcaagcactnncatgcatggcccatgctcacacacntgnannnaacatgcngtagacatntnagacacgtcatgtnacacatgnnacacangnnnaanacactgctttncangcanacncagacggcacnnngagacanacatgcnnaaacaacatgctcnctcacntnnanncgntgggccngtagtagtgtactgtgggtgnnactgggtgccatcnacnnngtattttacgnnctttnaactaaaaancttggagccttnanttnntntggtgantncaatncctanaantnncttgagngggatgaaccctaanancctggccctnntnccnctttcaaggccnagnaattganattattncntantngnncacgaagcttntggtancangngncccgagnnctnttnaaanttnnctnttttnanaatnaaacattttancggttctnagganccgngcctncngggtanggannnaattgtncctgggnatagttctcacaantnatnttnaaggggnnaagngatnngngnggnccntntatgnggcnngccaannaanggggtcgnngttaanatattccaagntaacanangnacnatggnaccnatccctntnngaagnaaggaactncctgnncgactannnactatgnnaaatattctcacatntacanaaaaagnaggnnccnnggtncttnaagnttntgcatagnnactatncntgggacgngttaacnnanattntatgctttannngatnggggcttnnn

SEQ ID NO: 538 - DNA, 892 bp, Homo sapiens
  misc_feature 8, 25, 27, 28, 30, 44, 45, 46, 47, 52, 54, 57, 109, 114,115, 119, 155, 180, 207, 219, 231, 304, 308, 310, 318, 374,379, 396, 397, 402, 411, 413, 433, 441, 442, 447, 448, 452,456, 475, 479, 483, 486, 491, 493, 494, 500, 501, 505: n = A,T,C or G
  misc_feature 507, 513, 515, 517, 521, 525, 530, 531, 532, 544, 545, 551,553, 556, 557, 558, 562, 563, 566, 567, 568, 576, 584, 585,587, 588, 590, 592, 595, 597, 598, 599, 600, 601, 602, 604,606, 609, 610, 612, 614, 615, 616, 617, 622, 632, 633: n = A,T,C or G
  misc_feature 638, 641, 644, 646, 649, 662, 668, 669, 671, 675, 677, 678,688, 697, 698, 701, 703, 704, 706, 708, 712, 713, 714, 722,726, 737, 741, 743, 745, 757, 768, 773, 774, 776, 786, 789,797, 799, 802, 816, 820, 823, 824, 830, 836, 843, 847: n = A,T,C or G
  misc_feature 848, 851, 852, 854, 856, 863, 868, 871, 873, 874, 878, 886,890: n = A,T,C or G
gctagttngaagaggtgtttctaangnntnggaatcgacatctnnnnaggcngnccntgcgattcgctttgctctctccattccaagttgttctctgttctagaaagcngatgnngggntacatctactgtttttgcctaaacagaatccctttntcctttttttgttaaaaggctcatncctaatattacattgctctggaacgantgacaataccanaactcagcaccntgatcggaccgggacaatcagattatctaattcctcagcaaacggagatcgatccgaaaagtggaaatatganctcntnctttgtgntggcatatggaccctgagagaaagaaactttaatcttttactcttggactgcaatnaagtntagctgcctaaaaatcnntttcntgacacttngnaggtttgtccacaatcgggngaaattanngggtnngacntaancactggatgaaaaaaaatnccgnttanttntattncnnttccanncttntnaaatananantttntcanccttnnntaatactattanntatatntnttnnncccnnatnnnccttcttnctcctacnncnntncnatntnnnnnnangntcnncnannnnttctnttatttctannatatntcntancnttnactaaaacctccnctcgtnnanattncnntataatattntctctagannttntnntntnttgnnncttaaaanctcntctatccctantatnantnattcttaccatnaaatacactanaagtnntntcacgagacncgntatgttantncanactataatcgcttncatntanntatatntaaaantgctatncagnnagnngntnttatatntttanctngnnaggntatcctcnatancc

SEQ ID NO: 539 - DNA, 751 bp, Homo sapiens
  misc_feature 2, 3, 4, 10, 15, 28, 32, 485, 647, 651, 654, 669, 693, 750: n = A,T,C or G
gnnnaggttntagancagctcttgttcnttgngcaggatccctcgattcgaattcggcacgagagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgntatttacaaaatctagcagactgtgggtatccatattttaattgtcgggtgacacatgttcttggtaactaaactcaaatatgtcttttctcatatatgttgctgatggttttaataaatgtcaaagttctcctgttaaaaaaaaaaaaaaaaaaactcgancctntanactatagtgagtccntattacgtagatccagacatgatnagatcattgatgaatttggaccaacccaactagaatgcagtgaaaaaaatgcttttnt

SEQ ID NO: 540 - DNA, 761 bp, Homo sapiens
  misc_feature 2, 4, 7, 10, 14, 565, 620, 651, 655, 660, 677, 679, 690,700, 703, 716, 729, 733, 751: n = A,T,C or G
gntnggntcnagancagctacttgttcttttgcaggatccctcgattcgaattcggcacgagcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaactacccaagtnagatttactggattaaatggcccttcgggtctgaaaaagcttttttaacttcttngcttaaaatgccgtttaattttgataagatncttnaaatngcctccaaaagtgttananccaatcatttnaaataaaccnggntgtatattgcatnatgtgtacatgcntatncccttctggttaaaactnaaaaaaaaat

SEQ ID NO: 541 - DNA, 748 bp, Homo sapiens
  misc_feature 7, 17, 19, 21, 156, 372, 453, 505, 555, 613, 649, 654, 656,666, 687, 727: n = A,T,C or G
ggtttantttaaatccntncncagctacttgttctttttgcaggatcccatcgattcgaattcggcacgagcggacccatcggagcgtaacctggatctccgcaggcctggcggaggccggccacctggaggggcattgcttggttcgcgtggtancagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcangtagcaatcgacctcaggaaatagaaattggagaatctggttttgctttattattcccttcaaattgaaggaataaaaatncaaccctttcattttattaaggatccaaagaatttaacattagaaagacatnaacttactgaagtaggtcttttagataccctgaacttcgtgtggtcttgnctttggttataattgctgtaaggtgggagccagtaattatctgcagcaagtagtcacncttttcagtgatatgaatatcatctttggcttggangccantngacaacctgncattactgactttttgaaaanaaccctctggatattgatgcctcgggtgtggttggactgncatttagtggaccccgaatcc

SEQ ID NO: 542 - DNA, 784 bp, Homo sapiens
  misc_feature 3, 4, 5, 6, 7, 9, 69, 86, 110, 114, 122, 132, 134, 136, 139,141, 156, 157, 163, 164, 177, 178, 185, 192, 194, 198, 200,214, 245, 247, 252, 256, 268, 274, 279, 280, 286, 292, 295,307, 309, 315, 319, 320, 322, 328, 334, 374, 384: n = A,T,C or G
  misc_feature 400, 408, 409, 411, 423, 424, 426, 427, 449, 451, 461, 463,468, 474, 475, 496, 518, 528, 536, 543, 545, 555, 564, 606,613, 619, 633, 641, 650, 657, 674, 729, 734, 741, 747, 753,762: n = A,T,C or G
gtnnnnntngtgtaatcgcttggctgcaggatccctcgatggcgaattcggcacgaggtgttgctcaangagcagacccgactccntaaggtcatcattgaatgggcatnatangtttgaanactgtccaananantangngtcaatacatcaacnnctttanntgcttgatattgnnattgaanaacacangnctcngnctagttcgcctganatgatgtttaagatactccggaaggagacanantgttntgantgcggattaganaccacngaagnnacactnaaggancancatctccacctngnaactgnattnncngaccanaaaagngaactggaccaaatgctctcaaaggtgctggcagcttaanagcgtgttangactctgcacgaagangacaggtnntntgagagcctggnnannacactctcccaaactaaactgnanctttcaacananggganccccannttggtggagaaatcaggtganctgttggcccttccacaaagangcaaattctntgagggcnagacttnancctttttgcngaaccagtncttgactgactaaatgaaagctttttaagccaggtggcccanccttaangaagcnactttttaatccancggaaccngcttgaganaaaaccntttttgacccaaaaccnggagaaccagctggcctaccaaagggaaatgggcccccatttgaacttggggttncccangaacaanccttgnccgggncaaagcccnttgttggaaaggacctcaacct

SEQ ID NO: 543 - DNA, 764 bp, Homo sapiens
  misc_feature 1, 4, 28, 52, 101, 102, 114, 119, 125, 126, 138, 139, 142,156, 169, 172, 179, 180, 194, 195, 197, 200, 202, 206, 209,219, 234, 235, 237, 238, 245, 251, 258, 261, 263, 267, 272,277, 297, 309, 336, 357, 382, 391, 396, 406, 442, 443: n = A,T,C or G
  misc_feature 462, 472, 476, 512, 513, 540, 553, 554, 576, 580, 623, 630,637, 650, 663, 667, 673, 674, 700, 703, 709, 710, 718, 720,725, 750, 754, 758, 762: n = A,T,C or G
ntantaaatcccttgctcttgttctttntgcaggatcccatcgattcgaatncggcacgaggacccggcggcgcggacaggcttgctgcttcctcctcctnngactcaccattncagancagaanntgaaaaaatggnnganctcacccaggtaanggatgatgaagtnttnatggctnntgcatactatgcannanttntncttntgnaaatgatgcntatgagtactgtaanngnnttctatncattgncaagaanggntnttgncaatncatangactgtgtagcattcggcanaggagaaaatgncaagaactatcttcgaacagatgacanagtgtaacgggtacgcagagnccacctgaatgaccttgaaaatatnattccattncttgnaattggcatnctgtattccttgagtggtcccgacccctctacagcnntcctgtactttagactatntgtcggagcncggntctaccacaccatgtgcatatttgacacccctttcnnatccaaatatagctatgactttttttngtaggatatggannactctttccatggcttacacgntgcngtaaagtaaattggccctgtgcagaaaaacattccactcagtnttccaantggcttnttaaggaattctngaccttgcaattnatantggagnnctttccttaagatttaaaggtttganggngagccnnaggaattntnaaccnggggtaaaccctttttggaattttnagcnttgncaanaa

SEQ ID NO: 544 - DNA, 755 bp, Homo sapiens
  misc_feature 9, 11, 13, 14, 22, 23, 340, 460, 465, 600, 608, 623, 665,676, 733, 741, 743, 750, 753, 754, 755: n = A,T,C or G
gatgctggntncnnatgcttgnngatccctcgattcgaattcggcacgaggaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtattacattttttatttttcaaattggatgataatttcttggaaacattttttatgttttagtaaacagtatttttttgntgtttcaaactgaagtttactgagagatccatcaaattgaacaatctgttgtaatttaaaattttggccacttttttcagattttacatcattcttgctgaacttcaacttgaaattgtnttttnttttctttttggatgtgaaggtgaacattcctgatttttgctgatgtgaaaaagccttggtattttacattttgaaaattcaaagaagcttaatataaaaggttgcattctctcaggaaaaagccatcttcttgnatatgtcntaaatgtatttttgncctcatataccggaaagttcttaattggattttaccagctgnaatgctttganggttttaaaaataataacatttttaataattttttaaaaggacaaactttcataatnatcccggngntcctttnccnnn

SEQ ID NO: 545 - DNA, 767 bp, Homo sapiens
  misc_feature 3, 8, 22, 27, 32, 37, 73, 92, 93, 95, 108, 156, 157, 225,263, 266, 326, 330, 350, 372, 386, 395, 398, 422, 465, 468,476, 485, 489, 503, 505, 513, 527, 528, 536, 546, 548, 550,553, 554, 561, 562, 564, 565, 569, 578, 587, 588, 591: n = A,T,C or G
  misc_feature 602, 603, 608, 645, 660, 674, 687, 688, 692, 696, 709, 715,721, 740, 762, 766, 767: n = A,T,C or G
agnttttnaatcctttggccantcgcnctttntgcangatcccatcgattcgaattcggcacgagaaaaagtnaagcttttcatgagcacanntnccttgcattgttngatgttactgatattcgtaaaatgaatattttctgttttgttctgttnnatttttttgagacaagtcttgctttgttgcccaggctggagtgcaatggcatgatcttggctcactgnaacccctgccttgcgagttcaagtgattcttctgcctnagnctcctgagtagctgggattacaggcgctcaccaccacacccagctaatttctgtcttttnagtngacacagggttttaccatgntggccaggctggtctcaaactnctgacctgaaactnctcacaccngtnatctcagcactttgggaggctgangtggaaaggatcacttgaagccatgagtttgagaccagcctgngcnacacagcngagaccccngtgntgtacaaaagcttncnacatttanctggctgaggagtnnctcacccntaacttccancnantcnnttaagcnnanncatnttgaacacntgagcccanntanggtcgatgctnntagtnaaccgtgactggaccacttacagtccaagcccgggtngccttataaaagaancggaaaacatttcnttaattcgggttnnagcnttanctatttcggaatnccttgngttttnaaaaacttgaatctccaanaaacagggttttttcttttggnccann

SEQ ID NO: 546 - DNA, 989 bp, Homo sapiens
  misc_feature 2, 15, 30, 32, 35, 43, 47, 49, 103, 105, 246, 253, 256, 267,276, 282, 287, 288, 290, 292, 297, 300, 301, 304, 306, 307,315, 317, 328, 338, 340, 342, 345, 347, 356, 364, 366, 368,375, 376, 379, 380, 381, 382, 384, 392, 394, 397: n = A,T,C or G
  misc_feature 400, 401, 403, 408, 422, 423, 425, 427, 428, 431, 432, 436,443, 447, 465, 470, 471, 479, 484, 497, 502, 511, 519, 521,524, 533, 541, 546, 551, 562, 569, 572, 579, 580, 583, 588,597, 604, 606, 607, 609, 611, 613, 615, 618, 620, 625: n = A,T,C or G
  misc_feature 629, 635, 636, 637, 640, 643, 644, 645, 646, 651, 654, 655,657, 658, 668, 669, 678, 683, 689, 690, 691, 693, 697, 699,704, 713, 714, 717, 720, 732, 733, 741, 743, 744, 745, 747,748, 749, 756, 757, 759, 760, 761, 762, 765, 767, 769: n = A,T,C or G
  misc_feature 779, 780, 781, 783, 786, 790, 792, 796, 805, 808, 810, 812,815, 820, 833, 839, 840, 841, 844, 847, 851, 853, 854, 860,865, 869, 874, 884, 886, 887, 888, 892, 893, 900, 905, 907,915, 916, 920, 924, 927, 930, 931, 935, 940, 943, 946: n = A,T,C or G
  misc_feature 949, 952, 959, 960, 964, 966, 969, 978, 979, 984, 985, 987: n = A,T,C or G
tncccttgttgaaanccctttgctcctttntnctnccgtttgncatncnattcgctcagctgaggcaattaaactggaaaagaaatagattgaaaagatactntngaagaagcagtacagaagttgggggactgaaggagagggagccactgcaggtgctagctgcttaaggggataccagtccttttacagatataatagatacagcttctgaggtggagggtgataggagtgtgtatgagaaanttgcagnttnacaactgctcntgcctcctnggcaanaggannancntttcnccnnttncnncccttatngnacacacattgncctgattggncntnccncngctagcttncagtcttnantntactcannagnnnntnggggaacncnctntcnnantatgntcccttttcctctnncntnnccnnatancaccccnctcnctttcctttctaaacttncacanntccctganaatgncttccgaatggantcttngaatttctncgcccctncntcntcataatcnttttgctnctccngctcnccctcattttnctacgtnccnccttctnnttnactgnctttaaatnttattancnncntntncnttncnatctncaanttttcnnnccnacnnnnttttnctnntnncaaatcgcgnnaaataagtnttgcncactcnnntnctancntattntccctcgcnnttntcntcatctcccgcnncactcacntnnncnnntcaattnntnnnnacncncnctgctctacnnncnatntctntncctncacaccctntancntntcnctcanaatgccttttctnccttannnctntcnttcncnnatctanccaantttnctttnacatcccctncnnntctnncccgacnatatntnacctcttnnatcncagngcntannatcnccccnttntcnctntcnctctcanncttntnttnatcttcatnnatcanncncc

SEQ ID NO: 547 - DNA, 781 bp, Homo sapiens
  misc_feature 4, 5, 10, 12, 13, 18, 19, 28, 34, 75, 81, 95, 96, 105, 111,152, 179, 182, 196, 204, 205, 206, 213, 223, 263, 265, 272,281, 293, 296, 302, 319, 327, 333, 344, 375, 413, 426, 434,438, 442, 447, 462, 479, 481, 485, 496, 498, 501, 516: n = A,T,C or G
  misc_feature 531, 533, 538, 543, 544, 550, 569, 573, 579, 590, 596, 598,599, 608, 612, 619, 629, 642, 646, 667, 671, 673, 674, 675,679, 690, 691, 692, 699, 716, 745, 751, 761, 767, 768, 772,775, 781: n = A,T,C or G
tgtnnctttncnncctcnnccgaaatcnctttgnttctaactttcctaattacctgggctacttgcactatcccntcgatncgcatagatggccnngttactaanggtgantttccagcgcggggggcacgtggagtcactggaacatttgngcaatgctggtgggaatgtcaacccgngcnggcctctggaatangcctggcnnntcctgcnagagttaccntgtgacccagcaattccactcctagctccacccacaggantngaaagcnaagacgcanacagatgcctgngcnccaaanttcacggcagcatcctncgccatantggcancatccgtcgtnacagcggcatcatccttcatcattacggcancatccgtcgtaacagcggctacatcacttcgccacagnggcagcatctgtngtcacagnggcngcanccttngccaaagcggcagcntccttcgtcatagcggnancatnctttgccatancngcnaggtggaaaccctgnccatccactgaggcntncatanactanncatggncagtccagggcactggaanccangccgtngaacggcgccnacggtnannaggaatganaccntgatgcnctggggccanacatactggctanacanacttggagacatcatgcttanttgnannnccantcacacttgcnnncggcgtnatcctgctcacgtgatncgacccgaatgggcacttcaaatgggaanaagggngatggcactnccggtnncctnganaggggn

SEQ ID NO: 548 - DNA, 735 bp, Homo sapiens
  misc_feature 14, 15, 28, 31, 33, 35, 38, 39, 44, 46, 576, 687, 691, 693,717, 734: n = A,T,C or G
tctaaacgcttggnncttgctctttctncangnanccnntgcgntncgaattcggcacgatctagatattgcccaatcgctgcccacagtgcacatacctttccaccagtcacatgtgagagggcagattttccaaatgctcatcaccacttggcactgtgtggactataattttggccagttaggaaatggcatctcattgttttcatcttaatttgcgtcagcctgattactcattgaaacttgtgaggttgagaaacttttcttaagcttattggccattcaagtttcctcctttatgaaatggttgttcatgtcatttgctcatttttatattagattgtttttcttttttccagctgacttgtaggaactctacatcttatcaatattaatcatttatcgaaaactatttgggtgccattatcttctcctagtcaatgttttttgtttgtgatatcttttataatatataagtttttaatgttggcagaagtaaagttaatctttttggctgtgttgtgtgtcttgtttgatgtaaagatagtttctgtaatagttttgcagtttgattgntcatctttaggtcttcaattcaacctgcacatccatcccctctatcctctttcttactctgtttttctccataccacttatcatccaataatatggtcatgccctttattnaccngntttgcatatataatttggcttgtncccggttccttccctana

SEQ ID NO: 549 - DNA, 812 bp, Homo sapiens
  misc_feature 18, 27, 154, 198, 202, 279, 318, 362, 379, 431, 456, 490,496, 507, 516, 518, 531, 552, 565, 590, 601, 604, 608, 627,676, 691, 695, 736, 744, 767, 778: n = A,T,C or G
ttctaatacttggctctngttctttcngcaggatcccatcgattcgaattcggcacgaggggaaggagcgggcgtgaggccagctgaggcatggtgacccctgggaaggagcgggcgtgaggccagctgaggcatggcgacccctgggaaggancgggcgtgaggccagcttgaggcatggtgacccctgggaaggancggncgtgaggccagctgaggcatggtgacccctgggtacgggggacttgggggccgaccttggtttgcccagggcccctnctgcaccacggccacatgcggaggacggcgttgggatangctccctgggtccacagcttctgcccgtgtattggggaaccctncttggtcaaggcttcangctcttggcagatggggcaaggaaccctgaggcttccgcgcccttccatggnctctgatgtgggacacttgaacgangcacgattctgaaggactccatggatcttgggangattangcccaccttcngttggtggncnaaagccgtccttncggggcccggcttgtttaacnggacaacttttcnggtcgggcttgttgggccccaatcnttgggttgggnaanttcnccttaaaccttgggcccgnccttttaaccttttttcccaatcttttgacctttttccaaaaaggggtncccctgggctttttngggncaattggttccgggggccaaaggttgggaaaaaatgccttncattgggnaaaaccctggatcccttgttaancctttgggagnttaaaatggaatgaattttccccccgggcttttt

SEQ ID NO: 550 - DNA, 742 bp, Homo sapiens
  misc_feature 3, 4, 6, 9, 27, 41, 108, 152, 166, 181, 183, 188, 202, 240,253, 341, 363, 402, 437, 615, 631, 645, 650, 669, 694, 718: n = A,T,C or G
ggnnantcnatgctggtcttgtctctntctaaaagttggcnattcgaattcggcacgaggttctgtggctggcatggtctgcctgctactggagagatctcctgaganttcagttttggattggtgctgtcatcttcctgggaatgcttganaaagctgtcttctntgcggaatttcagantntccgntccaaaggagaatntgtccagggtgctttgatccttgcaaagctgctttcancagtgaaacgctnactggctcgaaccctggcatcatagtcagtctgggatatggcatcgtcaagccacgccttggagtcactcttcataaggttgtagtancaggagccctctatcttttgtnctctgcatggaaggggtcctcagagtactgggtattttncttatcccttgactctgatagtaaacctggccctntcagcagtttgacgcctgggtatttatggatattaattagcctgactcaaacaatgaagcttttaaaacttcggaggaacattgtaaaactctctttgtatcggcatttcaccaacacgcttatttggcagtggcagcatccattgggttaatcatctggacaacccatgaagtcaanaatagtgacatgtcantcggactggccggnagctnttgggtagaccatgccatntggcgccttgctggtcttccatgancccctttggcaatcatgggtcttntggcgaaccattttgcaaacaact

SEQ ID NO: 551 - DNA, 736 bp, Homo sapiens
  misc_feature 33, 98, 100, 123, 125, 150, 165, 175, 187, 193, 201, 209,232, 241, 243, 270, 346, 588, 594, 608: n = A,T,C or G
agtctaatgctggtcttgtcttttctaatgctnggcgattcgtcctggtgtcaaacactataaacctttgaccagctgagctgtgactggctgtcacntntctgagtcctgtgtgcacagtantntcctgggtcaggtaaaatccaggtnttcaagttttaaggnttttttgaanaattcgggcttntttaanacgatccntgcccaantccacaagcttgttgacagtggnttacagttngngtggcaaagtccaagttgttacactgngctttaaaaaaaatcttatctgcatgtattgttaacttagagaccatgagatctatttatcaggaccaggaagatncacacttcaggtccattgcaactgacttttttcttgtttttcttaaaaccctggtggagcctgggaagggggcctccacaattctgtggctttgatattagccccaattttacaagcacatacaagccccataattgccgcaggaaaacacaagatggaaaatgcaataacccatgcactgagacttagaaaatcatccttactaggcaaaatgtattatgatgcaataagtgccactgggnattttnacgttgggactggncaggaactgctgcaaagaaaaataacagctccttctccattatttacatttaagatgttggtggggggaaggttgggagaaattagttctgagggtatcatatgccttttttaaagaaaatgggaata

SEQ ID NO: 552 - DNA, 733 bp, Homo sapiens
  misc_feature 1, 9, 10, 103, 105, 123, 131, 202, 217, 219, 228, 235, 240,281, 300, 333, 451, 482, 485, 500, 523, 652, 657, 659, 668,672, 680, 714, 719: n = A,T,C or G
nagtttaanngtatgtcttgtcttttccaagatcctatccgattcgaattcggcacgagaagtgtcagttttcctaatctcagtccaggtaggatttaaaaantntctcaagtgttgatgctntccaagcntgttggggtggaagggaattggtgcccagaaaatgggactggagtgaggaatatcttttcttttgagagtncccccagttaatttntnctgtgcttnattgctnctgtnctttattgtgaatgttgtaacattttaaaaatgttttgccntagctttttaggacttggngttaaaggagccagtggtctctctgggtgggtnctataatgagttattgtgacccacagcttgtgtgggaccacatcacttgttaataacacaacctttaaagtaacccatcttccaggggggttccttcatgttgccactcctttttaanggacaaactcaggcaaggagcatgttttttngtnatttacaaaatctancagactgtgggtatccatatttnaattgtcgggtgacacatgttcttggtaactaaactcaaatatgtctttctcatatatgtgctgatggttttaataaatgtcaaagttctcctgttaaaaaaaaaaaaaaaaaaaactcgagcctttanaactntntgagtcgtntacntagatccngacatgataagatcatgatgagtttggacaaccncactngaagcagtgaaaaa

SEQ ID NO: 553 - DNA, 870 bp, Homo sapiens
  misc_feature 1, 8, 34, 37, 98, 100, 102, 105, 113, 125, 135, 139, 145,147, 151, 161, 169, 173, 180, 186, 192, 201, 206, 208, 212,224, 245, 263, 266, 274, 298, 324, 349, 405, 417, 502, 519,537, 559, 573, 589, 613, 685, 702, 711, 729, 764, 770: n = A,T,C or G
  misc_feature 786, 791, 803, 816, 819, 822, 836, 846, 849, 862, 869: n = A,T,C or G
nagttaanagtaggtcttgtcttttgcaagatcntancgattcgaattcggcacgagtatataacaacttttgctttcaaagttgggtgggactagancncncantggaaggntggagtcagganacctggattnttgngcccgntntggnttttacagtntgcctaantttntgcagtnacttcntgccancctgtttcnttacntncaanagggaaagacantccttggccagcctagttttnagggtgaacgaaaggtcnttntcactgcntcctctagtcatttgcttcttcgntaattaacacatcttgagcacctgcnatgttccaggaacaggagatggcancgtgcaagataaagtccctgacttctagagactgcatgttagtggcaatcggcgtntacccggccttnaataaactactgaatgaaggaaaattctacctacaccagacacaattactggggtttctaaaatggaattattcccccggccccntgcatccagcagcctgntgcagggaaactcctccnaaaggcttgtaaggcaaggaanccgggacaatggcntggctatttaagcttncaacaagatggttacccctaagtncctaattccctaacaccaagggggccctttaccaggaaaccaaaaccaggttaaaaaaccccaaagttgggnaaaaagccatttgccanccggggccnttttaaaaaaaacctttnaaaaacctttcccttttaaaactttaccttcaagntaaaantttaaggggaatgggnccaanttttttaaccanccccaaaaaaaanttnggnaattttttttcccnaaattttttnaanttccccaaatttnggaaaang

SEQ ID NO: 554 - DNA, 766 bp, Homo sapiens
  misc_feature 9, 15, 22, 32, 37, 41, 73, 156, 183, 308, 326, 364, 383,384, 385, 390, 394, 395, 403, 405, 407, 409, 411, 412, 413,416, 428, 433, 436, 438, 441, 461, 465, 479, 484, 488, 491,493, 494, 500, 509, 521, 529, 534, 536, 547, 558, 572: n = A,T,C or G
  misc_feature 579, 593, 616, 634, 656, 669, 678, 688, 692, 702, 721, 727,733, 740, 744, 745, 747, 750, 752, 762, 765, 766: n = A,T,C or G
tatcaatgntatgtntggtctnttcgaaaganctagncggntcgaattcggcacgagccaacacccagttctnactctgtcatccaggctggtgtgcagtggtgcaatgtgggcttactgcagccttgacctccaggacaagtgatctcccacctnagcctccggaatagctgggactacagntcaacaacgcccctctgaaagtaggactcttggaaatgaaccttgttgggagtaaagctgaaccttcacctctcctttccaggattctactccattcatacggcctcacactgaattaatgtttntagcagccacatcacttngttacccaattgatctagtagtaaagtcttcccatctnttcatgtaaaaaaaaaaannnaaaangggnnaggaaccntnangntnnnaanaaaaaaaaaaancaggnggngngcnttttttaacctataacctgntttnaggcctttccccangtttntccnaancnnggttantaggggccnaaagctaaccgnatttttgntcccntnaggttaggccngaaattaaccngggtttaaagaacncattgantaaagccttgcctnggccaattccgggaaaagggaanagcctccttgttttacanattgggaaaaattggccccaangggggttaaccangtttgcccnttaataactnaaanggatttttgncaaaacctggttccaaggntttaancccaanccttttnaaanntnggncnctttggatgnaann

SEQ ID NO: 555 - DNA, 770 bp, Homo sapiens
  misc_feature 8, 12, 17, 21, 23, 24, 25, 26, 28, 33, 35, 37, 44, 46, 85,110, 113, 140, 144, 222, 226, 256, 305, 326, 371, 468, 530,543, 585, 586, 588, 612, 631, 654, 656, 701, 711, 727, 728,729, 730, 742, 743, 747, 759, 763: n = A,T,C or G
gttatccnatgngcgtntgtngnnnncnctaanananttggctngncgctgggccttgcttctctgagaaaactttggtcacacntccaaagccagggtgggtgcctccntgnaggagggggctttcctggttggtggcncagnaggagtccaggctttgtaccgtggacaccatgggctatggcaacaccttcctaaccatccttccatgaggacctcggnaganagtggacatgaaaccctttgtgctctgaancattcaacagaagctttctggttctgtgcctatttctttggcacttgancgtgtttgcaggttcattacncacatgatgaaagctctggcccatagcactagaattcatgttttnagggtttgtgagtgtgacaggtgctatggtttggatgtggtttgtttccaccaaaactcttgcttgaagtttaactgccagcatggcaattgttggnaggtggggcctaccgggaggtgattgggtcatgggggcttgaaccctccggaatagattacngctgcctcctganaaagttctacctgtcatgggggctggatcagtcaacattgannantggggttgttataaagcaagactnactccttatgcaccgtttntttgcatatgcccctctgggggnancttctttggctgctaacatttttggacccaacccaatgggccttnacccagaaanccggaacaaaatgccnnnngccattcctttnngganctttccaacttnccanaaataat

SEQ ID NO: 556 - DNA, 756 bp, Homo sapiens
  misc_feature 3, 7, 12, 24, 25, 34, 40, 41, 112, 115, 120, 126, 143, 156,165, 167, 174, 177, 187, 194, 201, 207, 216, 220, 245, 259,272, 520, 621, 638, 690, 714, 754: n = A,T,C or G
gtngtcnatganatgtcttgcctnncgaagaacnaggcgnntcggtagaacagaaaatgagcatccgatttcttcactaaaggagaccaaactggttccttgcggcctagtnttnaaganctggancttgaaagtcctccttntaccaactccacntccaccccntnattcccnttntcccaaagtnctactgntgttgcntgacanccccaaatntgtnctgtcaacacaaacctgcctttggngtataaacagggcnttacagaatggtncaccctatatatttctgttcagtatccattcactagttcttcattaataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatccttttaatatgtcctttgcttcctacttccctgncttccaacatactgtcacttactctggcagtcttctgcttttcattaagcctcaaaatctcctctgtctacttggcaccacaagctatgtcctatatatgnatttctggacttggcanggatagttcaaggggtcttggcaagtttttatttaccttcattatttaaaangggccttttggggatgttggcctntttaaggagcctttttggggaaatcaatacttctcttaanaa

SEQ ID NO: 557 - DNA, 742 bp, Homo sapiens
  misc_feature 6, 10, 11, 12, 43, 84, 86, 90, 101, 104, 110, 117, 126, 147,164, 175, 178, 186, 201, 206, 226, 237, 256, 261, 263, 298,305, 335, 364, 486, 551, 675, 692, 694, 716, 717, 718, 732,738, 741: n = A,T,C or G
tcgtcnaaannnatgtcctggctatccgcaggatccaggcggntcgaattcggcacgagtgatttttttggtttttttttttgntnttgncaaaagcttantcntttcanttaaaantgccactantttgactttttaagtaaaaantgtagggggttttaaanctactttcctnctnccaaaaantcagaaagtttctanctttntaaattgggaaagcaagcantgttttaaaancactgaaggaatctctttnttcgngnccttttgttaaactcggtttaagctgtagaccttntttaaantaaaatttaccacagaacaggaaatagaanctgtggaagactcgaaatacacctttgtncttctctgttcttcacctgctctctcgctgtctctacacacacacacacaaacacacacacacctatatttgcattaaaaatgggtagtaaaagcagtgaagggcaaacagaaggtccattncatcaagtaagaggttgaatataaactggaccaagtcttaattttttatttccttcattcggatncgtttactaatttctttgctagctttaagacttttaaaacattctttggccctgggagggagttgtttacccctaaacttggagaatcctggccctagaataaatgttccttttaaacccccanggccggaaaattgaatncngctgtgccaaaaaggaaaaaannnaaaaaaaaactcgnggcctntana

SEQ ID NO: 558 - DNA, 730 bp, Homo sapiens
  misc_feature 6, 7, 12, 14, 15, 19, 23, 35, 39, 44, 75, 79, 89, 97, 158,218, 251, 272, 282, 351, 420, 431, 434, 499, 529, 582, 615,623, 625, 631, 667, 677, 693, 700, 702: n = A,T,C or G
gggtcnntaatntnnagcntgtnaaacccctgagncttncgggncgttcacaaagaaacatttaatagggacttncaancaaataattntcggtttntcaggtggcagcaagacaagatggtggatccccatgccattacctgctagactcagggttnatatactgtagtggaaaggtgattccgaaggaatgttgtaagacaattgaagtgcagtancatcaaagttatttgacctaagggcaggagttncagtaagtatccacttttatncaagaaacantagataaactggaaatcttggagcccttcctggaactggggttaatgagaagtcaacatggtggattancatggaagatggagttgcttagtctcccattcaagatggagtttctttagcctccattgatagggagtntttaacaaaancangaaataagtctttgatccattgaatctctaagagtgagcccttgatgactcaggtttaaacagtnctgagacaatttaggagatagttttgaagntcaatttgaattgtaaaaggtcaggattttttaactttttcacatctttgaanaaaagcccatagagcgcaagttttcagcaaganctggaaancnatattnctatggaattaaatagctcctcagggcaatcaattnggcctggganaacataatgcttcaanggctgangnaatctggaatttctatgggatttcttca

SEQ ID NO: 559 - DNA, 743 bp, Homo sapiens
  misc_feature 13, 16, 17, 19, 28, 39, 40, 48, 52, 98, 492, 546, 736, 739: n = A,T,C or G
gttagtctataangtnngntatgtactngccctttccgnnggatcccntcgnttcgaattcggcacgagaggaaacacccccttataaaaccatcatntcaggctgggtgatctgacagagctagacactgtcaaacaaacaaacaaacaaacaaaaaaaccccatcacatctcatgagacttatttactatcatgagagcagctcaggaaacacccactcccgtgattcagttacatcccactgggtctgtcccacaaattgtgggagctacaattcaagatgaggtttgggtggggacacagccaaaccctatcaccatgtaaaataatatctaatttgtagagattaaagaacaagataacttaaatcttggatgtaagttaagagagtggtggtcagagttaaatcattttaaggttcatttattgtctggacaagaataaaattttgattatcaggaaatacaagtaaaaccacagggagacattgnttatatccaaattgtcaaaaattacaaagtcttataataccaagttttgctganggtgtggagcaacagaaacttttgttcactggtgggtatataaattgaataatttcagcttggacattacctagcaaaattgaaggctgtatacgtacatacctaccaatctagcaattcacttctagatattaagtcttgaaaaactcacatgtttccagagacgtgttaaaaggtggttaaatcattntgngaat

SEQ ID NO: 560 - DNA, 833 bp, Homo sapiens
  misc_feature 5, 11, 14, 15, 16, 17, 22, 32, 40, 41, 42, 187, 226, 279,615, 635, 640, 666, 667, 673, 676, 692, 695, 720, 733, 762,769, 770, 772, 773, 774, 775, 776, 777, 778, 779, 780, 781,783, 784, 785, 786, 787, 788, 789, 790, 791, 792, 793: n = A,T,C or G
  misc_feature 807, 822, 826, 828, 830, 833: n = A,T,C or G
atccngttctntannnngtctngttctttctncacgatcnnntgcgattcgaattcggcacgaggggtcctggtgggagttccatccagcagtgagtgcattttttccccagagcagttaagggtcttattaaaagccaccactttgctgaggcctgtacaggccttgggggtttggggaagagaantaaggcaggcacttgtcccttcagggagggacttgtccntactgggaggtttggggttgaccttggctccagcagagatacccagcctggcntggaagggcaggtcttgagcttacgcttgactgcaagggcaagctgcaggcctcttctgccttcccctgcattcaccaaggacaagtaggaccaagaagtcaagggaaaagtgccaagatagatctattcccatttctttcttccacctggagaattcctgagctatgcttcaaacctcttttgggccagggaaagactgggggacattttttagtcaaggatgctttaagaaagtaaattcctgcttgggggcccaggccttctttttcaagggcttgcttgtgaatgcccaaccaaaaaaaaggggcccccaaggcccaatcccttacttcctnggtccccccaaaaagggatnccaanttggggaattgggaaaacttgggcanncacccnaancccactttggtagganttnaccaacccaaccaacccaaaaccancccacccaaattnaaaaaaaggccaaaaccaccaaccaaccnaaacccnnannnnnnnnnnannnnnnnnnnnaaaaaaactttgangccttttaaaaactntttngngnggn

SEQ ID NO: 561 - DNA, 773 bp, Homo sapiens
  misc_feature 12, 13, 14, 18, 20, 21, 24, 27, 377, 383, 406, 464, 486,561, 570, 636, 650, 687, 758: n = A,T,C or G
tagtctaatgtnnnaaantnngcnctngttctttctgcaggatcccatcgattcgaattcggcacgaggaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaagctggtggcgtggctatggccggatggccattttggcatgttccctgccaactacgttggagctcattgagtgangctganggcacatcttgcccttccctctnaacatggcttccttattgctggaagaagaagcctgggaattgacattcagcactcttncaggaataggacccccagtgangatgaagcctcagggcttccttccggcttggcagactaacctgtcaccccaaatgcagcaatggcctggtgattnccacacatnctttcttgcattcccccgaccttccagacagctttggctcttgcccctgacaggatacttgagccnagcccttgcctgtnggccaaaccctgaattgggccacttgccaaacttgcnggggaaagggttccttgaaacaagggggccatttttggggaaggcttcttggcttggccttttggcatttnaatttggcctttttt

SEQ ID NO: 562 - DNA, 655 bp, Homo sapiens
  misc_feature 1, 2, 6, 14, 16, 17, 21, 23, 28, 30, 33, 36, 44, 48, 49,51, 58, 105, 278, 285, 302, 303, 306, 307, 353, 355, 418,434, 461, 525, 526, 527, 530, 531, 532, 533, 535, 536, 537,542, 543, 545, 546, 548, 549, 550, 551, 553, 558, 559, 561: n = A,T,C or G
  misc_feature 562, 564, 565, 571, 574, 575, 576, 579, 583, 584, 585, 589,590, 592, 593, 594, 595, 597, 599, 600, 601, 602, 606, 610,611, 613, 624, 625, 629, 632, 633, 634, 635, 636, 639, 640,641, 642, 643, 644, 645, 646, 649, 650, 651, 652, 653: n = A,T,C or G
nnatanacattaangnnagangntgagnanttnccntcgctctntgannanaaggcgncgcgaattcggcacgaggccaccggtctcttcctaatctgcacattntattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgtcgnatcttgnggccggtgattttgctnncgnnctgtttcacattcttccccctccacaagccaaatcgttcatttggntncactgtgtggactgtctgagcttgccctgccagaaaaatttggggctaggcacccaggtgcanactttggaagaagcantccacctgtgggtaccgcatctcgtgngtcccactggcaggctgaacctacttgaacatggaaacagcatgcccatatggcaaaggggccnnnacnnnngnnnaaatnnannannnncngacanncnncnnaatcangannntcnacannnatcnnannnnancnnnncaantacnncnaaaacacaccnnccanaannnnnaannnnnnnncannnnnac

SEQ ID NO: 563 - DNA, 738 bp, Homo sapiens
  misc_feature 2, 3, 20, 23, 45, 55, 655: n = A,T,C or G
tnntaatgctggaattcctnatncttgggctactcgttctttctncaggatcccntgcgattcgcagaaaagagtatagtaggggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcaacttgcagaggttgaggagaagatagacccagttccatcaagaacaagcttttgctgacttttatatgttttcagaactacttaatgactacattcgcttattgctgcagtgaaaagngtgtttgccatcgatgaatgctgcagaaatgggaagatctcaaattctttgctcaaaaacgtgaacttaaccaaaatgatggt

SEQ ID NO: 564 - DNA, 798 bp, Homo sapiens
  misc_feature 1, 6, 19, 21, 22, 26, 28, 29, 32, 35, 36, 45, 50, 53, 54,56, 63, 66, 376, 378, 379, 387, 389, 451, 464, 465, 466,505, 525, 536, 550, 555, 566, 582, 590, 619, 626, 633, 634,639, 663, 669, 670, 678, 688, 692, 696, 700, 719, 724, 727: n = A,T,C or G
  misc_feature 730, 732, 739, 751, 753, 758, 761, 767, 784, 785, 787, 792,793, 795, 796: n = A,T,C or G
nggggngtctaatgctgcncnnatcnanncanggnnctcgctctngctcnacnnanaaggcgntgngtgtgccaccacacccagctcattattattattattattattattattttgagacgaagtttcactcttatcccccaggctggagtgcaatggtgcgatactggctcactgcaacctctgcctcctgggttcaagcggttctcctgccttggcaggcacctgtagtgtcagctactcgaagctgaggtgggagaatcgcttgaacctggggggcggagattgcaatggtgtggtctcggctcactgcactcgagcctggcgacagagcaagactctgtctcaaaaaaaaaaaaaaaaaaaactcgagccntnnaactattngngaggtcgtattacgtagatccagacattgataagatccattgatgaagtttgggccaaaccncaacttgaatgcnnngaaaaaaagcttaattgggaaaatttgggaatgcctatngctttatttggaaccctttntaagctgcaantaaaacaagttaancaccncccaattggcntccattttaatgtttncagggttnaggggggaaggttttgggaaggttttttnaaattcncgggccnnggggncccaatgctttggggccccgggtncccaannttttgggncccttttaangggngggnttanattggccccccttgggggnaaaancgnggnanatacctnggtcccctgtgnanaaatnggnttcccnttacaaaatttcccacnnanatttnngnncc

SEQ ID NO: 565 - DNA, 744 bp, Homo sapiens
  misc_feature 3, 5, 6, 11, 15, 16, 19, 20, 23, 24, 28, 32, 33, 37, 40,41, 43, 128, 136, 219, 595, 598, 637, 706, 731: n = A,T,C or G
ttntnngtttnaatnntcnnggnntcgntctnnctcnaannanaataggtttggcgaattcggcacgagcatgctggccagcatccctgcctgtgcaagctctggatgagctgtgtgcccctgccacncacacccngcactccctgccagcctggcctcagggcctctgatccatgtgcactggagtggtgatgactgacagggccactggggcatttncacgttaacagcagctgccactggcaaaagaagtgactcgccaatggtggcatctcagatgtgggcccaggagtctggggagctactttgaacagggctatccattcattgtcccaccaaaggctatggagcccacccaccatgtgctggagtagtcaagggaaataagacactctccttgtccttgttaactcaatcaacaagcatttgcagagcaccgcctatatgccggcgctgtccgaagtgctgaagatacagcaatgagctaagtaagcactgacttcgtagaaaaccataacatcggccatctttggaaaagagaaaaacaatggagttacttatttaaaaaaaaaagaaagaaagttatctcttccanganaggctagaagtacttttctgctttttggccagtgcccantggaatgcctggtttgggggaagaagaagggactgggttaactgtggtgcttttgttgtaaaaaggcanctggcctttgtacttgaggagaaanatggagccttggg

SEQ ID NO: 566 - DNA, 756 bp, Homo sapiens
  misc_feature 2, 6, 7, 17, 35, 36, 39, 40, 42, 43, 45, 51, 55, 56, 318,338, 344, 379, 413, 420, 425, 428, 435, 439, 445, 447, 449,471, 472, 474, 476, 479, 483, 484, 485, 490, 494, 497, 499,500, 501, 504, 511, 513, 515, 530, 531, 533, 538, 545: n = A,T,C or G
  misc_feature 546, 547, 548, 549, 552, 557, 562, 564, 567, 569, 570, 571,572, 573, 574, 575, 579, 583, 584, 591, 592, 593, 594, 595,600, 601, 603, 606, 607, 609, 615, 616, 617, 625, 627, 628,630, 632, 634, 636, 637, 638, 639, 641, 642, 643, 646: n = A,T,C or G
  misc_feature 647, 648, 649, 651, 652, 653, 654, 655, 656, 660, 661, 662,664, 667, 669, 670, 673, 674, 675, 676, 678, 679, 680, 681,682, 683, 684, 685, 686, 687, 688, 689, 692, 695, 698, 699,701, 702, 703, 704, 705, 708, 711, 712, 713, 715, 716: n = A,T,C or G
  misc_feature 717, 718, 720, 721, 724, 725, 728, 731, 733, 737, 738, 739,740, 741, 742, 745, 746, 747, 748, 749, 750, 751, 752, 753,754: n = A,T,C or G
gnagtnntattgatttntctccgtgaatcgttctnnctnnannanaagtgngttnngccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttantggctatgctcaccccgctncattangcctattttggtctgctgtttccaaatgcttctanatctaggcatttggtatccaacctattgccacantgcctanaactncanacccccngccnctatgntnanacctacttggcacaagaacaanngnanacnttgnnnatatnccanaangnnnaanattacanantnttataataccaattnntnttganggtgttnnnnncanaaacntttgntnacngnnnnnnntatnaatnnataattnnnnntttgnnancannanctatgnnnaattaaangnntntntncnnnncnnnacnnnnannnnnnttannnanttncnnttnnnntnnnnnnnnnnnnttnaanaanntnnnnnttnatnnnannnncnnctnnaangtntntttnnnnnnatnnnnnnnnnncg

SEQ ID NO: 567 - DNA, 746 bp, Homo sapiens
  misc_feature 2, 3, 7, 8, 11, 12, 14, 15, 17, 18, 19, 20, 22, 25, 30, 41,53, 55, 58, 62, 106, 489, 501, 619, 651, 688, 701, 714,745: n = A,T,C or G
gnntgtnnttnncnnannnnanganagagntactcgctctntctctacgatanantgngttncgaattcggcacgagatttcctccagtcctgggccccatccttnagggccttcccagccagccagcaggagaggcaagaactgggggaacacaggaacctaggggaggaggggagcgctgggcatcctcaggctggcggccaagcctgcccctggaggcactagaggagggcatctgtctgtgggagcccagagctgcagggaggaggaggagggaggtatctggtgtgagcgttgcccctgcgacatttgggaccacacaggtgggcttccttattccctgacaaagcctctgtttccagctcttccgccctctctggatgagggaacagaagtggaggaaacaaaagaagcagcagcacgcacagtcctgtcgctgggtgcggagacagcctggcaaagtcccactcagccatggcctgatgcangccccagccctnctttcttgggtgtcaaatgactgtgtcctggacatctgatgcaccacctgccctgcctgttgcaaacgtgatgctcccggatggaatggagaaactaggagactgggacaagcaaaangctgcaaacaacccagaacccattcttagaanactggagaaatgattgaggaatcattggcaccgtggncctgtgcttcatnacaaacacctttnagaacaacttgggattgaaaaaccaagacant

SEQ ID NO: 568 - DNA, 738 bp, Homo sapiens
  misc_feature 2, 3, 4, 5, 7, 10, 18, 19, 23, 40, 48, 50, 503, 550, 619,670, 671, 672, 673, 674, 675, 676, 677, 678, 679, 680, 681,682, 683, 684, 685, 686, 687, 688, 689, 690, 691, 692, 693,694, 695, 696, 697, 698, 699, 700, 701, 702, 703, 704: n = A,T,C or G
  misc_feature 705, 706, 707, 708, 709, 710, 711, 712, 713, 714, 715, 716,717, 718, 719, 720, 721, 722, 723, 724, 725, 726, 727, 728,729, 730, 731, 732, 733, 734, 735, 736: n = A,T,C or G
gnnnntngtngttcttanngttnggatctcgttctttctncacgatcncntcgattcggtctgggcagcctacgctttccggataaaaatggcagaatgaaagaaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctgctatggaaatgatattagacaaaaagcacttcaagtggttttcttatttgagttcaaaatgggtcataacgcagcagagataacttgaaacatgaacagcgcatttggcccaggaactactaacgaacatacagggcagctgtgattcaagaagttttgcaaagcagactagagccttgaatatgaggaacacagtggccagccattggatgcttcacttcttgaagcatcttgacagctttttgcaggtgaaatgcttncacaccagcaggatgcagaaaaatgctttccaagagtttgttgaatncagaacatggatgtttatgctgcaggaattaacaaatttatttctcgttggcaaaaaagtgttgattgnaatgggtcctatttgattaataaagatgtgtttgagcctaaaaaaaaaaannnnnnnnnnnnnnnnnnnnnnnnnnnnnnnnnnnnnnnnnnnnnnnnnnnnnnnnnnnnnnnnnnnat

SEQ ID NO: 569 - DNA, 753 bp, Homo sapiens
  misc_feature 5, 9, 11, 26, 28, 39, 43, 44, 46, 53, 54, 98, 480, 574, 631,739, 743, 747, 749: n = A,T,C or G
gtttntgantntgattcttatgcttngnctaatgctttntctnnangatcccnncgattcgctggaggagaggagctcagagttctacagagtctttnctgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccctaatgagaagaccctaaagagagacatcaagaatggattcagcagaatcatttcacgttttgaacagcagcagtttgaanggccaaagcctttgatcagggatcccgtcattaaaggacactcttgagtattagtaaaccctcttatgatgattaaaagagaagggcagccctnttcacctttttggtctttctattcaacttgcctgaccataaaatggttctcttctgnacaaagccccatcatttggtgaacctcacccttaacaaagtaggattggggttggggggcttaattaattggaatggggccaaggagaagagcccgaaaccttagatnccangggnanaagt

SEQ ID NO: 570 - DNA, 832 bp, Homo sapiens
  misc_feature 2, 5, 18, 30, 35, 36, 48, 49, 52, 56, 98, 101, 385, 427,481, 503, 510, 557, 577, 613, 624, 635, 640, 670, 682, 683,686, 694, 701, 711, 718, 741, 751, 753, 783, 804, 806: n = A,T,C or G
tnatnaataaggtttganttcttatgcttnccaanngcttggacctanntanccangcggtgcgaattcggcacgagccaggccccaataatctgggnttnaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttncaagccaatggtttcttttgggttttgggtttttatgtttgntttttgggggtttggaaaaacatgcatttttaccgtgcacgtaaaattggtcanagaaaaagggagcccagaaaangcagcanatgggccatgcccctttgctgggttttccttttcttttgggactgtnaaggggaaatgggtttttanaaggtgaaggtttggtcctgttggaaggaaaagaantgtctctgttnggggggacaanaaggnacccttgggggaggtccattcgcaatggtncctaccaaaacnnggntctttaanaacaccngggcctttgncccaggnaaaaaaccctgggcccctttaanaaactttggnangggaaccccggaaaacccccttgggccttnccaaatcttttttcccaaagncncccccggggggcccaaaaaaaaacct

SEQ ID NO: 571 - DNA, 748 bp, Homo sapiens
  misc_feature 4, 10, 11, 23, 26, 29, 34, 35, 39, 46, 47, 48, 49, 50, 55,61, 62, 589, 626: n = A,T,C or G
agtnttaatnntggacttctaanganttnggctnntcgnttggaannnnncagtnctctannagcccatcgatgcgaattcggcacgaggctaggattacaggtgtgagccaccatgcccagccacttatctttaaaggattaagtttatgtttcctactatgggaaaccatcccaccccaaacttgatgaccgcattatgtgcttttatagaacatggcacttctccaggatagcatttattctgttttgtaagtgtgaatgtaattaccctacacacagcatacacataatcttcatattctttgccttgtcttgtgaaggcaagggccatgtctatcttattcgtcattagattcccacatccaacatagtcctggggacagcaccaatgcacttttggtgcataagcaaatagtgcatttatagctcttacctacaatatctgatagactaatcaaatatagtaggttatctgggcctttttgattcatgtctctagcttaactttcatttttttcttatttggtatctctcactttgccttttgatatactcttacagtttcgctcactgagtaaaagaaaatntaaacagcaagaagtaaacttgtgttttatggatttngataacatcttctaaaagaccccccaagattgttgatgtctaaaaaaattaaagggccttcaactcataataatacttaatagttcttaaaatattacaaactgattggaacattgcctaac

SEQ ID NO: 572 - DNA, 755 bp, Homo sapiens
  misc_feature 11, 12, 13, 14, 33, 37, 38, 51, 69, 76, 458, 542, 552, 605,666, 739, 753: n = A,T,C or G
agtcttattannnngttctaatcctttcttaangagnntaggctactcgtnctttctgcaggtatcccntgcgatncgaattcggcacgaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacancaaaaacaaaaaatgtgctgttcaagttttcagctttaagatatctttggataatgttatttctatctttatttttttcattanaagttaccanattaagatggtaagacctctgagaccaaaattttgtcccatctctaccccctnacaactgcttacagaatggatcatgtcccccttatgttgaggtgaccacttaattgctttnctgcctccttgaaagaaagaaaagaaagaagactgtgtttttgccactgatttaaccatgtgaaactcatctnattacccttttctngg

SEQ ID NO: 573 - DNA, 743 bp, Homo sapiens
  misc_feature 3, 20, 31, 32, 33, 35, 37, 41, 56, 59, 61, 65, 66, 67, 72,74, 670, 671, 724, 742: n = A,T,C or G
cangtctaatgctggctctnatcggttcttnnnantnaagntactcgttctttctncangnatcnnntgcgntncgctcacacagcatgtgtcagatccatggggtaggagtcggccagagacttggtaacagacagattgctggatcccacccctagactctctgattcagttagtttggggtaaggcgcaagactgaatttttcacaagtttcccagtggtgctgatacttctggtccaggaacttagtggggagagaacgactaatctagaccatttcacttcacattctgagcttcttgtcactgtcacactgcatccttttaacaatgcattccctatcctattgcaatactgacatctcatcaatattttaaaacatgcgttttcagaaacaatattttatatcaaatactcacttttagtaatatttctgcaattttgccctatggatctgagatctaacaaatactattctggacatgggctacaacagttgaggctggaagtaaaaatgttaaaccctgctgaccacgttattttaaagtgtattttagttaagaataatatggcttaggagcagggctaaacagtagcagtcacatggggaatgatactttgcttttgcacataaaatgtcctgaagggaaaaaataaagcagaaaattnncagatgaactgaaaatctgtacaaatgttgggctgaatactgccagcgttgangtgtaggaaaatgaaccnt

SEQ ID NO: 574 - DNA, 737 bp, Homo sapiens
  misc_feature 15, 34, 39, 40, 48, 53, 56, 124, 137, 148, 193, 195, 228,247, 251, 258, 259, 260, 280, 330, 365, 410, 423, 457, 491,515, 524, 529, 550, 562, 568, 607, 621, 624, 640, 646, 676,678, 680, 686, 687, 697, 700, 716, 717, 731, 735: n = A,T,C or G
ccgtctaatgctggnttctaatcgctttcttaangctcnngggctcgntctcnctncacgcagcccggcggtgcgaattcggcacgaggggattacaggcatgacccaccgcgcccagcctgtnatttcttatactntgtattttggncttgtattatgcttctgatacgctataattatttatgtccatgtncntttcttcaatagactgtgaactcttcgaatgtnggactcctagagctagatnctcnattattnnntattaaattgaatgacttgnaactacagatcctttatttaaacttcccaaatttctgctttatctaggcnactctttaaattcttttatctcatgtagatttcanaggctgaaataattgagatttttagtttgaagaaaagagaactgnggatttaatggcnttattattatatttttaatggctgtttgggagtnaggttgcagacattggtcactttcctcctaaatncttaaatatttcctaaaaacaggncattctttnttttnttatggagtctggctctggcntccaggctggantgccgnggcccatcttggcttactgcagctccccttcccgattcncgctggtctcctgnctngctgctcgggaggctnaggccngggaatcgttgaccccggaggcggaggttncnanagcctnnacgggccctnggnctcccggctgggtacnngaccggacctccgnctgnat

SEQ ID NO: 575 - DNA, 766 bp, Homo sapiens
  misc_feature 2, 7, 16, 22, 30, 35, 37, 48, 59, 63, 374, 489, 616, 630,683, 697, 722, 732, 742, 756: n = A,T,C or G
gnagttnaaaagcggnttttantcctctcnaatcngnttgggctactngctctttctgnaggnatcccatcgattcgaattcggcacgagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctnccgcctgagcctcctgagtatctgggactacagatgcgtgccaccaagcctggctaattttgtctcatgtcttctaaaaattattttgtgaagccccttcacaaaaaaccttaanggaaatctgatggtgctcaggaatctaactctccctaaaccatcctcttttaactgcttctaaaatatctctggtggcctttcttagcctttttctggttcattcaatgcttcaaagcgctttttgnttctaagttgagtnctttgggggtttgacaggtagtgacgtgtagttttgacactgttaacttgttnaatacagtgaaaangtttgtgaagtgaaaaatgcttganaaagaatggnaatgcctttntacaaataaaagtnttgttaaaat

SEQ ID NO: 576 - DNA, 761 bp, Homo sapiens
  misc_feature 6, 7, 8, 9, 12, 14, 15, 20, 41, 45, 48, 51, 52, 55, 56, 58,59, 60, 62, 71, 74, 196, 399, 602, 648, 696, 712, 730, 732,745, 753, 757, 761: n = A,T,C or G
ggggtnnnnagngnnttgancccctttcttattatcaaggngctngcnctnnctnnannnancacaggcgntgngaattcggcacgagaagataacctcttaatgcattcatgttgtatatgaaggaaatgagagcaaaggtcgtagctgagtgcacgttgaaagaaagcgcggccatcaaccagatccttgggcngaggtggcatgcactgtccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgnttcccctttttgactttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcacagtgggaaccatcttcgtttcccctttgaactccaantgggatgccctaccctggcgccccttaggaccccggactggcccgngtacaaaactttaccgtgccaaaattcttaagtgaatttacctttctncctctttttgaagctngaaatttttggtcatcangntttgcttgtgatngtacatanggtngaan

SEQ ID NO: 577 - DNA, 803 bp, Homo sapiens
  misc_feature 5, 9, 10, 11, 12, 13, 18, 19, 22, 25, 26, 27, 28, 38, 39,43, 46, 48, 53, 56, 57, 61, 63, 65, 78, 210, 276, 534, 535,536, 542, 544, 580, 588, 609, 612, 629, 634, 635, 640, 649,662, 674, 685, 708, 720, 725, 726, 729, 734, 763, 764: n = A,T,C or G
  misc_feature 774, 776, 782, 787: n = A,T,C or G
gggtngttnnnnngtggnnttnttnnnngtttctaatnntcgnggngntcganctnnctcnananagaataggtttgngaattcggcacgaggtctcccgcccggcgcccccagtgttttctgagggcggaaatggccaattcgggcctgcagttgctgggcttctccatggccctgctgggctgggtggggtctggtggcctgcaccgncatcccgcagtggcagatgagctcctatgcgggtgacaacatcatcacggtccagccatgtacaangggctgtggatggactgcgtcacgcagcctctagaactatagtgagtcgtattacgtagatccagacatgataagatcattgatgagtttggacaaaccacaactagaatgcagtgaaaaaaatgctttatttgtgaaatttgtgatgctattgctttatttgtaaccattataagctgcaataaacaaagttaacaacaacaattgcattcattttatgttcaagttcagggggaggtgttggaggttttttaaatnnncggccncngcgccaatgcattgggccccgtacccacttttggtncctttaantgaagggtttaatttgccccnctntgccgtaattcatgggncatanncttgntttcctggngttgaaaattggntaatccccttcnacaaatttccnccacaatcatttaccaaaccccngggaggcctttnaaagnngtnaaaanccctgggggtggcccttaatttaagtggnnccttaactcncntttaantgccnttgcccttcactgcct

SEQ ID NO: 578 - DNA, 738 bp, Homo sapiens
  misc_feature 8, 10, 29, 35, 39, 91, 623, 640, 679, 681, 683, 720, 721,722, 723, 724, 725, 726, 727, 728, 729, 730, 731, 732, 733,734, 735, 736: n = A,T,C or G
tcgtcccntngatcggggtaacgtccttncctatnaaanttctttcgggaaagcagaaaccaagctggcagaagcacagatagaagagctntcgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcaaggggaggggaacctgtccagtttgtaccatttctttgnatgtatttctgatgtgntctcttgatctgcccccactgtcctgtgaaggacagctnangncaaggagtgaaaaactttacttcttaaaaaaaaaaannnnnnnnnnnnnnnnnaa

SEQ ID NO: 579 - DNA, 758 bp, Homo sapiens
  misc_feature 2, 3, 7, 11, 18, 19, 24, 26, 34, 36, 45, 52, 53, 64, 475,510, 681, 726, 737, 756: n = A,T,C or G
gnngtgnctanctaaatnnttggntntaaacgtncnttctgcatnatccctnnttgacgaattnggcacgagacagagtcctgaaatatgcaaatgaagtaaattctgatgctggcgccttcaagaaacagcctaaaggacctgcctgatgtgcaagagctcatcactcaagtgcggtcagagaagtgctccctgcaggccgaagccatccttgatgcaaacgacgctcatcaaacagagaccttctcctcccaagtcaaagggacaaataagcctctgggttgaacggtttgagacattctgccttggaccttcccttgtcaccaaacaagccaaccttgtgcacttccaccaggctttcacccattccctgcaagccttggtcttttgacctggccctcaaccatgtggctttccaccccttgaggacaagttggaacagaagaccaagagtggcctcactggatacatcaanggcatctttggattcaggagctaaccaggctcttnctcgggggcgggggagattctgactcttaatctggattgtgagaaaaatccagcaagttccatgatatttaaatccaggtctgcattggcccggggcaagagtttaacatcttcgggccctgcatttcctacatcttggggtctgtacacgttcttaagcaagcgtgtcangagagcaccctgttggcttcttggtaaaatgtgtgcaaggtcatnctgtcttctgnaccttctggggaaaagggncc

SEQ ID NO: 580 - DNA, 816 bp, Homo sapiens
  misc_feature 10, 22, 51, 52, 60, 61, 63, 69, 80, 92, 108, 111, 128, 160,163, 529, 534, 538, 559, 595, 597, 614, 654, 669, 675, 682,684, 686, 687, 698, 706, 713, 715, 716, 730, 739, 742, 751,759, 764, 793, 805, 807: n = A,T,C or G
tttctaaatngcttgggtttcnaaatcccttggttgacgccctcgcctaanntggcgtgnnantgcccncgattcgctgncaagtctggaantcatattggagcctgngtngactgaaaactcagcangagttgatgttaaagtcttgggtctgaaattngtngggcaggagattaggctggaaactcaggcagaatttctgtgttacaatcttgaggcataattcttctccaaaaaaatctccatttttttctcttaaagccttggatgagccttggatgattggatgaggactacccacattatctagggtaatctcctttgcttaaagtaaactcactgtgttaatcacatcaacaaaataccttcacagctacatgtagtgtttgaccaaacaactaggcaccatagcctagccacataaaattactatcattatactttgtcttatcacatacttctaccttggaagggatatttcccagttggtatagctacaaaacagaggcagatcatttagcctgcattngattngtantgaaaaataagcctttggtgngtttaaccactgaaaatgtttgcggcctattagtantngcacaacttatcctatnctggccaaacatagaatgctttcggtttgcaaggtaacangatcccctttacagntgtacnaaaaatnancnntaaaaaaactngagccctntagaacntnntagtggagtcgganttaacgttngancccagaccntggattanggatncattggatggagtttggacataccaccancttggaatggcnantgaaaaaaa

SEQ ID NO: 581 - DNA, 868 bp, Homo sapiens
  misc_feature 3, 4, 7, 8, 10, 11, 12, 15, 16, 17, 18, 19, 21, 22, 29, 31,32, 33, 34, 35, 36, 37, 39, 40, 41, 42, 43, 44, 45, 46,48, 50, 51, 52, 53, 54, 55, 56, 63, 66, 67, 73, 81, 170,192, 196, 200, 228, 318, 346, 347, 360, 365, 433, 473, 483: n = A,T,C or G
  misc_feature 538, 543, 546, 556, 558, 586, 597, 613, 628, 646, 649, 672,682, 688, 689, 699, 705, 710, 711, 727, 730, 731, 732, 740,743, 747, 750, 754, 758, 772, 773, 775, 776, 788, 810, 813,815, 826, 839, 844, 847, 851, 856, 866: n = A,T,C or G
ccnnganncnnnccnnnnncnnacaaaancnnnnnnnannnnnnnnancnnnnnnnctcttcnaannctgctnacgcccanagcatgacccacgatcgaatcggcacgaggttgcaagcagccttggaatagtaactcttctcatttgtttgggatctggccaccaagtnccagaatgatacacggatcagngcanaagntcatcaggctctcggaccttagggctgntggagaagcttcagcagcagaactgatggtgaaggctcgtgttctccatcctcaactttctttgcttcgatcatacacaagaatacattnggaagggcaaaaaaatgaacactgtcgnncattgcagcccgngtttngtgacacagatgcacagtctgcttgtgaagaccttctctcaagtggcatttgggagtccatgccagancatggtgcttcatgagagactgacagctatcaggggttgnggcacttagngaggactctcctcccccagtgtgtgctgatgacacatcacacctgacaatagctngaagnctnctctgacccntnttactctgtagccaacataccacatgantttaaaacccnttctaaaatatccaancaatggggtcatacntggcccaaatgccagaantcnagagcctaataggacttccaatnattaactttnccaaanncgaaaaaagnagggcnttccnnttatggcaaaaaaatnaannnaaaagganatntggnatngttngccnaaaaaaaaagcccnntnngaaacctaatangaggaggtcccacttaaccggncgnanccccagaacantggaatacaggantaccnatnggantgaanatttggggancc

SEQ ID NO: 582 - DNA, 745 bp, Homo sapiens
  misc_feature 14, 19, 34, 443, 448, 478, 482, 483, 500, 508, 541, 551,554, 557, 559, 568, 575, 583, 598, 601, 603, 611, 613, 629,631, 637, 650, 654, 655, 666, 669, 672, 673, 674, 675, 676,677, 680, 695, 704, 705, 712, 717, 719, 723, 725, 734: n = A,T,C or G
  misc_feature 735, 737, 738, 743, 744, 745: n = A,T,C or G
ttctgaataccttnttacncgccttcttcaggantttcaagacctaattcggcacgagaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggaggggggggaatgggggaagggctgatgagaccccagctggggcctgttgtctgggacccttcctctnctganaagggaggcctggtggcttaacctgggcangtcnngtcttctctgaccccantggctgcngtgaaggggaaccacccttccttgcttgaccantggccattanctnccntnaccacttgnaacccanggtcccanctggctgggaccctnttntncccccaangncctttcccttgggctntnttggantgagcaccttctntgtnngcaccttttanaantgnnnnnntgntactgatttttttgntaaaaagannttaaaanctggnantttntnaaaaaaaannannaaaannn

SEQ ID NO: 583 - DNA, 748 bp, Homo sapiens
  misc_feature 2, 10, 27, 31, 47, 49, 619, 668: n = A,T,C or G
gnttctaatncttggcctactcgcctntctncaggatcttatcgatncnaattcggcacgagatatggtatagttggaaataggttattgtgagttatttgtagtcatgtctttaatggcccttgcatggtgtctaacttctgcaataaatgatctgccagtcctagtgtctgggctttatgcaatttgttttcctttgtggatgaagtgggagtaagacttgttgctgtgaggatcagatgaagtggctaggatatggacacactttacttgaattggaaaacaagccatgtatccctaatctgcaaaatgtggcatgtcacacgtgtaatctctgaggtttagtttttgctcaagattgcaaaggtgacttgcttgatgctttctttgcttgagcacacatctcattcattaaatggtgtctccttttttgcacacaggatgcagaacataattgaccttttccaagtctacttagcagaaatgaaaatggaatcatataaatacagtattatactttaaaataaaaaggctgtacaaaagtttggctgacatagcttgcttctagtaatctgaatggcttatttaaataaagttggatctatggactcttcacagnctagatattatcctactggaagatgtgcctcgaaagctgttgaaccacngcaaaaaaacccttcagtcagcacgtgagaaaacctgcgagcccacatttcccccgggaccattctgaacatcctactgg

SEQ ID NO: 584 - DNA, 773 bp, Homo sapiens
  misc_feature 42, 186, 656, 684, 695, 698, 752, 756: n = A,T,C or G
tttaatgcttgttacacgccttctgcaggatttatcgattcnaattcggcacgaggctatgtattgtgtcctaccatgaattcactccatgctagccacattggcctgtatggctattccttggacacacctaggatgttcttgcctcttagcttgcctacctttctctcatcatttgggcctcancgaggatatcatctcctcagagaagccttctgtgaccatgctatctaaaatactccagcacttcagtcaccctttatcccattactctgctttttcagaaacattggtgctccctgaaacatatttgtttacttgcttagtgtcttttctcccgcactaccatgtaagcttcttgagggttaagggaccttgttagggataaccactgtatccttagagtgtgacacatagtaggttctcaatacatatttttgaaactctaccctgatgcaaaagagatatcaaataattatagtttttgcattataaatggctttggtgaaatccctggcacaaaactaataataaaagaaataaacagataatgttgaagttctgggcctgcaaaacctaactcttttaaagcagtcccagtaaatgtgtcattgggatccataagactttgtgggaaagtcaacataattttattngggaaaaagcattgaaccttcaaaagtnaaaactttatnggnccaaaatctcaattactggggggccgttctttaagtcattttaaaccctttgangccnacagttttacaccaaat

SEQ ID NO: 585 - DNA, 745 bp, Homo sapiens
  misc_feature 9, 11, 16, 17, 33, 594, 610, 691, 701, 725, 745: n = A,T,C or G
ttcaatacntntttcnngccttttgcaggatcnctcgattcgatggaacatgagtggaagtgggcagtctttttctttccctatcagctgagtgaatgaagatttagagggcagcagagtcatgacatggatgacgttgggtctctggatggctaaatggaagacccgccccccaacgccactctacccccctgctttgaactatgctttgagaaatgagcttatgagaccactgagacttgggggctgtttgttcagcagttcacctacacttattaggaaaggttgacttcttgtactacgcctttccttaaatcatcttttgtataattctcagaacactgctggtttgggtggtctcacacatttctcacatccaaattttaaagatttcatgaatgttcattacagtggatttatttttctctttctgcttctcggcatgccctctcaatttgggagaaatctctaattggatgactttggtgggaccacaggagtgtaaggatcgtaattccctcacttcatcccctgcaaattaaagcctgggcacttaagactcactcaactgaatcttgatatgtgggactttanatcttaagcaaatgangcaaaagaaggaaaagacagttgagaaaatcaatctctgaagttcagcacttgatttccaccgtggaccggactcctgcanctttgcattngccttggttcctggccattttccnaacccgggttcctttttgan

SEQ ID NO: 586 - DNA, 749 bp, Homo sapiens
  misc_feature 17, 39, 48, 78, 79, 83, 90, 93, 94, 106, 111, 116, 131, 144,149, 166, 167, 172, 175, 186, 187, 210, 212, 225, 230, 231,255, 258, 269, 278, 279, 284, 287, 293, 313, 314, 320, 326,331, 334, 337, 350, 378, 423, 430, 451, 456, 460: n = A,T,C or G
  misc_feature 466, 467, 508, 521, 546, 577, 579, 587, 598, 612, 613, 615,616, 629, 630, 646, 652, 663, 664, 665, 682, 684, 699, 701,704, 709, 711, 718, 734, 739, 747: n = A,T,C or G
tgttctaatactaggtntactcgccttttgcaggatctnatcgattcnaattcggcacgaggggtcctggtgggagtnncatncagcagnganngcattctttccncacancagtnaacggtcttattaanagccaccactttnctgangcctgtacaggccttgnnggttnggngaacagaaatnncgcaggcacttgtaccttcaagnanggacttgtgcctnactgnnagggttggcgttgaccttggctcnacngacatacccantctgacttnnaacgngcncgtctnagcttacgctagactgcacnnccaagnttgcangcctnttntgncttccctgcattnaccaatgacagtacgaccaacagtcaangaaaagtgccaagatatatctatcccatttcttctacacctgtanattcctnactatgctcaaactatgtggngcaangaanactggnngacatttttagtcaatgatgctgacaattaattactggtgnggccaggcatatnttcacggctgcttgtgatgccaacnaagaacgggccccagcccatccttactcctngnccccaaanagatccagtgngaatgggaagctgnnannaccaacccaactnntgatttaccaccaacnccaaanatcacgcatgnnnacagcaaaacaacaacncnatgcacttaacaagnanccnaaaantnaactcgngcctctaaaactattngggantcctttanct

SEQ ID NO: 587 - DNA, 783 bp, Homo sapiens
  misc_feature 9, 26, 40, 594, 595, 596, 603, 604, 606, 609, 610, 614, 615,617, 621, 624, 639, 644, 652, 654, 662, 663, 667, 681, 682,683, 693, 696, 698, 699, 706, 710, 747, 748, 750, 761, 765,776, 783: n = A,T,C or G
gttctaatncttggcctactcgcctntctgcaggatcttntcgaccttattcggcacgagcccaaggcaagctgttaacaaaatcaacctgggccaatcatcaaagggttggacctaaggttgctatactcaatagaacaagcattttaaataaatttctcgtaagttgttgctttctttatgtggtgggtgtggctttaaagagcacaaaaccacaacaaatcaaagagtagctcgggcttgtcttttgctttatggctgagggtttgaaggatgattcatggacttgtgaatgccagccccagtcccggcttaggtctatctgccaataccaccagggccaacaaattcacgcaacaaattctctcattttttacagtttatcagttgcactcatagttattgtcataatcactccccacagtaacctgtaaggcatataaagtagctattttagtaagataaatgatattttatatatgttatgataagataaatcttatcattttaagaagaaactgagctcggagagatgaaatgacttcctcagttgctgctgtaataaaagtctactttttgctaaaaaaaaaaaannnaaatatnntntannattnnantaanaanaaaaacttcgagccnttttnaaactttnantggagtcnntttntcccgtaaaatccnnnactttggatnaanannccatttngatnaagtttttgggacaaaccccccaacttagaaattgcnntnggaaaaaaaantgcnttttattttgnggaaaan

SEQ ID NO: 588 - DNA, 771 bp, Homo sapiens
  misc_feature 20, 30, 422, 538, 555, 557, 581, 583, 595, 608, 688, 704,718, 727, 734, 736, 745, 758, 766, 769, 771: n = A,T,C or G
tcttctaatgctggttacangccttctgcngatccctcgattcgaattcggcacgagatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcggttgattntttttgaaaagatgaaccaaaggatttgactgctaatattttattccttacacttttttctgaataagtctctcataatgagtgcagtgtcagactgtgcctactctgatggtatngtgccatttgtaaaatnanaataagagcagaaaaaacacaaanangagaacactggnttcagacattcantggggcaagttaaattatgggactgcaaaaataatggattttttattcaaagaaaagctttaaaaagttttattatccanatttacaacccactanttaagctaaataancctactttnaaaaatngnaaatggttnctatctttataangtgccaanttnan

SEQ ID NO: 589 - DNA, 844 bp, Homo sapiens
  misc_feature 2, 7, 8, 16, 18, 34, 92, 95, 458, 506, 544, 578, 597, 599,606, 613, 620, 629, 630, 657, 662, 666, 668, 672, 693, 699,703, 708, 710, 717, 724, 725, 726, 727, 732, 735, 738, 740,742, 743, 744, 752, 754, 757, 763, 768, 772, 780, 788: n = A,T,C or G
  misc_feature 795, 800, 801, 803, 805, 809, 815, 818, 827, 828, 835, 839,842: n = A,T,C or G
tncactnnaatccttntntaaaaagccttctgcntgatcccatcgattcgaattcggcacgaggccagagcctagaggagagatcaaagacnttngccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcaatgaggacactgactgccaaggaggagcttctgcagaccctgcggacccacctgatcctncacgtggcccgagcccacggctactccaaggtcatgactggggacagntgcacacgcttggctatcaagctcatgaccaacctgcnctgggtccaaagggccttcctggcctgggatacnggctttcttggatgaaccngnaccgggngaacgtnggtggtnggtgccggnncattgcctgggaaccaccacccccttnaaaangaangntcgnttatttctaacaaaacccggnccttgnttcntaccntnttccctntcttggnnnnttttnaanacncnannncccaattngnaanaacccnaaaangggnccctttgnaaaaaaanggggccnatatnntntntcanacccgnggnctttgaatnnggaaaangccnctnct

SEQ ID NO: 590 - DNA, 767 bp, Homo sapiens
  misc_feature 13, 17, 42, 114, 115, 508, 563, 611, 619, 686, 687, 713,714, 732, 738, 753, 761, 762: n = A,T,C or G
tctaatgcttggntctngccttttgcggatctttcgattcgnattcggcacgagagaacgttctcaggttgaccagctgctgaatatttctttaagggaggaagaacttagtanntcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaangtacaggcaaagaaaatgagccccagcagatggtttcacctagtaactcattganggctggacagaaccagaaagcaaccatgcaccctcaaacaaggaagtnacacctcnggctggccttcccttccgaacaggtgaaaggggcttgaaaaatgttgctaccccaaaggcgacattnntggcaccaaattatccctcttgaccnntttaataccttttgattncatttnggcaaaagactttgnaccagccnnggaga

SEQ ID NO: 591 - DNA, 765 bp, Homo sapiens
  misc_feature 565, 607, 614, 622, 629, 659, 667, 720, 729, 730, 738, 756,762, 764: n = A,T,C or G
tctttgaatccttttgtaaaagccttttgcatgatccctcgattcgaattcggcacgagacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtcatcttctggccccttgagtactgccagaggcaaaagatgtttgtttcttattcattccacttttgtctcctgggatcccttctgtagcctaaagtatggctgggaaatggacttgagaagattggcttgaattangatcataatcatgtgtgatcccatcatgaattcattggaatntggggtncatgtaangcaatcnttctggtgtaaatcttcctttttttaatgnacatatanttttggaaaaaattttgaattaaccctgaaaatttttaaaaaagccctcttanaactattannggaggtcncattaccctagaatccanacattnant

SEQ ID NO: 592 - DNA, 757 bp, Homo sapiens
  misc_feature 2, 6, 9, 13, 19, 21, 252, 569, 637, 641, 644, 675, 692, 731,755: n = A,T,C or G
tnttcnaanactngttctngncttttgcaggatcccatcgattcgccaaatctgcctagagattgagttcacagtgtatgttctgggggcgctggtgcagtcagcggtccagtctccagcctgcaggcgtgcacactggggtggacgatgggtggccccgcaggtgtacacatttgggtggccccggcccctataccccagtgttctctttgatccagtcccgaaacagagggagccttgtgtacacgcctncaaagtggagctgggaggtagaaggggaggacactggtggttctactgacccaactgggggcaaaggtttgaagacacagcctcccccgccagccccaagctgggccgaggcgcgtttgtgcatatctgcctcccctgtctctaaggagcagcgggaacggagcttcggggcctcctcagtgaaggtggtggggctgccggatctgggctgtggggcccttgggccacgctcttgaggaacccaggctcggaggaccctggaaaacagacgggtctgagactgaaattgttttaccagctcccaaggtggacttcantgtgtgtatttgtgtaaatgagtaaaacattttatttctttttaaaaaaaaaaaaaaaaaaactcgancctntanaactattagtgagtcctatttaccttagatncagacatgataagaatncattgatgaattttggacaaaccacaacttggaatgcantgaaaaaaaatgctttatttgtgnat

SEQ ID NO: 593 - DNA, 766 bp, Homo sapiens
  misc_feature 9, 12, 16, 17, 611, 617, 655, 661, 674, 676, 727, 729, 732,733, 735, 737, 739, 741, 742, 744, 747, 749, 753, 756, 757,759, 763, 765: n = A,T,C or G
tcttgaatnctngttnntgcctttttcggatccctcgattcgaattcggcacgagagaacattggtgtgtgagtgttttttgatggtgcaggacccggaggtgctttccttgccaagaatagaaacatccagaatgctcctccccatcccccaatcccagacagcaattatgtcagccctgtaaggcattgcctgctcttgaccctttggcccatctttttatttttaaaaaattcccatgtcacagatgccctgtctatgcagagggtggcgtgggatgggtgaccactaagtttaggctggtgaaggtggtgagcccttctgaggccctgatagaactttccaggagttcatggtccgcggctccagcttctcactgtaaagttgtcatcctggcagaggcagccaatgcttttcattctagggggtagagatttatgctaatgagtgaatattgcaccactagtgactttctgtttaaagttcagctcttagaaaatggaatcttacctgacccctagtgaattatgtacataagcagggaatgtttccaactagatctccttcagaagagtccctgtgctggaataggtcactgaatcttatttggntttgtnaaacaaaagcttttgggtctcgtggggtgtgtgtgtgntttggngtgtgttgccccntntgccgtttcaaataaaaggtttggtaccaccttttcaaaaaaaaaaaatantntanntnanantnntntancntttnttnncnttanant

SEQ ID NO: 594 - DNA, 754 bp, Homo sapiens
  misc_feature 4, 326, 428, 479, 548, 557, 563, 577, 580, 586, 589, 611,612, 617, 625, 636, 637, 640, 648, 651, 655, 662, 672, 673,677, 684, 687, 691, 694, 696, 710, 713, 714, 716, 726, 730,734, 741, 744, 745, 747, 749, 753: n = A,T,C or G
ttgnttaggatcccatcgattcgaattcggcacgagggaaggcagtgggaggagaggaccaagtctcaaactccagaagccccacctccctgagctcagctcctctgccaagccccctcagcgcgaagtcctcgtccagagaaggcaacggcgagaaacaaatccaacatcctgggctgctttttccttcccccactttttaaaagtttggtgtccaagtcacttgacaaacccagaccctaacaatgatattttgtgtagaattctgggatcaaaatataatttcaaaaataatatattttctgacatcccccaaaaaaaaaaanaaaaaaaactcgagcctctagaactatagtgagtcgtattacgtagatccagacatgataagatacattgatgagtttggacaaaccacaactagaatgcantgaaaaaaatgctttatttgtgaaattttgtgatgctattgctttatttgnaaccattataaagctgcaataaacaagttaacaacaacaattgcattcattttatgtttcaaggttcanggggaggtntgggangtttttttaattcngcnggcgcngcnccaatgcattggggccccggtnncccancttttggntccctttaagnngangggtaaantgncgcncttggcntaatctttgnncatnggttggnttnctgnggngnaaattggttttccnggnnanaatttccccncatnttangatcccnggnngntntaang

SEQ ID NO: 595 - DNA, 767 bp, Homo sapiens
  misc_feature 15, 16, 19, 27, 29, 314, 407, 423, 526, 567, 583, 601, 606,639, 645, 657, 665, 678, 683, 702, 710, 732, 736, 738, 740,745, 757, 765, 766: n = A,T,C or G
ggtttaatgctgttnnaanccttcttnancctttgtacagcatccctcgattcgaattcggcacgaggaacgcttccattttatacctgtgtctagttagtttctgcctatctatccaagaagcttttatcaagggtccaccatgtgccagccactgaagtagatataaatacaaggatgtgtaaggtatggatgatggtatacgaactgtcatcttactggatttgtccgctctgttaaagatacggttccgaaaactttttaaagccctagagagggctttaaggcaatgtagcatcatatatagaggcatnaacctgttcatatctttctatttaacagaactgtgcacctgggcacaagggtgtgcacaacaggatgtgtacagcagcactgttaaagtgtancacatccatactacangatcttatgcaactgttggaaagaatgaagcgatgctgcactgtggtcatgcagtgatctctaagacatattaactcgaaagcaaaaggtttaacaatgtatnacaaactgggctgcaattgactcgcgcctgtaatcccagcnctttgggaggcttgantaaggcggatcacctgangtcangagtttgagaccaaacctggccaatgttggccnaaaccnctgcttctactnaaactacnaaaaattaacctngggcntggttggctccgtgccttntaatcccngcttactcggcaatgcttgagngaangnanaattngctttgaacctnggggaggnng

SEQ ID NO: 596 - DNA, 743 bp, Homo sapiens
  misc_feature 2, 5, 9, 12, 20, 30, 56, 93, 156, 192, 199, 203, 218, 240,256, 259, 278, 295, 301, 307, 308, 317, 320, 325, 334, 340,346, 356, 358, 369, 374, 391, 474, 486, 559, 567, 628, 659,701, 702, 719, 734, 740: n = A,T,C or G
tnttnaatnctnttttaatncttgctgcangatctttcgatgatcccatcgattcnctggtctcgaacacctgacctcaggtgatccattcgncttggcctctcgaagtgttgggattccaggcgtgagccactgcggccagcacatttccacttntagatcctactccataccacaggtttcatttaagangaaaganctanataaatgtgctcttntggataccccaccctgacagantgcattgttacacagntancatgggttgacactgcaanctggcctgtcagccatnggaggngtttanngaaaggcanatnatgtnactctgtgncagggngccatntgcttacccntnacctagcatanggggnttctacgggtgaccccnagcatatttctaggttacttatgggcagatttgtaagtgacaaaactccagctgatgctgggaatggggagagggcccttganggactttgtggntttgtgcttctggtttcctggccaaccccagggtcacttgtctggagcccagctgggcactaatgtctgccancgactatnttacagtgtataaatgattcctctatttggggagagatcttccaatccagaagagcccctnttggactgcctgggttaaatctgcatagcanaagtggttgatgagtcatctgaagaaattcagccccaacttnncaacctgcccttcctgnttcctttttaatggnggcctntgg

SEQ ID NO: 597 - DNA, 786 bp, Homo sapiens
  misc_feature 1, 6, 7, 8, 11, 21, 23, 32, 78, 103, 113, 117, 119, 121,123, 131, 159, 165, 172, 174, 178, 180, 189, 220, 258, 263,271, 273, 339, 344, 347, 373, 401, 408, 417, 420, 421, 425,429, 430, 446, 447, 458, 460, 476, 479, 490, 493, 494: n = A,T,C or G
  misc_feature 516, 536, 547, 560, 567, 577, 581, 585, 610, 615, 632, 636,638, 640, 642, 661, 666, 684, 687, 695, 698, 699, 707, 717,724, 730, 731, 732, 739, 747, 753, 766, 777, 785: n = A,T,C or G
ngtttnnnccngtttttaatncnttgctactngctctttttgcaggatcccatcgattcgaattcggcacgaggacanaccgttgagaggacgtggaggcccnttagggggtntgcncngnanaggcagangtggccctgggaacagagttttatgacncttttnaccatanangaangngagaatttnaaagatatggtgggaatgacaaaatagcagncataactgaagacaacatgggtggatgtggagtttggnacctngggatcgngnaaagataccagtgatgtggagccaactgctccgatggaggaacccacagtggtggaggagttccantgcanccnggaagaggagtatccagcctaagttnctgactggatgtcaagaagaaacccaanttataanagatgactntanntgantggnnaaatctttcagatcannccagaccatancntgagtttaacatccgnaanccacaatccantgnnccttactaagccgtggtgattnacaagtcataaatccattanatgatgtggtnaaagatgcctatnatgaccnattctccatngttntccngaaacccgtcaattgacatcacatntcctnttggagattaaattttnggtnancntnccttcgtccttgggcattngaacncataagaatgcacccccnggntaggcccngtnnaaaggttnatgaaggccnttataanttttgnnnccccaancattaaantggctngattcccttaatnttttcctcccnaacccagnt

SEQ ID NO: 598 - DNA, 809 bp, Homo sapiens
  misc_feature 1, 7, 8, 9, 10, 12, 13, 14, 116, 118, 263, 645, 656, 663,680, 693, 710, 713, 723, 727, 751, 767, 775, 777, 789, 796,804, 808: n = A,T,C or G
ngttttnnnncnnnttttctaatgcttgcttctcgttcctttgcaggatcccatcgattcgaattcggcacgaggacagaccgttgagaggacgtggaggcccgagagggggtatncncggcagaggcagaggtggccctgggaacagagtttttgacgcttttgaccagagaggaaagcgagaatttgaaagatatggtgggaatgacaaaatagcagtcagaactgaagacaacatgggtggatgtggagttcgaacctgnggatcgggtaaagataccagtgatgtggagccaactgcaccgatggaggaacccacagtggtggaggagtcccagggcaccccggaagaggagtctccagccaaagttcctgagttggaggtagaagaagaaacccaagttcaagagatgactttagatgagtggaaaaatcttcaagaacagaccagaccaaagcctgagtttaacatccggaaaccagaatccactgttcttccaaagccgtggtgattcacaagtcaaaatacatagatgatatggtaaaaagatgactatgaggaccattcccatgttttccggaaaaccccccattgacatcacattccaacttggagattaaattttgggtaacccttcctttgtncttgggccttngaacccntgaaggaaggcaccccnggtgaagggcccngggggaaagggattcanggnaaggggccantaanaaaccttttgggaccccccttaanccaataaaatttggtngaattgcnanggaatggtttgnccccccnaaaccccnaaant

SEQ ID NO: 599 - DNA, 759 bp, Homo sapiens
  misc_feature 4, 9, 17, 24, 34, 35, 36, 38, 43, 644, 654, 679, 712, 721,723, 739, 751: n = A,T,C or G
tttntaatnctttttcnaatgctngcttcaggannntntgcangatccctcgattcgaattcggcacgagccaggttagctgctgaatcaaagcttcaaacagaagttaaagaaggaaaagaaacttcaagcaaattggaaaaagaaacttgtaagaaatcacaccctattctatatgtgtcttctaaatctactccagagacccagtgccctcaacagtaaagacttttctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtaccttttttttataaacttagttttagactatgttgtaaaaatggggaaaggttgtaaactatgtngtaaaaaatngggaaatgtggctttaaaatatatncattatatttggttcaaggattttggcaggggntaaaggaancnatggttcaatctttgnatttatataccntgatttaa

SEQ ID NO: 600 - DNA, 769 bp, Homo sapiens
  misc_feature 10, 16, 20, 28, 31, 191, 272, 417, 423, 430, 569, 585, 602,606, 614, 643, 656, 699, 726, 732, 743, 744, 758, 760: n = A,T,C or G
ttttaatacntttttnaatncttgcttncgntcctttgcaggatcccatcgattcgaattcggcacgagagcaattccactcctagctccacccacaggtaattgaaagcaaagacgcaaacagatgcctgtgcaccaaagttcacggcagcatccttcgccatagtggcagcatccgtcgtcacagcggnatcatccttcatcatagcggcagcatccgtcgtcacagcggcagcatccttcgccacagcggcagcatctgtcgtcacagnggcagcatccttcgccaaagcggcagcatccttcgtcatagcggcagcatcctttgccatagcggcaaggtggaaaccctgtccatccactgaggcgtgcatagactaaacatggccagtccaggcactggaatccaggccgtanaacggngcccacngtcaaaaggaatgagaccctgatgcactgggcgacacagacgggcgacacagacttggagacatcatgctaagtgaaaagccaggcacacggagcggacggggtgatcctgctcacgtgatgtgtcccgaatgggcacnttcagaggggaagaanggagatggcgcttgacngtgnccgggacnggggttgggagcgaccggttgttggtttngggtttctttctngggtgaaggaaatgtttttgatattggggccgtttgggtgatntttgcattaccctttgaatatgcttanaacccnctagaaattgnnacactttttaaatngnttggaaatt

SEQ ID NO: 601 - DNA, 755 bp, Homo sapiens
  misc_feature 1, 38, 45, 60, 176, 200, 253, 254, 257, 265, 267, 315, 332,333, 338, 341, 342, 349, 351, 372, 390, 392, 395, 404, 408,431, 432, 515, 518, 530, 579, 594, 599, 655, 656, 691, 694,731, 734, 735, 738, 748: n = A,T,C or G
ntgtttaatactattttctaatacttgctttcgttctntttgcangatcccatcgattcnaattcggcacgaggagacagcagcccccagggaatgaagctgatgccagagtcagacccgaggaggaagaggagccactgatggagatgcggctccgggatgcgcctcagcacttntatgcagcaactgctgcagctggncctcaagtacctctttatccttggtattcagattctggcctgtgccttggcannctncatccttngnaggcatctcatggtctggaaagtgtttgcccctaagttcatatttgangctgtgggcttcattgnnagcancgnnggacttntnctgggcatagctttggtgatnagagtggatggtgctgtnanctnctggttcangcanctatttctggccagcagatgtannctatatctgtgattactggcacttggctacagagagtgctggataacagtgtagcctgcctgtacaggtactggatgatctgnaanacaggctcagcnatactcttactatcatgcaaccaggggccggttgacatctaagacttgnttattctatagttcnaggancacaatggaatatgatcccttaactcctgatttgggatcatctgaaggaccaaggnnggcagtcttcgaagtggaataaaatagccccggcngtngtgacttgcacctatattcccagacttttgggaggcnaannttngaaggattgnttgccct

SEQ ID NO: 602 - DNA, 773 bp, Homo sapiens
  misc_feature 1, 23, 24, 25, 27, 29, 50, 245, 344, 370, 381, 392, 416,456, 502, 521, 530, 558, 560, 569, 574, 628, 634, 642, 660,663, 665, 667, 673, 701, 704, 706, 716, 736, 742, 744, 746,753, 758, 760, 767: n = A,T,C or G
nttgtaatagctggtttctaaannntngntttcaacccctttgcatgatnccatcgattcgagcaaatcaagatcttcaggtacagttggaccaggcactccagcaagccttggatcccaatagttaaggcaactctttgtttgcagaggtggaagatcgaagggcagcaatggaacgtcagcttatcagtatgaaagtcaagtatcagtcactaaagaagcaaaatgtatttaacagagaacanatgcagagaatgaagttacaaattgccacgttgctacagatgaaagggtctcaaactgaatttgagcagcaggaacggttgcttgccatgttggagcanaagaatggtgaaataaaacatctttnaagtgaaattngaaatctgganaaatttaagaatttatatgacagnatggaatctaagcctttagtcgactctggtactctggaanataacacctattatacagatttacttcatatgaagctggataactnaaaacaatagaaattgaangcactaaangtgaattgtcatacaagcgaaatgaaancnttatttganagccngcgggcttctaacatattgagcgataactttttgcaaatgaaagatgcccttcngctttntgaattgnaaaatattgaaacctganagntnancttagntgaattgaaacttaaatttgaaccctgnacnanaccggttaantgcctgttcctgataaaaanaagccntnangtgcttncctgntngatttancccccg

SEQ ID NO: 603 - DNA, 784 bp, Homo sapiens
  misc_feature 7, 26, 28, 30, 42, 43, 110, 123, 166, 185, 274, 319, 410,422, 446, 447, 451, 498, 596, 601, 607, 637, 640, 655, 657,662, 681, 693, 705, 711, 713, 715, 721, 723, 728, 737, 738,742, 758, 773, 780, 783: n = A,T,C or G
tgctttntaatagctgtttttaaatncntngctttgcgctcnntttgcaggcatcccatcgattcgaattcggcacgagggggacatcagtgatcgtaagtctcctgggnccgttattctcanattaggtgacggagctaagacttcgagaccatctcgtcctttntgtatcgcggaaacctgangaacgagccggcggcggtgacctgcacgagaagccaggctaactgggtgaagtaccatgcaagcatttcttaaaggtacatccatcagnactaaacccccgctgaccaaggatcgaggagtagctgccagtgcnggaagtagcggagagaacaagaaagccaaacccgttccctgggtggaaaaatatcgcccaaaatgtgtggatgaagttgctttccaggaanaagtggttgcantgcttgaaaaaatctttagaaggnngcanatcttcctaatctcttgtcttacggaccacctggaactggaaaaacntccactattttggcagcaaacttgagaactctttgggcctgaacttttccgattaagaattcttgagttaaatgcatctgatgaacctggaatacaanttagnttcganaagaaagtgaaaaatttttgctcaattaanctngtgtcaaggaaaatngnttcanatgggaaagccgttttccncctttttaagantgggaattcttngatgangncnaattcntnttgancttaactgnnttangcagcttttaaaaaantaccattggataaangagtccnaant

SEQ ID NO: 604 - DNA, 801 bp, Homo sapiens
  misc_feature 4, 6, 7, 10, 28, 29, 31, 50, 54, 63, 83, 99, 118, 258, 286,291, 301, 339, 369, 371, 426, 438, 440, 469, 476, 479, 489,510, 517, 529, 535, 538, 541, 551, 561, 564, 578, 585, 587,589, 591, 592, 596, 606, 614, 615, 616, 620, 628, 632: n = A,T,C or G
  misc_feature 634, 638, 641, 643, 646, 648, 649, 660, 670, 672, 678, 680,686, 689, 690, 693, 694, 696, 698, 701, 707, 712, 719, 726,728, 729, 736, 739, 745, 749, 753, 754, 761, 768, 770, 772,775, 776, 777, 780, 782, 789, 790, 794, 796, 797, 798: n = A,T,C or G
gttncnnctnaacccttttttgaaatcnntngcttctactctttggcatncatnccatcgatncggccccgtgtggggagacngacagcaccctttttntctggcatttgcccttgangctatagcgcctcccctctcccctcagagggcacagctgcaggcctgaccaaggccacgcccggctctcgtgctctaggacctgcacgggacttgtggatgggcctggactctccagaaactacttgggccagagcaaangaaaacctcttgttttaaaaaaattttnttcanagtgttttgnggaggagttttagggcttggggagagggaggacacatntggaggaaatggccttctttttaaaagcananaacacataaccttacaactgcctggcaagcccaatatcacttgtttgggccctancgggactccaangnagccacacgccccttctggaagggtgtgngcatgtnaantgtgtgccancgcgtgggctggcgtgtgaanatctatnaaataagtatanatgggngtntantatatgtgtntaaaataaangantggacatatttggncctctgngnananncttngaatctaagncaagagtnnntctngaaaaacnaaananagtnctntntananntttacgtaatnatcaatactntntccacntnaccctnctnntanntntnccnatatantcgantaattcntcactcntnnattcctngtnaacacnaatnaatnnaactatnaaatatntntnctnnntantngacatanncatncnnnccg

SEQ ID NO: 605 - DNA, 759 bp, Homo sapiens
  misc_feature 2, 17, 20, 30, 376, 507, 565, 606, 609, 647, 657, 659, 663,671, 681, 684, 691, 715, 720, 721, 722, 737, 753, 757: n = A,T,C or G
gnttctaatgtggttcnaanacttgctttngctcctttgcaggatcccatcgattcgaattcggcacgagagcctcgcctgggccggcctgtggctcccattttcctttcagcgggacaaaggggacttgttaccaggccattttctggatggcctgtgagatctctgcccctccaagaccctccaagtctgagcctgacccacagctgggacactgaattcagccctgggaaccatgggggcttctatctggcaccaggctgcagcctccccaatcccagcccactttgctgtgtctctggcgggctgtcctccttggtgggagctgtcctgcacactgtaggatgcttaaaggtatccctggccttcacccatncctagccagcagctcccagtcagacaacagccagaaatgtctccagactctgcccagcctcccaggtagccaccctcgagacatgacctcagagtctctgtgtctcctagaagcctgacagagacccccanggcagtgggtgggtggcgggctagagacccttgcctgtgtccgggaccctggcgccgntcttccctcctgtggatcccttcgcacttacaagtgttctnaantgggcagacgcctgggcaccccttgggccctgcccaancatggccatngngcangctttttnaacccgcatnggntttccangcctggtgaatcttgcttttccanggacnnnttggaacctttcctncggggcggggcccccnagcnct

SEQ ID NO: 606 - DNA, 809 bp, Homo sapiens
  misc_feature 4, 8, 13, 14, 15, 16, 17, 41, 233, 321, 397, 413, 502, 508,514, 537, 538, 543, 544, 551, 554, 555, 592, 613, 617, 619,620, 626, 642, 666, 686, 689, 698, 710, 712, 722, 724, 728,738, 740, 742, 749, 753, 763, 764, 770, 776, 779, 783: n = A,T,C or G
  misc_feature 795, 799, 802: n = A,T,C or G
tctncgtnaatcnnnnntttaaaagcctttgcttttgctcnctttgcttgatcccatcgattcgtgactttgtacctggtccaagctgatggggttttgctgctgttgacccaggcaggagtctgactagagaacaaactaaggttgctgcaacaaacaaggacctcttccaagaagggctcccaggcctggcgcagtgactcatgcctgtgatcccagcacttgggaggccnaggcgggtggatcatttgaggccaggagttcgagaccagcttggccaacatgatgagaccccgtctctattaaaaatacaaaaattanccaggcgtggtggcgcctgtagtcccaactactcaggaggttgaggcaggagaattgttgaacccgggaggcggangttgcaatgagccaanatagcaccactgcactgcatccttgggtgacagaagcgagactccatcttaaaagaagggctcctgtgtctacgtcatggtggggctanagagangtcccngcagctgggctgtgttgagtgannggctnntcttttnaannccaggcaatagtttgtcttgactctgtccttttctgngtccacatgacattttacatntttncnnagtttncttaatttaaagttgnctaattttaccattatacattttnaattggcatttcttttaccnatnctttttgtntgaaaatggtantntttgaaatcngnatcngttctaatgngntntattttnaccnaatgccaatnntacctnctttgnaanaatntattcgttttcnaagnttnaacctct

SEQ ID NO: 607 - DNA, 788 bp, Homo sapiens
  misc_feature 2, 13, 19, 24, 33, 34, 35, 438, 459, 466, 505, 545, 591,592, 668, 671, 675, 680, 684, 690, 711, 728, 730, 745: n = A,T,C or G
tntttctaatacnagtttncaagncttgctttnnnatccctttgcaggatcccatcgattcgcaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccaacanttgggaggtgtcatggaagangctgaanttgtggacaccgatcttctcttggatgatcaagattcantcttgcttcatggtgacgcagaactataaagccctgtgtncacttatagacagtgaaaacccacgggtcttcatctttattaatcnngaaaccttggaatgcctgctttgttttgtaacccctttttaaaacctacctgtttttaaaaagtggtcatttttanttnacgntttanaaanaaaaantcctatttctttttccttttnattttaaaaaaaaattngntttttgttggggggntttggggggaattaaaataatttggcccccaactttaaaaaat

SEQ ID NO: 608 - DNA, 796 bp, Homo sapiens
  misc_feature 17, 30, 354, 361, 362, 398, 458, 463, 485, 492, 507, 520,530, 537, 565, 582, 589, 596, 630, 639, 650, 653, 665, 667,686, 693, 697, 706, 707, 710, 729, 730, 736, 737, 743, 751,754, 759, 762, 763, 767, 768, 769, 770, 773, 775, 787: n = A,T,C or G
  misc_feature 791, 792, 795: n = A,T,C or G
tcttttaatgctttttncaagccttgtttnaaatcctttgcaggatcccatcgattcgaattcggcacgagactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcaagagacgcaagggagaagaaatcataacacccccacccnaacaccnncaagacagcagtcttcttcacccgctgcagccgttncgttccaaacagagggccacacagaataccccacgtttttatataaggaggaaaaccggnaaaanaatttaaaagttaaaaaaatancctttcngttttacactactgntgtagactcctgntttcttcaancacctgnagattcttgatttttttgttgttgatgntctctccattgcttgtngtttgcntgggaanttttatttaaaaaaaaaaaaaattcttgtgagtngactttggnttttaaaccantgntagattttaacngnacccttaatgggttgtacntatatgntttnaaaacatgnnaanaaatatttaatgtaaaggnnctgttnntaaatntaaccacntanagaanttnnaaannnnttnanccctttagaacnattnntgng

SEQ ID NO: 609 - DNA, 790 bp, Homo sapiens
  misc_feature 2, 3, 4, 11, 16, 24, 33, 34, 39, 354, 478, 518, 536, 545,562, 596, 601, 626, 641, 643, 651, 652, 678, 705, 719, 725,740, 741, 743, 750, 753, 765, 771, 773, 782, 787, 789: n = A,T,C or G
gnnntttaaanacctntttcaatncttggtttnnaatcnttttgcaggatcccatcgattcgcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggntcattttttttctctggcaacaaagcttgatgttttcactgctttagtttcctgtttgctggtgggaggggatacggtctgtgactctggacttgctctgggggaacagttgtcactgcccccngggagaggggcagcttgggcttggaagaaagcacaccccngagaccagagccccttcnagagggatncttggctgcttcattgnctttcccccagcaagccctgctcttccacaagcnccttntggggtcttgggtatggtcccccgntcaccttctttccanantccctganntggtgtagggttgtgggttggcacanggaattttggggcattggggaaggggntttcaaaacttttnccaaanacccccgtgttcctnngnaaaattnaanttggtgggcttngggtgntnacccccaantcttngnc

SEQ ID NO: 610 - DNA, 786 bp, Homo sapiens
  misc_feature 8, 9, 10, 12, 13, 25, 34, 37, 39, 40, 49, 50, 51, 54, 55,647, 665, 667, 674, 690, 721, 735, 745, 748, 768: n = A,T,C or G
gatgtttnnnannctggttctaatncttggaaanctncnnctttgttannngcnntttctgcaggatcccatcgattcgaattcggcacgagcccagctggacctggtggccctttcctagtgcctctgctgggggaggagaacctctgtccacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagccccatgcacgtggaggaggagctggctttcagccccagaccccacgctagcactttccacgctgcttgcccgctgttgatgtgcagttcccagtgcctgtgtgagccgacatctgctcagtcctatccctcgtcagcgtgtggagacccagctcctgcaagcccttctgcttccacgcccccagacagcttggtggagggtcctgcatctgggccaagctggggtgcacccagccaaagacaaagctgccttcacgtgcccaaaggattcaagatggtgcactggccccgggaggagtcttgaccaaaaatgggagcccgctcttgtggggaaanccccgacttcccccaccnanaaaccgntcccacggtgccggancttcccccttttcctttgtgggggcaacaanattggccttgggcnctttcaattnttncggaagctttcctgggtgtnggcttttgaccttaaaat

SEQ ID NO: 611 - DNA, 938 bp, Homo sapiens
  misc_feature 15, 19, 24, 26, 33, 36, 52, 128, 235, 285, 402, 442, 492,497, 498, 499, 501, 502, 511, 512, 518, 520, 521, 525, 526,528, 531, 535, 536, 539, 540, 544, 546, 550, 551, 555, 558,568, 571, 578, 581, 582, 587, 588, 590, 593, 598, 600: n = A,T,C or G
  misc_feature 601, 604, 605, 606, 607, 609, 612, 613, 615, 620, 621, 628,630, 636, 641, 644, 648, 650, 651, 652, 654, 656, 657, 659,663, 665, 672, 674, 675, 676, 679, 680, 682, 688, 689, 695,696, 698, 699, 700, 701, 702, 705, 716, 721, 725, 726: n = A,T,C or G
  misc_feature 727, 731, 734, 737, 743, 747, 753, 754, 755, 759, 763, 764,772, 773, 777, 778, 779, 781, 792, 802, 807, 810, 814, 826,827, 833, 834, 835, 837, 839, 857, 858, 860, 862, 869, 871,876, 877, 878, 879, 883, 886, 887, 888, 889, 891, 898: n = A,T,C or G
  misc_feature 909, 917, 922, 924, 925, 926, 928, 930, 931, 933: n = A,T,C or G
tgttttaaagccctntttngaatncntggcttncgnccccttggcaagatcnctctctgcaggatcccatcgattcgtttgtatttttagtagagacagggtttcttcatgttggtcaggctggtctnaaactcctaacctcgtgatccgcctgcctcgacctcccaaagtgctgggattacaggcatgagccaccatgcccagccaaagatcatttttttatatagacttcagncctttgtaaatattgtaactggggagtatagagtagaaaaaaagtatagntaaaacatttgttctacaaattaacctttaaaaatataattactgctaaaaatagagtgctgttacacttaaggaaaattagtgccattttggaaatgagatcttgtgccataaatncagctgaactgaatataaatgttcacaaattaatgctgtnaaaggaatgagttaagcagaaaaacttttaaccagcacttctcaaaaaanaaaannnannaattaaatnntataancnncatnnanatntatnntanntttncntctnnattncantaattttgtnttncaaatanttnnacctnnanctntgttntnnttnnnncnatnnantatcnntttatcnantatatnattanctnattntnnngnanngnatcntnctctatncnnnatnntncatatnncgtccnntnnnnnaantatgcctcatnatatntacnnnaaangtntangtatgnttantgcatnnncatnactnntgatgtcnnagtnnnanatattttgccnctcattattntgctnatntatntgtttgacacannatactnnnancnattcatcttctcgcaatnngngnacttttnanttacnnnnatgntannnntnatatatntatcattaganaccttttnaattntnnntncnnanacgcg

SEQ ID NO: 612 - DNA, 771 bp, Homo sapiens
  misc_feature 7, 10, 11, 12, 16, 18, 26, 28, 35, 36, 41, 46, 48, 52, 54,61, 66, 127, 619, 636, 653, 668, 680, 688, 693, 695, 726,731, 752, 766, 770: n = A,T,C or G
tgtttgnaannncggntnttgaaatncntggtacnnaaacnctttngnaaancncccctcnctgtntgatcccatcgattcgaattcggcacgagatagaaactaggcactgatttgtttatatttntcctgctcgagacacatgatgtttcatgtatctgtggctttttatagtttaaaataatttctggaaaagtcatagtcattatctctttaaccgctccctctcttccattctctttgttctctcttcctcgaactcctgttagtcatttgatcctccatatctctgaatatttttgtatttcttttattatttatttcttgtctctgctacattttacattgagtaaaagtgggatgtgacagtgggaaatcattagtgacttagaaattccagttggtcattgggccaattttgatgctaccttctctcttttatttctcacttcaaaataaaatttgcaaaaacaaaaaattaaatatagtatgagtccagttactggcctaaggagctaaaagcattctgggtttgtatgaagacagctgagttataacaaatgagagtactgttgtgtgactgcattaattattccctttttaaatgtacaagagcaangcattctacctgactgngttattgagctctgcancatacatggtgacanagctaaaacaanacaagccnaaccnanaaggaaaaccccagctttagggatactctgntcatngaatatagcctgaaaaatggntaatcaagaaagtnaacnt

SEQ ID NO: 613 - DNA, 774 bp, Homo sapiens
  misc_feature 22, 32, 43, 104, 177, 429, 453, 541, 550, 553, 582, 623,634, 648, 661, 665, 668, 673, 681, 684, 688, 695, 705, 708,717, 752, 754, 764: n = A,T,C or G
tttgaatccttgctttcaaatncttggcactngccctctctgnaggaatcccatcgattcgaattcggcacgaggtaacgtgacacgtattttacttcttttantaggcggacacactttcttaaagtaataatacgtcatggccctgctataaggtagtagttctagaagactgtntatctaataattcagactaaagctatttatattgctgtgacaccacgtggaaaacttttataattccatcttatttctgatgtatatgttttattttctctgccttcataagaactaaaaaccaaagttatttacgtgaaaacaagatttttgtttgagttcatttacttgagatatgtttaaaaaatccaccttctgtcacactatagaagtatattttgaattatcaaaaggtagaattataactttcanaaaagaaaaaaatggtcaatttantttaactctatgtcaaaaatttatttatagtctcatatattcattccacaccccccgttcttctttccttctttctccctctgccttnttcttaatnatnatttttaaattctgaccaaaaataaagtngtggcaagtactttcttagcataacctggactggttgaagnagtaattctgntcctttaaaaaaantccccaactgggncccnggncaggnacaaaaanttntaangaacatntgggaattangcnaaatggatnttccttggaggtccaacccccaaaaatcattaggncnaccaaaattnaaaataatcg

SEQ ID NO: 614 - DNA, 754 bp, Homo sapiens
  misc_feature 6, 14, 20, 24, 27, 33, 36, 41, 100, 102, 518, 596, 628, 646,679, 711, 728: n = A,T,C or G
ttggantcttctcngaaacncttngcnattgcnctntctgnaggatcccatcgattcgaattcggcacgaggttcttcaaagccaaccaagacaggcttntnagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctnaccagaggttcttcaaatcttatgcatagcaatccaaagttaaaagggtttgtgccactagctcgagaggaaatcaangaatggaaaaatgtgttgtaattggtctgcantctacaaggagaagctangaacatttagaaagctttggaaagaaggccggngggagaaattgaatgatttttggtttcaactnccaaaaggtgtgttgcnctcccttctttgaaaaaacattttct

SEQ ID NO: 615 - DNA, 774 bp, Homo sapiens
  misc_feature 6, 53, 58, 60, 312, 404, 521, 551, 578, 601, 620, 625, 644,669, 670, 683, 693, 697, 701, 705, 715, 721, 735, 738, 743,750, 761, 766, 767, 772: n = A,T,C or G
tgtttnaatgctgttttgaaatcttgtttcaaatcctttggctacttgctctntctgnangatcccatcgattcgaattcggcacgagggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtncatgatcagtttggtgttcttgtaccacagtttttaactgaaggaaccagttgtaacagtctcaatttttaactaaaacttgaagaactaanacaacaatgcaaacctttcagcattgtttggccaaacttgttaaaactgtaatgcaagaaccaaatgcactgtgatgtggcaccaactaattagcaagcatgaatttttcacccaanagtgaaaaaaggaaaatctaccatggcttnaagtttaagagcagaacttcctgactnccattctatgactgatcaaaaanactaatagtttaaaacctnagcangccttgttcacgatatgcngaaaaaaaaagtgcttgcagtttannatccttatggaantttttcacantgtnacanggtnttgtaatacnttggangccctacattttcntangaatntattttncttggcctaanttggnntcaangc

SEQ ID NO: 616 - DNA, 769 bp, Homo sapiens
  misc_feature 3, 4, 6, 13, 48, 516, 540, 554, 580, 589, 607, 613, 614,636, 658, 662, 666, 686, 690, 695, 697, 699, 715, 717, 724,725, 727, 735, 746, 752, 753, 755: n = A,T,C or G
atnncntttttgnaatcctctctgaaatcctttgctacttgctctttntgcaggatcccatcgattcggccagtcctcaccttccctagtcctcgtgtgtattttaggagatgcgtgggtgtggaacagcctcctgcctccggtccaggtgtactggggtctgtgtgttgtgtttctgcgtgttctcggcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaagcattccgaaagaagtttgtcattcctgattttgaggagttcacgggccatgtggatcgcatctttgaggatgtcaaanagcttactggaggcaaagtggcancctacatccccttnctggccaagtcaaacccagacctgtngggtgtctncctgtgcactggtggatngtcaanngcactcttgtgggccacacaanagattccctttttgcctgcaanaccntgtntgaaacccccttaacttatngccnatttncntnaagcaacccttaggcnanttgactnncnttcacaantttttggggcnaaaganncnaattggcctgccct

SEQ ID NO: 617 - DNA, 766 bp, Homo sapiens
  misc_feature 4, 5, 20, 21, 24, 30, 37, 46, 85, 91, 102, 331, 520, 529,561, 564, 584, 599, 606, 649, 655, 674, 675, 690, 694, 697,702, 704, 709, 715, 727, 731, 735, 736, 741, 746, 759, 760,764: n = A,T,C or G
aganntcttcctttctaatnnctngctacnttctctntctgcaggnatcccatcgattcgcttcctcaaagcatggttgctgagnacccanagttgcgaggngtttttttactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcanactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaagactctctgtgtngctggggtnctgactatagacccaccatatgggtccacaanaantgcagcatctctaatgaganttattcttgcccttngttcaangatcttattgaaaggacatcttacagcttttcccaatgagaangcccangaagtgttaaacatactgnnttgaaaaaagcactntatnttntcccntnttaanatggtntctaaaatgtanaaanaaannaaaanaaaanctcgatccctctnnaacnct

SEQ ID NO: 618 - DNA, 762 bp, Homo sapiens
  misc_feature 4, 5, 8, 9, 36, 44, 605, 618, 619, 620, 621, 624, 627, 630,633, 635, 636, 641, 646, 656, 661, 675, 685, 692, 699, 701,710, 723, 725, 736, 739, 751, 754, 755, 758: n = A,T,C or G
tttnnagnntcttcctttctaatggcttggctactngttctttntgcaggatcccatcgattcgctcagtgcagcgatcatggctcagtgcagcctcaaactcttgggctcaagcagtgctccaacctcagcctcctgagtagctaggactataggcacacagcaccatgccccggctatttttttattttgtagagatggggtctcactatgttgcccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggcttgaataaatttctatttctaaaaanaaaaaatataacnnnntanttnatnaantnnttaanaaaanaaaaactggnacctntaaaacttatagtngagtcgtttnaccgtanatcccanantttgataangatacattggatnanttttggacaanccncaactaggaatngcnntgnaaat

SEQ ID NO: 619 - DNA, 754 bp, Homo sapiens
  misc_feature 8, 23, 34, 36, 42, 450, 570, 590, 596, 602, 610, 616, 618,655, 658, 663, 704, 706, 722, 728, 746, 748, 752, 753: n = A,T,C or G
tttggagntctttctttctaatncttggctactngntctttntgcaggatcccatcgattcgaattcggcacgagcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcatgaaatagaaattggagaatctggttttgctttattattccctcaaattgaaggaatnaaaatacaaccctttcattttattaaggatccaaagaatttaacattagaaagacatcaacttcactgaagtaggtcttttagataacccctgaacttcgtgtggtcccttgtctttggntataaatgctgtaaggtggnagccantaattntctgcaanaagtangncagcacttttcagtgatttgaatatcatcttggcttngangccangtggacaaccttgtcataactgacttctgaaaagaaccctntngatatttgatgcctcnggtgtnggtggaactgtcatttantngganna

SEQ ID NO: 620 - DNA, 767 bp, Homo sapiens
  misc_feature 19, 131, 158, 159, 402, 512, 518, 529, 549, 559, 601, 606,635, 650, 652, 655, 656, 670, 687, 688, 690, 701, 706, 712,721, 724, 732, 733, 738, 752, 754, 758, 763, 767: n = A,T,C or G
gcgttctttgaaagccctnttttgaaaggcttgcttctaattacgggaaacctttgcaactgcagatcccatcgattcgaattcggcacgaggacccaggtagaccagctcaagagttcatgttctttgtnatcctcctgtgagctctctgtaagtcnntttcttgcccatcaccacatccctagtactgggtatcagtctggccacttggctttctggtttgccccaatgtggtctattcttgatgcagctaccaaagtaatgttttaaaaccattataccaagttactatccttgtcaaaacccccagtaactgccaatctcacttagaataaaatccggactcctgtgaagcacagcataaactggccactgcctatgcagcaacctcatctttaccgnttcctgccttgctcactcccttccagcgccgttattcttcctgatgcccctagtacacaacaactccttcctgctccaagagtaggaaaattactggtctctctgccagngagaancctcttctggnattacctttgcttcattgcngaatcttctncaatatcatcttctaaaaagagccttttaaaaatcacctttnctatnatgccctactcatttccagtccctgaaanggccattcccacttnantannacttattgctaacntgaaatacactaaatgnnanccttcatgaanggtanggcaanttaaatgcnttngcactggnnaggcnaagagaacaagcancntggnttcanaagn

SEQ ID NO: 621 - DNA, 828 bp, Homo sapiens
  misc_feature 24, 27, 30, 37, 46, 71, 105, 122, 148, 227, 229, 248, 266,267, 270, 276, 340, 370, 373, 384, 415, 421, 439, 441, 458,468, 475, 478, 486, 504, 505, 509, 514, 538, 539, 554, 571,576, 579, 582, 585, 596, 602, 622, 640, 645, 646, 647: n = A,T,C or G
  misc_feature 649, 650, 663, 664, 665, 666, 670, 671, 678, 679, 684, 686,687, 697, 707, 710, 716, 719, 722, 727, 728, 733, 734, 740,741, 748, 749, 750, 754, 768, 773, 776, 784, 788, 790, 793,800, 812, 813, 815, 816, 819, 820, 824, 825, 828: n = A,T,C or G
tttctaatagcttgctttctaatnctnggnaacgctnggtctctgnaggatccctcgattcgaattcggcncgaggggtgacagagtgaaactcgtatctccaancaaacaaacaaaaagtncttaaacatatgtgaacaaaaatttngtgatggaaggattctagttaatgagtattgcatcaagatttacatctttcttactaaggaaaagagttaataaaaatngntctttattttacaggcagntactgaggctcttcccanntcncagtanacagccactcagccttgaaaatggagtgttgttgtttctaaacatatatttatgtcatttattnaggtacagttcacttaaataaccataagtngantctctcttgtnagtgatttgggtaggaagaggccatgtctanagttcnatttctctgttgggtccnantgaaattggaccttttnagttgttcanaaaaatnaanataaattnctcatattaaatcaagannctcntcaanttatagatgtggggtagggttccnngtaaaacccattatnaatctagaaaattatcnctatnganaangcntttaatatctnttaccntgaaattcattactttagtncaaggcctacctttaaangtttnnncnngaaccatttttannnnttcnncttttgnnccaananntcattttaanccaccaaaantcncaattnttnttncattnnaatannggatgnnaattatnnnatcnatgtgtcatatttnaccanganaatactgngctncntgnaataatnggtacactaaanncnnganntttnntcn

SEQ ID NO: 622 - DNA, 784 bp, Homo sapiens
  misc_feature 23, 37, 44, 49, 50, 56, 63, 64, 118, 396, 444, 496, 520,539, 543, 551, 572, 600, 604, 642, 651, 661, 662, 664, 667,670, 674, 681, 683, 687, 688, 689, 692, 693, 694, 698, 700,705, 706, 708, 714, 715, 716, 719, 720, 721, 725, 726: n = A,T,C or G
  misc_feature 730, 732, 733, 734, 738, 741, 743, 750, 752, 755, 757, 768,770, 772, 776: n = A,T,C or G
gtctttgaaacctttttctaatncttgctttctaatncttggcnactcnnctctcnctgcagnncccatcgattcgtttgctttcagtggttggctttcactgaaagaaagtgtaaanaaagtcagaatttatagctttcactatgtccaagactaggactgggttataaagattttcttttgtgaaggaaaataaaagaaaatttgccactactgcatttactttactattgtaaacttaagattcattccttagtctttggaattttgatgtctcaaaaccagatgagtggaagtgctgaatttgcaaaataaagctaagaatgcttaactctgcactttaagttctactctgaccaaattgaagatgagcagagcagccctgaacagcatttngtttatacagtcttgtttaagaatagaatttttttaactcttcatttnttgtctctgtggaagctgtgtaactctttttaaaatgcaatttaaaacattntggtattctaacaattctctcaanaaacagcatttccaatggnaatnggtattgntacgctgtaccttatgtattncctgtacctgaacacttgatgctgcctnacangaaaatagaactttatgttaaaaaataaaagtctggtncttctttgnaaaaacaacnncnctnctnctcnaaatccncnacannnctnnnaatntnctaanntnagtctnnnttnnngcanncttntnnncccnctnanctccctntntcntnttcatatctanantnacanccctccct

SEQ ID NO: 623 - DNA, 1164 bp, Homo sapiens
  misc_feature 8, 12, 16, 29, 32, 38, 47, 54, 57, 58, 61, 68, 95, 98, 103,104, 109, 116, 119, 125, 131, 133, 136, 137, 141, 143, 148,156, 157, 161, 164, 165, 166, 169, 177, 179, 181, 185, 187,190, 194, 196, 198, 199, 205, 206, 208, 211, 212, 213: n = A,T,C or G
  misc_feature 216, 224, 226, 234, 236, 238, 240, 241, 243, 245, 249, 250,251, 253, 254, 256, 257, 275, 281, 284, 296, 298, 299, 302,303, 304, 309, 310, 316, 322, 324, 325, 327, 331, 332, 345,349, 351, 352, 353, 354, 360, 362, 364, 367, 370, 377: n = A,T,C or G
  misc_feature 379, 380, 386, 389, 392, 394, 395, 401, 404, 407, 409, 415,423, 424, 426, 430, 433, 437, 439, 442, 450, 452, 458, 459,460, 463, 464, 473, 475, 476, 478, 481, 482, 484, 487, 503,509, 510, 514, 515, 518, 525, 527, 530, 533, 535, 541: n = A,T,C or G
  misc_feature 554, 562, 564, 566, 574, 576, 588, 592, 596, 597, 603, 606,609, 612, 616, 618, 620, 621, 623, 624, 626, 627, 631, 636,642, 645, 647, 648, 649, 653, 654, 658, 661, 662, 666, 669,671, 674, 683, 687, 690, 700, 701, 709, 711, 712, 714: n = A,T,C or G
  misc_feature 721, 726, 727, 728, 731, 737, 739, 743, 746, 752, 759, 760,762, 764, 768, 769, 782, 783, 785, 787, 808, 812, 816, 817,826, 827, 828, 833, 855, 860, 864, 867, 873, 876, 878, 880,887, 895, 896, 897, 898, 901, 913, 915, 927, 928, 936: n = A,T,C or G
  misc_feature 943, 958, 959, 966, 972, 980, 984, 986, 992, 1001, 1002,1007, 1009, 1013, 1021, 1026, 1031, 1032, 1034, 1036, 1053,1054, 1057, 1059, 1061, 1066, 1067, 1072, 1074, 1080, 1083,1086, 1088, 1095, 1096, 1097, 1098, 1100, 1103, 1104: n = A,T,C or G
gggacttnttangccnttttcgaaatccnttncttccnaatcccttngcaactntcnnctntctgcangatcccatcgattcgaattcggcacgnagngagcnnattcncgttttnagngttctntttctntnatnnacangngaaanttccaggnnatcntgnnnccntatctgantnangctngnttnaacntngnnacaccnngnctnnnaancaaatttnanaaaagggnancncnnanancatnnnanntnnccaatctaccaaaatcanaacacncantgaacaacacanannatnnnatacnntctacnccaaancnncncatnncacgcacgataanacancnnnnaaaaanancnaancanatatcananncaaccntanacnannaatcanacnctnanctcccncacagcanngngacnaanaacnancantgataaancncacctnnntannacacacctnannanccnntntantcccgaataaccaatngccacnnctannccnataacanantcnctnanccctcntgcatcaaattantaaattcncnancataaagnanatcacagcctcnttcnaccnntgatcnaanctntanaccnangnnanncnntatnaaacnctatancantnnnactnnaacnttnnatcngcncntanaaattaaanatcnaanactcaatatnncggaatantnncntctctanataannntanaacggngnaaanacncctcanacataanngncntacnnatcgatctatcanntnancataaagtcacccgcatattnaccnacgnncaacataannnaaatnctactctcagaccatataaatntcgcntccntanatcagngcnanantacaaanacgtcgcnnnngtntggaccacacgncntagataaacacnnataaacantttttanatgtaacacatttcnnatctatnaaatancatcattnatgnanacgatnacaacaaannctacncnatgntactaaanacaantaaanntnanattaaaaaagttgcaannatncngngaaanntcccnanaaacantanatncntatttannnntnacnncggngtnnccntaaaaanaactctnnnntnnctggnttgtanatntannncnanctcgcg

SEQ ID NO: 624 - DNA, 798 bp, Homo sapiens
  misc_feature 12, 18, 21, 32, 43, 55, 63, 395, 398, 408, 516, 561, 572,582, 586, 612, 636, 651, 657, 670, 673, 684, 691, 704, 719,720, 723, 729, 732, 733, 737, 745, 750, 753, 754, 755, 758,759, 765, 767, 768, 769, 771, 773, 778, 784, 792, 793: n = A,T,C or G
  misc_feature 797: n = A,T,C or G
ttgttaagcctnttttcnaantccttcctttnaaatcttttgnaaaccttggtanttgcaggnatcccatcgattcgagtaaagcatcctgcctcagaatgactttcctatcatgctttatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggnttntatatagctnggcactttattactcttttgaactgaaagcacactcccttataggttcatgtaactgtcctgtaataaggtgcttataaatgggaacaactacacagcctagttttgncacaacctttagcatctaaaaaagttttaaaagcttcttaaatgnctaatataaanggagatgctnatanccacaacatctattttaccaatattngtttccttacacttaccttgggantttgcattgagtgangttttngtaaaccccaaanatncccattaatanaaaaaanttggtacgttttnatgactttaatccannttncttgtnggnnttcncctaaaangcttnccnnnggnntggaantnnnantnatttntggggnaaggtttnngttnt

SEQ ID NO: 625 - DNA, 793 bp, Homo sapiens
  misc_feature 11, 31, 42, 45, 55, 57, 108, 513, 524, 539, 579, 585, 593,610, 620, 623, 643, 650, 662, 683, 688, 706, 708, 745, 747,760, 774, 785, 786, 793: n = A,T,C or G
ttcttaagccncttttctaatgcttgctttnaaatcttttgnaancgctcggctntntgcaggatcccatccgattcgaattcggcacgaggaaatgcctctatgtangtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaaccccatagggtgtacaaaaggttctataaaatctgcattatagagacaaagangcaggcaaatncatgtcacaagggtnaagcttacagtttacaaactggggaacgcccagggtgtangatttnaaaaacgncactcttgagaaaacanatgtaatcanggntgctgaaaactttgcatggnggctttnaagacatttagnccttgttcaaaccaaaatttnttggnatttgccagattccttantnttgccatgggccatgacaccatttttggcctttatgncnctttaaaattttnaattaaaaataccntttccagtaannctaattn

SEQ ID NO: 626 - DNA, 825 bp, Homo sapiens
  misc_feature 1, 9, 16, 25, 34, 36, 49, 57, 59, 64, 66, 89, 120, 122, 135,155, 156, 161, 170, 172, 176, 178, 179, 180, 186, 187, 190,198, 216, 222, 226, 241, 276, 277, 283, 286, 288, 295, 296,299, 306, 311, 312, 323, 331, 352, 354, 375, 395: n = A,T,C or G
  misc_feature 401, 402, 473, 482, 494, 496, 522, 525, 545, 564, 567, 569,570, 574, 575, 576, 581, 583, 593, 599, 602, 604, 605, 608,610, 612, 616, 619, 623, 634, 635, 637, 638, 640, 641, 644,648, 652, 653, 657, 659, 662, 669, 670, 682, 685, 686: n = A,T,C or G
  misc_feature 689, 690, 693, 694, 698, 699, 700, 710, 711, 717, 718, 719,720, 723, 725, 727, 734, 737, 745, 747, 753, 754, 755, 759,762, 764, 765, 774, 777, 778, 784, 785, 787, 792, 793, 795,799, 801, 802, 804, 806, 811, 812, 820, 824, 825: n = A,T,C or G
ntttgaatncctttgnaaatccttntttctaatntntggatccttggcnactcgctntntctgnangatcccatcgattcgaaacggcnctaggaatcatcgaaggttgagaccgtgacnanttacatagtgatnaatacccatctatgtactgnngcctnctaaatgtntntctncnnnatggannttncctttaanctctagatccattgacancctgancatntctaaaaggcattangaaactgaacacatctgatacagaactctgcattnncttccnaantntgcccannccnagcctgntcctnnttcacgcttancacttatnatatgatcccactattcactnantctctgaagcttaaaacctangattcatgcttgactactgnataatnntacaatctactcctaatgcattagcaattcttgctagctctaccttcaaaatatattctgaatagactatntcttgccgnttcccttgcctncncatttcccatctgcaccccttctctnctncccaaaatcaatacactagntgtttctaaaaaaaatatngananntagnnnaaaancntaaataaatntaaaanaangnntancntnacanaanattnctaatataggnnanntnntgncaanaacnntaantnttnaatacgnnaaaactctctcnaanngannaanntatnnnagttaaaagnnaaatannnnaanantnccaaatntanaagataangncataannntatnagncnnaacgctaantgnngatganntntaatnngnatanannantngttannacaaaatntacnn

SEQ ID NO: 627 - DNA, 772 bp, Homo sapiens
  misc_feature 13, 18, 30, 36, 39, 47, 50, 67, 104, 142, 208, 220, 224,242, 262, 327, 361, 472, 481, 513, 536, 577, 581, 601, 603,606, 628, 631, 634, 635, 637, 641, 644, 647, 649, 651, 652,663, 686, 692, 700, 703, 704, 706, 708, 715, 717, 721: n = A,T,C or G
  misc_feature 723, 744, 752, 753, 767: n = A,T,C or G
tttttaatgcttngtcgnacttctcccagnaatcgnttngaaactcngcnactcgttctctctgcangatcccatcgattcggaaatttgcactgatggctcanaaggcttacgttttggagagtatgacctacctcacagnagggatgctggaccaacctggctttcccgactgctccatcgaggcagccatggtgaaggtgttcanctccgaggccgnctgncagtgtgtgagtgaggcnctgcagatcctcgggggctngggctacacaagggactatccgtacgagcgcatactgcgtgacacccgcatcctactcatcttcnagggaaccaatgagattctccggatgtacatcgncctgacgggtctgcagcatgccggccgcatcctgactaccaggatccatgagcttaaacaggccaaagtgagcacagtcatggataccgttggccggaggcttcgggactncctgggccnaactgtggacctggggctgacaggcaaccatngagttgtgcaccccagtcttgcngacagtgccaacaaatttgaggagaacacctactgctttanctcngaccgtgagacacttgctgntnccntttggcaaagaccatcatggangancanntnggtnctnaancngnntggccaacatnctcatcaacctgtattggcatgnaccgcncttgctgnacnncngngccaaancnctcnantccgccattggggcttccggnaaccactnnacaccaaggttctnttggc

SEQ ID NO: 628 - DNA, 808 bp, Homo sapiens
  misc_feature 3, 8, 12, 16, 18, 19, 32, 93, 142, 178, 187, 201, 207, 218,219, 224, 227, 287, 289, 296, 297, 298, 311, 321, 326, 368,375, 413, 414, 422, 428, 439, 445, 447, 471, 484, 487, 491,505, 506, 507, 518, 522, 562, 580, 605, 607, 613, 616: n = A,T,C or G
  misc_feature 617, 621, 631, 639, 647, 653, 660, 661, 664, 669, 673, 675,676, 677, 680, 682, 683, 686, 687, 688, 697, 702, 719, 724,725, 727, 729, 734, 739, 746, 762, 764, 765, 771, 775, 779,781, 788, 800: n = A,T,C or G
tcnctcgnaacntttnanncttggctactcgntctctctgcaggatcccatcgattcgaattcggcacgagatgacatcctcattatccacantgcaaagccaaccatccctatgatgggttcattgtggatcatgacttantgggtcaagagtttggaagtggctcagctgggcggncttctgctncatgtggctgccanatggtnccctgctggtnngcagnctngtctagagggtccatgatggctttactcacatgcctggcatcttgacagggacagctggnangcaaagnnnatctgggactgtncacagagctncttcntgtggcctttccagcatggtggtctaagggtagctggacttnctgcatnacagctcagggctcccagagctactgtcccaagagatnnaaagtggnaactgncaatcttttangctaangnccagaaaccattacccctgcaccncacagtctttttntanctgntgaaataaacattnnntttatcaattntaancattcgcaaattggaattaaataccttttactaattttgncgtgaccatctgcccctngttcaagatctaaaaaacttttatngntcatcntgnngatntaaaaaactnttgtgttngcatttanaacccntaagcannttnggcanttanannnaanannttnnnaaacccttntatanaaccttattaagttgangcatnngnantttcnccttnaaatccnaggtccttagggctangnnataccnttcntatngnaactttngggaacctaaancctctcct

SEQ ID NO: 629 - DNA, 827 bp, Homo sapiens
  misc_feature 5, 6, 18, 27, 41, 49, 51, 53, 101, 104, 106, 113, 116, 119,127, 134, 137, 143, 144, 150, 152, 155, 157, 164, 166, 167,184, 185, 189, 193, 194, 196, 208, 214, 217, 219, 224, 232,239, 241, 247, 250, 253, 263, 272, 273, 279, 281, 286: n = A,T,C or G
  misc_feature 288, 294, 295, 305, 316, 317, 323, 324, 326, 334, 346, 357,367, 375, 376, 379, 381, 384, 386, 388, 390, 391, 394, 398,402, 404, 405, 406, 412, 413, 414, 415, 417, 425, 426, 429,434, 435, 437, 439, 447, 449, 450, 457, 458, 464, 469: n = A,T,C or G
  misc_feature 477, 479, 483, 484, 485, 486, 489, 490, 492, 493, 495, 496,510, 511, 512, 517, 524, 529, 533, 535, 536, 543, 545, 546,548, 552, 553, 556, 560, 567, 572, 574, 575, 582, 584, 588,590, 592, 596, 597, 600, 606, 610, 612, 613, 616, 621: n = A,T,C or G
  misc_feature 622, 631, 640, 642, 646, 648, 649, 658, 661, 669, 671, 672,675, 676, 683, 696, 697, 706, 709, 710, 712, 720, 729, 730,731, 733, 735, 736, 738, 741, 742, 749, 754, 767, 772, 785,789, 792, 794, 797, 798, 801, 802, 803, 806, 807, 809: n = A,T,C or G
  misc_feature 810: n = A,T,C or G
ggccnnctttgaaccttnttcaaatcntttggcactcgccnctctctgntngntcccatcgattcgctgtgatccaaggcatgaaaagagtgcaaggtaancangnggcagcnttnatngaagcatnaaataangcnaaagcnnatgctnanctnanggagcangnngctaaagacaaccacannctanctgnntnctaatcatgctntgcttnctnangtgancttatagnaacgcantnagactncangcnttgcttggcncaacaaggnnacctanantcatnangaagcnnttgaactaangagtggctacnncctttnntnctcatgcntgacctgtaatnattcttctganttgaggcaanagcgggtnnaantnatngntnanntgnaaanactntnnnatccgnnnntnctgattannttncattnntntnaatgatanannctcatcnngctcgncctgnactttganangctnnnntcnnanntnnctgactttaggagnnnacctncagcganatgtnaagnanngaaattnanntncctnncgntccnccttgcngactnanngtcttgngnaacntnangtanntantctacngggngnnacnttggnnaattggggncttataaantnttcntnnaagaatgantgnaccaattntnnaanntctaagnttggggaaatctnngtttcctgnatnngnacaaaaantcgatttannngncnngnttnnttgggcntcatntgccattgatgcnattcnacttatgtcctcntggngcntnttnnaannnggnngnnaacattttttgtgtgcc

SEQ ID NO: 630 - DNA, 793 bp, Homo sapiens
  misc_feature 4, 14, 16, 17, 24, 34, 44, 45, 59, 101, 117, 118, 121, 126,130, 131, 135, 151, 157, 158, 164, 174, 192, 205, 215, 220,224, 225, 228, 233, 237, 244, 245, 246, 249, 257, 259, 260,264, 271, 278, 279, 282, 284, 290, 309, 312, 317, 321: n = A,T,C or G
  misc_feature 331, 333, 340, 350, 355, 356, 358, 365, 372, 373, 386, 389,397, 409, 417, 421, 432, 435, 441, 445, 456, 460, 495, 498,518, 527, 531, 541, 544, 550, 557, 582, 586, 587, 588, 590,595, 598, 602, 604, 609, 616, 619, 622, 630, 639, 640: n = A,T,C or G
  misc_feature 643, 652, 667, 669, 677, 678, 687, 690, 703, 704, 707, 709,726, 728, 730, 731, 734, 735, 738, 739, 743, 745, 746, 749,750, 754, 756, 763, 766, 770, 775, 789: n = A,T,C or G
ttcnaatgcttggncnngagtccncctttgaacnttttcaaatnncttggcaactcgcnctctctgcatgatcccatcgattcgaattcggcacgaggcgngttgttctacactgcnntcngaagntttnntaanaagccaccacttagcngaggcnnctacangtcttggggncttagcgaagagaaatcncgctggcacttgncccgttcacntaagnactnntgnctgantccnagggtannngtncaccttgngnnccancagacanacccaanntgncntaaaangggcaggtctaagcttacnctngactncacnggcaagctgnangcctgtnctgccttccnctgcnntnacaaatngacagtnngaccaagagtcanagnaaaaactncaaggatacatntatcccantctnttctacacctntanattccntganctattgctcanaccnatcgtgcgggcaaaggcaagacttgggcaacattnttnaatacaatgatgctgacaantaatttccngctngttgccaggnatntttacncgagctnttgtgattccaaactaaagaatggngccnnnangcccntcnttantnctggncccccanaangancctaactngcgaaaggnnagnatggcattnacccaaaccaacttntnggattacnncaactccanaanatccgacggcatnnaanangcaaaacaacaacttcncnannatnnaannaatngnnccnnaaananaacccgngcntctnaaacnattgtggacccatncccc

SEQ ID NO: 631 - DNA, 752 bp, Homo sapiens
  misc_feature 2, 6, 7, 12, 15, 21, 23, 34, 37, 39, 53, 55, 113, 534, 572,584, 602, 615, 650, 665, 727, 743, 751: n = A,T,C or G
gnagtnnccttngancctctntnaaatcgctttngcnantcgcctctttctgntngatcccatcgattcgaattcggcacgagatgttacagacatgaaatatgaacagaatnctaaaagaacataaaagaataagagctccttaaagattataaataaatggtgatgttaaagtaatagcaccattggacgaagctagggaatcaacacttgacagaaagatacatattttttttatacaaactacatatatttgagcaatcaagtagtagacatagagaattttctttttatggaagtactctaataagtaaagggctgatagaattatatcagcattttctagctcctggtgaattatgcattgggcatccatggctgccttagatcacaaaaataccaccagatatatgcctgtggatgaaagatcacaccaccacctgtgaaatagtcttccccacaaaaaatccaacccaaatcctatccagcctgtagatggtactcgagatcttctataagaaataaagagagcangctggtcacggtggattgtgcctgtaatcccagcactntgggaggccaangcaggtggatcgcctgangtaaagaagttcnagaccagcctgccaacatggtgaaacccccctctntacttaaaagtaccnaggatgagcccggccgttgtggcaagcacctgtggtccccagctacttgggaagctgagcangaaaaatcgcttgaanctggggang

SEQ ID NO: 632 - DNA, 751 bp, Homo sapiens
  misc_feature 2, 3, 4, 5, 6, 7, 10, 11, 12, 13, 14, 15, 42, 549, 685, 697,723, 725, 726, 733, 735, 747, 749: n = A,T,C or G
gnnnnnnttnnnnnnttctaatgcttggctactcgttctttntgcaggatcccatcgattcgcaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcantggctcacgcctgtaatcccagcactttgggaggccaaggtgggtggatcacctgaggtcaaggagctcgagaccagcctggccaacatggtgaaaccccattcttttcttaaaaataccaaaaaatttagcccangtgttgaatggntgcatgcctgtaattcccagcttctnanntaggctnanacaaggagcttncntt

SEQ ID NO: 633 - DNA, 806 bp, Homo sapiens
  misc_feature 3, 4, 6, 7, 8, 10, 15, 25, 26, 27, 28, 33, 34, 40, 55, 57,68, 93, 383, 455, 465, 492, 513, 518, 569, 592, 624, 644,668, 670, 676, 680, 690, 709, 716, 722, 725, 734, 740, 747,750, 753, 769, 779, 782, 792, 802, 805: n = A,T,C or G
ttnnannncnttttnaaaaggcctnnnnttgannctttcnaatgcttggctactngntctttctgcangatcccatcgattcgaattcggctntagggaaggggagggttggtgagtcccagaccttaaaaatacaaggttaagagggaccccaaagcaaaaaattccaacccttttcctcccagtcattgaaacaccaaaactattataccggagggtgtaatagttttgctgcccagttgtggtaggccagtagtggcctcccaagatgcccatgtcctaatcccaggaacctgtcaaaattaccttgtatggccaaaggggctttgcagatgtaatgaagttaaggatctttcgccaggaagattatcccagcttgtcangagggcttgatgtcctcacccgggtctgtataacagaagagcaggtgacgggagaggaggttggaggtgtancgatggacangaaactggagttataggagggcagctnaagccacagaatccaggccancttangagcccaggaaaatgcatttctttccacaaaagcccttggaaggccccaanccctgcttcccacccttggactnggcttcaatgaggcttaatttttataaattcntggcttgattttagaactcntaaggggaaataaattttgtgttngntttaantcanaaaataaatnaattaaaaaaaacttgaancctttanaaactntantggaattcntattancttaaanccnaancttggattaaaggatncatttgtttnaanttttgggacnaacccccaanttnt

SEQ ID NO: 634 - DNA, 775 bp, Homo sapiens
  misc_feature 1, 14, 25, 35, 37, 39, 42, 131, 132, 138, 479, 518, 538,539, 540, 547, 582, 592, 620, 665, 666, 677, 679, 680, 689,696, 699, 702, 704, 710, 752, 769: n = A,T,C or G
ngggacttcgcctnacgaaccgctnggaaatcccntntntgnaggatcccatcgattcgaattcggcacgagtataaactttattttattctcttctggttttgtgttacatgacaagaaattgaattaanncaatanaattttagttcgggttgcttaggtttttactgctcccattcttgcttttactaatttatccaagattagatgtgattactatttaataataatttagtcctcacacttacaaaccacttacaataccagcatgcttctatcactgtaattctattcaattctcaggcccatgaggcatgccagccagacgaccagacagcatttatagagtgggcactcaataccagccacaaaagatcctgtgtcagaaggggaaacaggcttggaggcttggagtatgtcgtgatagcctccctccagtccacacaactggtactgctggggctgaaactagaactcangcctatgcctctcaagctcaagggtcggatgtccatgtncttcgcctctagaactatannngagtcgnaattacgtagatccaagacatgggtaagatacatnggatgagttnggaccaacccaccaacctaagaatgcantggaaaaaaatgcttaatttggtgaaaaatttgtgatggctattnngcttaaatttngnnaaccatttnataaagnctngcnantaaaanaaaggtttaaccaacccaaccaattggcaattccatttcaanggtttcaagggtccaangggggg

SEQ ID NO: 635 - DNA, 784 bp, Homo sapiens
  misc_feature 6, 12, 17, 26, 30, 38, 48, 50, 53, 333, 360, 377, 405, 425,452, 473, 523, 543, 552, 559, 560, 568, 604, 624, 626, 631,637, 648, 649, 651, 659, 660, 665, 669, 678, 691, 694, 697,698, 704, 708, 717, 727, 737, 740, 743, 747, 769, 776: n = A,T,C or G
  misc_feature 784: n = A,T,C or G
ttgagngtcctnctttnaccctttcnaatngcttggcnactcgctctntntgnaggcatcccatcgattcgaattcggcacgagatatagctctggaggtcaggacataggagatattgattcaggacttgccagagtatggtcttggggtgtgccctgatattacaaacagggatcttagtggctaggtgatgaggccatggcaaatgtagatggaccaagatcaatttgcctttctagatgaggttttctaggtgaaatgtttttgaaactattttgtagcctagtataatttataaaagtagagagaaactataaatataaatttggaangggttagctaaaaggagaaaacagcanaatcttcatatatatanaaatggatattaatttgctagaattaanagactgcaggtaaagatagntttttttaatacctctttttgctgtanaaaggacaggattaaatgatnaagggatgctggaatgaggaatggtaactttaggcaagatagtcttctgngacggctgatatgaacaatngagagtaanacatttnnaatacaanaaattgtcctgctgctcacccatcaagccttttcangtttcttcccttgccaaaantngtaanaacttntggtacttttnnancttgtatnnttccngttnattggttanaaccccttcgatnaanaannccatantttnaatttgggnttgacccccnaggttaaaanttnccntttnctcaatttccccttttcaaagntttaacntaattaan

SEQ ID NO: 636 - DNA, 765 bp, Homo sapiens
  misc_feature 3, 4, 6, 7, 13, 17, 24, 397, 436, 486, 520, 574, 580, 614,619, 624, 653, 657, 663, 677, 682, 690, 716, 720, 725, 726,728, 738, 751, 755, 764, 765: n = A,T,C or G
ttnnannctttcnaatncttggcnactcgttctttctgcaggatcccatcgattcgtcctgcgcaggagccgcagggccgtaggcagccatggcgcccagccggaatggcatggtcttgaagccccacttccacaaggactggcagcggcgcgtggccacgtggttcaaccagccggcccggaagatccgcagacgtaaggcccggcaagccaaggcgcgccgcatcgctccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcnggaacaagtccacggagtccctgcaggccaacgtgcagnggcttgaaggagtaccgctccaaactcatcctcttcccaggaagccctcngcccccaagaagggaagacaagttcttgctgaangaacttgaaacttggcccacccaactgaaccgggacccggtcatgcccgttccnggaaangtctattataaaggagaaagcttcgagtcatcanttganggaanaagaagaatttcaaaagccttcgcttatnttcngtattngcccgtgccaaacnccccngctttttnggcttaccggccaaaaagaagccaanggangcccnnanaacagggatnttgaaaaagaaanaatnaaaccctcnn

SEQ ID NO: 637 - DNA, 853 bp, Homo sapiens
  misc_feature 8, 11, 20, 21, 37, 44, 57, 79, 104, 245, 424, 506, 509, 609,628, 637, 647, 653, 678, 682, 687, 700, 703, 711, 731, 735,744, 751, 754, 760, 764, 765, 773, 775, 792, 804, 820, 825,827, 831, 841, 847, 852: n = A,T,C or G
ttttgganccnttctttgannctttctaatgctgggntactcgntctctctgcaggntcccatcgattcgaattcggcncgaggatcagcccacctcggcctcncaaagtgctgggattacaggcgtgagccaccttgcccagcccacatcatacagtttgaaatgaaactttgccacaaccagcctttgctgtagcacacacatatatcactgaacctgtttgaaataaagttttttttctttntcctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattangcagtcaaaaaaaccaagcaagcataaaaggtcaataagttgtaatcttgatagtaaaggtggaaaacttattataaatggnaangaaagttttatttccttttttgtttgaatgggcaagtatgccatattatacccaaaagttcttttaaaaaaatatttcccattcaacccatttttaattnaaaattaaaaccattttgnaagggaaantttacccaanggcaanccttttttttcctccaaaaaggttnaccntgttnatccttctttttnggnaaatttanccaccaatttttttaaaggngggncaatggggnttaaaantanccctgnaagnnattttttnanccttccaggtttaaaantccccttggatngggtcttaacctgggngggtngnatanaaaaaaatanatcctntttanc

SEQ ID NO: 638 - DNA, 740 bp, Homo sapiens
  misc_feature 2, 6, 12, 643, 650, 664, 708, 709, 717, 726: n = A,T,C or G
anttgntctttntgcaggatcccatcgattcgcagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagggagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttccctgcaaggagtgtggcaaagtcttcttcaagatcaaaagccgaaatgcacacatgaaaacttacangcagcangaggaacaacagangcaaaaaggcttaaaaaggcggtttttcagctgaaatggcaccnncaattganaggactacngggccccgtggggg

SEQ ID NO: 639 - DNA, 774 bp, Homo sapiens
  misc_feature 5, 6, 9, 68, 70, 83, 90, 98, 99, 101, 103, 118, 119, 120,146, 147, 153, 155, 158, 178, 222, 233, 239, 258, 263, 269,273, 284, 288, 290, 291, 292, 298, 303, 328, 346, 348, 350,354, 355, 356, 359, 394, 403, 406, 407, 417, 426, 430: n = A,T,C or G
  misc_feature 431, 463, 481, 499, 519, 536, 589, 608, 610, 617, 619, 630,646, 647, 651, 659, 660, 663, 664, 666, 678, 679, 684, 687,694, 715, 727, 728, 734, 735, 736, 756, 769: n = A,T,C or G
ttttnnctnttaatcaatcctttgttgactccttggctacttgttctttttgcaggatcccatcgatncnaattcggcacgangtgatgncagattgnnantncactaaactgggcannncatcaggatcacctgtgggccttcannaatcananatncacccccaggccatgccctngacccagtgcaccaggacaagaaatccaccccaggcctctcccnagacccactgnaccagnacaagaaatccacccccangccangccccntacncactgccctangatntnnnggtgtnaaccnggtggtgctttgtaaagacgtgcangtggtaaccccacgccgncncnctcnnnacnttggacacatgatcatccacgtgtctgtgatttgnttcctcggnttnntttgtgaatngaaaataantgtnncgtttgactagggtttaagagcagcaggcagnccctcagctcagcaagcngccctctcagctcagcangcagcccaagtctcctgtangacttctatggaccatnctggcgggaatgaagaaactggtcaagctggattcgggactgaaagtgtaccntggtgacaccgtatgactnanctgactnanaaagatcactnatctttccacacttgnngggnaggagccnntannangttcaatatgcnntggtngantcccatngctacaatttcatggacacantttgattacttnngataannnaggcccttggaggccccttntccccttttaacnggaat

SEQ ID NO: 640 - DNA, 743 bp, Homo sapiens
  misc_feature 3, 4, 5, 18, 24, 32, 33, 37, 38, 118, 145, 157, 166, 175,176, 179, 181, 182, 185, 186, 187, 202, 221, 223, 224, 226,228, 229, 236, 239, 245, 247, 255, 256, 258, 267, 269, 271,274, 279, 282, 287, 288, 294, 300, 312, 319, 343, 356: n = A,T,C or G
  misc_feature 366, 368, 390, 412, 419, 422, 428, 429, 435, 454, 456, 457,461, 463, 468, 469, 471, 485, 486, 491, 493, 499, 500, 504,506, 512, 538, 544, 547, 562, 566, 570, 583, 588, 625, 643,646, 658, 659, 665, 677, 699, 706, 708, 709, 713, 727: n = A,T,C or G
  misc_feature 735, 741, 743: n = A,T,C or G
ctnnncctccttgatccnttcctnctttgaanncatnngctacttgttctttttgcaggatcccatcgattcgaattcggcacgaggctgacctacatcagaagctgctggatgcagnaaagtgaaaacagaccaaaacaacacngggcgaatcttnacaccattntgggtgccnnatntnnccnnngatatttgcttgctnagctctactcctccaaganannangnntcaaacnctncagcangntagagcanntnaagaccgcntntnctnacctnctnaagannctctgngaggancgcaatcctttngtggaanatagaatcaacagaccacactgcnctctggaccatgngctctcaaangngctagaaggtgctgaccttttnagactcttgcagaagaggcgangtggtgnganaccctnnaggaanactttcccgaactagaccncnncttncngaacnngntcaactgttggggnngaaancntgtganntgtngnccttcngagagacggcatattctatgatggcngacttnatncttctgcggaaccanactngacntactgaaagaaanctganaccaagcgtcttccttaaggacccttatatccagacnatcctttggataataccnctnggccaaaacctnntaactntgcatacaatcnggatggcaacatttgaactggnggccttnannaccnttaccggcttttcncattatgnaagagntn

SEQ ID NO: 641 - DNA, 740 bp, Homo sapiens
  misc_feature 12, 23, 24, 32, 40, 43, 660, 670, 681: n = A,T,C or G
ctttcctttgantcttcttctannaaacgttngaacgaantcngcacgagaccactaacagcatctacttgactactgatactttgatcatggagtttgggcatgccacttgatagaaatttgaagagcaattatatttttcaaaaagagttttgaataatgttaagatagattgcaacatgactatcaattcttcccttcccatcaaaggagagagtccgtttatccagcctttgaatcttgattattcaagtgacttgcttcacccaatgtaacattaataagcacaatacaagcagaggcttgccaagaacttggtttgtttctaatgcttagaagaagaatggtgtatgccatatttctgcatttagaactcacgtggagacatgtgtggcccaattgctcctctttcatctcaggcaataaccagacacgggactgaggccatccatgaccagccagccctagtcaacacacaacacacaagctgatcacagatgcatgagtaagcctaactgagaccagccaagaccagcctagaatagaactgctcagcagcaataaaaactaaataaattgttaccttaagctacttttagagctatttggaagtgtatttttgtgcagctaacatttactatcagataaaatggtgattgnttatctctgntttaatgatgntttaaggaaatggttctattaaaaggaaatatctggggctttgtcaccgttaaaaaaat

SEQ ID NO: 642 - DNA, 737 bp, Homo sapiens
  misc_feature 3, 11, 12, 20, 21, 23, 26, 28, 30, 31, 32, 33, 35, 91, 611,613, 694, 721, 731, 733, 737: n = A,T,C or G
tancctttgannctttctcnncntgncntnnnngnaacgacctcggcacgaggacaccccagatgcagccaccaccagcagaagcgatcanctgaccccacaaggttttcgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttctgcggtggcgcaagggtgttcaggagcgcatggggccctacaccttcctggagactgtgtgcatctacngntacttcctctttgcttcatccccatggtggtcctgtggctcatccctgtgccttggcttgaatggctttttggggcctggncctgggctgttaaaccgccgggctggnatttaacctntnggcn

SEQ ID NO: 643 - DNA, 748 bp, Homo sapiens
  misc_feature 10, 16, 19, 26, 34, 38, 42, 81, 107, 108, 417, 459, 470,497, 511, 524, 552, 576, 589, 610, 623, 633, 659, 661, 670,693, 726, 744: n = A,T,C or G
cttttaaccntttganccntccctcnaaaccttngatncganttcggcacgaggaaggcagaagtgtaaatgaacatacantttaaggagaaagcctgctgtgtttnncttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgtatgacattgttaaagtgctccttaatgaaggtgcaaatatagaagatcataatgaaaatggacatactcccttaatggaagcagccagngcaggtcatgtggaagttgcaagagttcttttagatcatggngcaagcatcancactcattctaatgaattcaaagaaangtgctctaacactngcttgctacaaangccatttggatatggggcgctttctacntgaagctggtgcagatcaagagcncaaaacagatganatgcacactgccttaatggangcctgcatggatnggacatgtanaggtggcacgtttgctttttggatantnggtgctcangtgaacatgcctgcataatcatnttgaatctccattgacgctagctgcctgtgganggacatgttgaaattgcngcct

SEQ ID NO: 644 - DNA, 759 bp, Homo sapiens
  misc_feature 3, 4, 5, 7, 25, 46, 52, 74, 76, 79, 102, 103, 116, 130, 133,135, 137, 145, 155, 160, 161, 162, 169, 172, 182, 183, 188,190, 193, 197, 198, 204, 215, 227, 228, 236, 240, 248, 254,258, 264, 265, 266, 268, 270, 271, 280, 283, 284: n = A,T,C or G
  misc_feature 287, 290, 296, 297, 298, 302, 307, 310, 317, 337, 341, 342,346, 348, 360, 361, 368, 369, 371, 380, 381, 384, 390, 396,411, 412, 413, 420, 421, 436, 441, 444, 452, 457, 461, 463,465, 475, 483, 486, 494, 500, 501, 506, 515, 518, 522: n = A,T,C or G
  misc_feature 524, 530, 545, 546, 547, 552, 558, 563, 567, 576, 580, 590,606, 612, 617, 620, 639, 643, 657, 665, 676, 679, 683, 686,703, 709, 717, 733, 751: n = A,T,C or G
tcnnncncttttcgatcttttgagncttgcctttgaaccccttggntacganttcggcacgagggaaccatgananccnagagctagaattgctattggatnncgtctattctctntttgcttattgggncgngntncgtggttnctggcctcangggtnnncccgaanganggggtatctnngagcnanttntgcnntttacnggctagcttgntgggggcttaanntgccactnttanacatgctntactantcantgagannntncnntcgaccatntannacnatnctgtgnnntccngtacnctntggccgnatggagctattagcttcaanatgnntcgnantgttacatgcanncactganntnactatccannatntaagtnctcttngcttactgtgaacannngctactnncttggatattatagnaaggntcnttgatacncgatnatcntncntgtcagatcnataaatancanctataccnactgtnnaaatnccatctggnggncttncnatccanacataattgcattannncgtcnaattgngatanagtnttgaaagantctnggtttagacnttggatgttgcaatgnttgtgncttanaanttatgtgctggctactgantaanctgggggcatgacnttactggnttgacctaagnggngaantcnatggtccgattgctggnccctanccttaagntttgccatgaataggncttttgccctaaaataanaccccttt

SEQ ID NO: 645 - DNA, 766 bp, Homo sapiens
  misc_feature 2, 3, 4, 5, 6, 7, 8, 16, 20, 22, 38, 94, 115, 136, 171, 198,234, 244, 303, 313, 319, 332, 335, 355, 377, 393, 419, 429,465, 479, 481, 485, 491, 498, 500, 501, 521, 548, 553, 581,589, 597, 610, 622, 624, 640, 648, 659, 661, 671: n = A,T,C or G
  misc_feature 699, 703, 706, 722, 735, 743, 765: n = A,T,C or G
tnnnnnnntttcaatntttnancgtcccttaggatccntcgattcgatccagatgggatacctctaaacacgaaaagaaagaagattccattantgaatttttaagtttggtttnatcaaaagccgagccacctangcaacagtccacccccttagtaaacaaagaggaanagcatgcaccagaatcatccgcaaatnagacagtcaacaaagatgtggacgcacaggctgaangagaaggganccgccatccatggacttattcatggccatctttgccagttcctcatatgaaaagtcctnatcctgcgangatgancacggtgacagtnaanatgatcaggcacgctctggngaggacaacttccaaagctggnaagacactgacttggnggaaacatcatctgtggctcacgctnttgtgccagngccctaggagccgtcaccttccttcccgatacaaangatgcagatagatnanaganaagagntcggccngnngctgcctcccgtcttatgtnccaatgctcgtcagacacttgaagttnctcanaaagagaaacattccaagaacaaagacnagcacaanggcaatanagaacacaggccngaaagaattganangaaattggaaacactngaagcacnaaacacctaangnaatccaaaanaattggcaaaccaggggaaaagtaggtncctncgngaagtttcgacagccngcggacaagccanaattgacnatgaaaccgcatacgtgtcttnc

SEQ ID NO: 646 - DNA, 752 bp, Homo sapiens
  misc_feature 3, 4, 5, 6, 7, 8, 19, 21, 24, 28, 666, 711, 714: n = A,T,C or G
ttnnnnnntttttatcctntnatncttnctctttggatccatcgattcgctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaagtacttgcaatctgaaaagggttatgctgtggaggttcttttagaacaaaatagatctcggctcaccaaattccacaacctgaaggcagtcgtctgcaaggcctgcatgaaggagaacagacgcatcactggccgagcccactggggctcacaccacgcagggaggtggggaagacagggctccagctaccacaggacgggctctgggtatagccgttccagtcagggacagccgtggagagaccagggaccaggaagcagacagtatgagcatgaccagtggagaaggtactagtcaaccttcagaaagagtatggagagaaaaagaggcacacctggacgcagagccctgccagcgccctctctgctgttgcagctgcaaggagaccatgcctgtgggagccaggcctcgcttgcatgaanaaggaacgatgcctttttcaatggtgtcttccttccattgtgcanaanaaccttttggtggcttctcttccgacttgtgcctgatt

SEQ ID NO: 647 - DNA, 743 bp, Homo sapiens
  misc_feature 21, 600, 675, 740, 742: n = A,T,C or G
ttaatcctttcaattcgttcntctttggatccatcgattcgaattcggcacgagccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaaccactatgagaagattataggaaaaacaccaagactagaggactctgggttccttttatgcaaagtcaactcttctgggtcacagttacccagcaacaaaaataaagagaggaccaggacgatgccagcaccccgtttatcctgagtgaactctccggaggcctcttcaagcttgtgggttctctgctgtcttgaagccatccatccatttgataggttttgcaaagacttggtcctgccaagatggttttaatcatttctgctaaaaggaatggactcgaggatttgatctcattttagatgcagttgtcctcacttggccattttacagcactttagtaaatatggccagtgtatttggtcactattaaatcaatccccattcattatctgtcanggcaactcagtgaactaaatactatgttctgacctctggcactctttctcatgttggttaaatatttaatattgnctaaggcaattcaagtatttttcttaaataaaaaatatgaaaactcaaaaaaaaaaaaaaaaaanana

SEQ ID NO: 648 - DNA, 759 bp, Homo sapiens
  misc_feature 20, 27, 88, 89, 101, 410, 421, 447, 449, 454, 470, 497, 505,516, 542, 545, 575, 603, 614, 624, 627, 650, 658, 684, 696,703, 708, 721, 743, 752: n = A,T,C or G
ttttaatccctttcatttcnttccttngtaggatcccatcgattcgttttttttttttttggtgattggattaacaattttattctgnntccactacaaangggctggtgttttgttccaaatgtttagctgggagggctgtagggacccctgttacccccattaaacacagtaaagcatggatccagtcagccccctgctggcaggtgtgggcctggcaactacacagatccaaccccaccctcctgggtgcggccagaggccaaggcagtcgcccgagctcctgaatcccaagaatggttctggcaagtactgctgtttgtttgtaggggcaaagagttaaaataaaacgaggttctgccatggctaagccttgtggaaaccagaccccaaagcccctgccatgccangggtctcaacnccagacgcttgttatggaggcaccancnggtantggcccctgtaagcanggccagagtcgggacaaagagcaagantgaaacanccaagagacanaggaccatgctggaccattgggcacncangaacctgcctgggaaaaaccggggggcaangctggcatgggaatgaacacctgcttgntgacacctatntgagcttcanttnccttaacttgaaaaattgaacangcccggtncggtggctcataccctgtaatcccancacttttgggangctttangccgnttggatcattgangttaggaagattaaagaaccancctgggccnacattgg

SEQ ID NO: 649 - DNA, 746 bp, Homo sapiens
  misc_feature 2, 4, 21, 23, 24, 625, 667, 684, 718, 736, 745: n = A,T,C or G
tnancctttgaatccttgaangnngatccctcgattcgccggaacctcatccagtgccacccatcttgacaccttctccctcttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacaccttcaaggccagaccgcttgcctcttgatgagaaaggacatgtaacgtggcatttcatggacctgaaaatccatacccatacctgatttatctgaangcaattcctcagatttcaactatcaaaactagggaaaactgngagtttaacaccaagtnctacaacacaaggttggaaacacctgaacttggnggatcatgataccacttnaccactccnt

SEQ ID NO: 650 - DNA, 789 bp, Homo sapiens
  misc_feature 15, 25, 31, 35, 44, 45, 46, 49, 53, 54, 56, 75, 111, 112,130, 140, 150, 158, 175, 241, 442, 598, 721, 737, 748, 754,758, 761, 768, 778, 780, 788: n = A,T,C or G
tgacccttttgaaantccttgcatntttcanaccntttggtacnnncantttnngntggatccctcgttcgctgnacaaaagatgtttttcaattaaaagacttggagaannttgctcccaaagagaaangcattactgntgtgtcagtnaaaggaanccttcaaagctttattngatgatgggtttggttggactgtgagaggatcggaacttctaattattattgggcttttccaagtnaagctcttcatgcaagggaaacataagttggaggttctggaatctcagttgtctgaagggaagtcaaaagcatgcaagcctacagaaaagcattgagaaagctaaaattggcccgatgtgaaacggaagagcgaaccaggctagcaaaagagctttcttcacttcgagaccaaagggaacagctaaaggcagaaagtaganaaatacaaagactgtgatccgcaagttgtggaagaaatccccaagcaaattaagtagccaaaagaagctgctaacaggatggactgattaccatattcgcaataaaatcttgggccaaaagaaaatttgggttttgaaagaaaataaaaattgatnggaactttttggaattccagaagactttgactacatagacttaaaatattccatggttggtgaaaggatgtaccaagctttgtgaaatattgtaaatttttaaacctattatctactaaagtngtactggaattgtccntttgcctgttnacttgnggtntantcatttntatttaatgntnaaattaang

SEQ ID NO: 651 - DNA, 757 bp, Homo sapiens
  misc_feature 2, 3, 4, 5, 6, 11, 27, 113, 114, 434, 569, 584, 604, 643,645, 649, 678, 718, 749, 756, 757: n = A,T,C or G
tnnnnnctaancctttgaaatcgtccntgcatgatccctcgattcgaattcggcacgagcagatatttactgaaggaatctaggttgttttttcagtggacaatgggaataanncatttctaaagcaccgactggagaggaaggcaacagagacaaggagagaagccgagagacatgtctgcgtgctgccacgcatctgagcgattgctctgtgaagagttgtacactgaacattttcaggggaggctgtttacccaggcaatgtcctcaaacaagcctgtgccggggtgtcctggaatctgtgccaggactgtgtttttagcccttcacctctcagctttagcaggacatgaaccagttataacaagatggccctgcagctggttacaggaatgtgacatggcaggatctatggaaccaaatggaaggttttnaggtgatgtaggtctttcacagttagctttggggaatacagaatactcaaataaagtgctttgttattatttcagagggaatggcgattgaaatgttacaacagagatttcttggtggtagctatttgggtaaangtatatggatatttntctgtacatgtgaaattatntaaaataaaagttatataaattacattgacaaaaaaaanangtanaaaaaaaactcgaacctttaaaaactatngtggagtccgtattacgttagatccagaccttgataaganaccattgatgaattttggacaaaccccactngaatgcnn

SEQ ID NO: 652 - DNA, 759 bp, Homo sapiens
  misc_feature 3, 4, 5, 36, 68, 79, 80, 88, 153, 206, 218, 221, 241, 267,290, 342, 356, 366, 377, 416, 451, 610, 612, 616, 619, 640,678, 684, 708, 711, 716, 726, 748, 751, 752, 758: n = A,T,C or G
tcnnncctttaatgctttgaactcgttgcactgcangatccatcgattcgaattcggcacgaggctgnccaggcagttnnatggcctnctggttgtgtgccttcacacccgcctacagccccacctcaccatcaagcgctgagccaatgcggntgtggctggccctgagttcctgagtcagctccttgccagggccagagctggtnacagcggggcancanggtgggtagcctctaccagncagggcagtccctgaggggccagcangggggctgactgcctagtggctnaacctactgaacccacccactcccagcgatgctacccagaaccccaacggcntgaatcctgcacantgccgggcantgccagactcnaaagggctcgctgtggggacagccccgtcatggccacanactctgtcctcacctttgattgtcaggatgacagnccccaccaccatgatgagcgtctgcagggcgtccgtgtagattacagcagccaggccccctgccaatggaagcaaggttgctggaaggggccctggtccagggaggaaggacaccgggaggaacttctgggcttctgctggggccacttcctgggctgntnctcnggnctgtatggggaagtggccttntgacccctttacacgttccctgggtggaccttccctgnttgcangcacccataccttgcgatggtgtncanggctnttgatgcccnaaactttaggattgttggatangtnnaatctnc

SEQ ID NO: 653 - DNA, 820 bp, Homo sapiens
  misc_feature 10, 12, 14, 15, 29, 31, 34, 37, 100, 102, 125, 144, 164,169, 181, 184, 187, 190, 194, 213, 216, 218, 230, 232, 234,236, 237, 244, 247, 249, 252, 276, 280, 285, 310, 324, 329,331, 332, 334, 335, 339, 343, 347, 350, 366, 371, 376: n = A,T,C or G
  misc_feature 380, 386, 387, 391, 398, 404, 407, 415, 418, 435, 437, 440,441, 445, 455, 461, 464, 466, 467, 469, 471, 478, 481, 487,506, 510, 513, 516, 517, 527, 528, 532, 535, 546, 547, 554,563, 567, 568, 569, 573, 575, 581, 585, 590, 594, 604: n = A,T,C or G
  misc_feature 610, 613, 622, 631, 635, 637, 638, 651, 654, 657, 662, 663,664, 667, 669, 674, 677, 686, 693, 694, 703, 705, 707, 712,713, 714, 715, 719, 724, 726, 728, 738, 750, 754, 756, 774,780, 783, 791, 798, 812, 815, 817: n = A,T,C or G
tgcaatcccncngnnaatcgctttgaaancnccntcnctgtatgatcccatcgattcgcaacagtccaggctctgcagacagcatcccacctgtcccagntngctgacctgaggagcatcgtggnggagattgaggaccttgtngctcgcctggatgaactcgngggcntgtatctccagncanaanaangacngcatacaacagaccattangangntgtcatctacantntnanngatcatntgngnacngacccatccattaatgaggatcanggcntccanctgatgaacgctgatcttctgcaanaagaacgttctagntctancnnanngccntcancctncgnctcttgagctcagtgngtcangctcntaanatcttnncacntgccaanctgtgnggnctgccttnagncttccggataggcactntnatnngacntgccctatanttgccngcngnnantnaaccaantgnaccatngtcactctgttgacatcanggcnatntgnntaaactaatnncttngcngcactctagtnngcgttgncactgcccncgtnnnctancntaccanttcncattncccntttaatgggnaaaganatnatccctacnatcatattncccntnnaatggattcgagncgnaantcttnnntantnatctnaancctaaatgntcacatnnaaactttanangncatcnnnnatgnaaccnancnatggctaaanggcctcattaangccngntttttcaaacttgaaaantgcatnccnccattganaaaggantacacgggcccccntgngnggg

SEQ ID NO: 654 - DNA, 768 bp, Homo sapiens
  misc_feature 4, 5, 10, 17, 21, 29, 38, 40, 49, 52, 589, 632, 675, 692,706, 707, 721, 745, 750, 756, 757, 759, 761, 762, 768: n = A,T,C or G
tttnnccccnttttgtncctnttgattcncttgctacntnttcaaatcngtnggatcccatcgattcgccacatttaagtgagatatgggaaggaggagcagattgtttttgaagggaggaagagcagttacttagggtcaaattaagttgtaaaatcccccccgggattttgtatgtaagtcaaagtgaattgtatttggaagaagaactggggagcccacctctggtattttttttatgtccctcatatggacaaataaacctctggtattaaatgaattttcttttgggggattctatatattcgggatttcaaccaccaacctatctggtttttcccgctgaaatgttgggtgatggaatcaggagagcagatttggagactctttatattttataattgagagagacaaagagaaaaccgtttgatttgaaaaagttttctaggttccctcaggtagatggaaattttcatcaaaaacagtttattcaaggtacatagcctactagtttcccatttgagagtaccgcagaatgatacgacgtgtactgcttctctacgcagaatgaagtataaaattagcaccnaatagtactttaatttgcaggtgctaaactttttacatgcttnatctcatttaattcttagaagaaactaattttaccaagtaaantgtctggaccaaccatntgcaggtccaaaannctggaaaaaccgtnaggtttggactcctacatagcctnttttntaagtnncntnntaaatn

SEQ ID NO: 655 - DNA, 752 bp, Homo sapiens
  misc_feature 2, 4, 8, 24, 25, 484, 497, 567, 616, 659, 711, 712: n = A,T,C or G
tntncctnttgatccttgcactannaaatccgtggatccctcgattcgaattcggcacgagggtaaacctatttatataatagaaggatgattataaacatttaataaattatatcaaatagatattatatattaaatgggcagataatagaaatctgtccaagcaaaactctggataatttttatgttgccttattttttgttttctgtgaactccaagaaaaatgagataccagtttggaacagatgtaatattgctgatttaacagtttagggatactccccaagttcaataattttgccaagatacaaatttaaatggaaccttttatgaagcttcatagtgtgtgaagaacttaccttgtttatatgtttgaagacatacatatttcacatttcagaagagtctatacatagctcaccaaatatcaaaaccaccttgttagaaaacattaaggtctgtcttatttatttgttcatttgnttatgagacacantctcactctgtaatctcactctgttgtagaggttgagtgcagtggcacgatcacggctcactgcaacctncatctccctgactcaaggaatccttccacctcagccttccaagtagcanggaccaccaggtgcaccccactatgcccagcttaattttttgnattttattggacagattggggttttgcccatgttattcaggctggatccttnnggcctcaaactcctggggcttcaagccaatctggcctgcc

SEQ ID NO: 656 - DNA, 754 bp, Homo sapiens
  misc_feature 11, 21, 23, 26, 29, 103, 173, 260, 293, 389, 428, 453, 462,475, 513, 567, 573, 583, 592, 617, 628, 632, 634, 648, 663,680, 689, 699, 700, 717, 718, 734, 737, 753: n = A,T,C or G
ttttccttttnatcttgctcnanaanccntggatccctcgattcgcagaggctggttcagaaaaggaggaagaggcccggctggcagccctggaagagcagangatggaggggaagaagcccagggtgatggcaggcaccttgaagctggaggataagcagcggctggcccangaggaggagagtgaggccaagcgcctggccattatgatgatgaagaagcgggagaagtacctgtaccagaagatcatgtttggcaanaggcgaaaaatccgagaggccaacaagctggcngagaagcggaaagcccacgatgaggcggtgaggtctgagaagaaggccaagaaggcaaggccggagtgagtgcctgcggcccctcacagggctgangccagcccctatcagctggatgtggcagaggcatgccanaggacctaagtgtgatggaccagantcacttctnctcctcctttctncaccagccctgacccctcatgctctctggctgggccantgggcaaccctcgcttccttggatggactgcctgctggtgcctggtcagagaanagcctnttttcccagnctgattctntgctcccaggaaccaattgaccatnaaggtgcaaangccnanccaatccccttacntactggcccccattnattcctggctttttcanaagcccccntgccaaacannttgggaccccctgattnnttaagggtgccttttnatnggggttaaaggttaant

SEQ ID NO: 657 - DNA, 734 bp, Homo sapiens
  misc_feature 2, 9, 11, 19, 21, 25, 27, 28, 29, 32, 35, 94, 111, 261, 267,269, 274, 277, 280, 282, 283, 290, 292, 305, 377, 381, 387,422, 438, 445, 458, 464, 490, 498, 508, 541, 574, 576, 585,600, 608, 613, 619, 620, 633, 641, 648, 649, 650: n = A,T,C or G
  misc_feature 669, 671, 677, 679, 692, 705, 710, 718, 721, 729, 733: n = A,T,C or G
tntgttccncnatgaacgntngaancnnnatnccnttggatcccatcgattcgctgcggccgcaggagctgtggcggttttcctaatcctgcgnttatgggtagtgcttcnttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgantgccantnaaatnaantcntnngaactanancgagctgattganaccctagtaacatgtataccaaatactacattcaccgaattccaagaagccgggaggttcagcagtcctggncctncaccgntttcaccaccttgcactccatgtggctctcctttnccctaattcacagggngaagccngatttggtgatgngttacngaccacgaacatgtgttcctatctgngtatctgnccttatccantgggatactaggaataaagaaagtgatcattgntactttcaaagcatctgccgggttgaaacgatntncatgtcccnaaagatttgttgatntgcagctnctcantgctanngtcggttttgaanaaagtttnccaaatnnntgtaccttgggccaatttntngacaantngaactgacttgtnagaatcttgcagntaacngtcttgtntcntccaattngggng

SEQ ID NO: 658 - DNA, 783 bp, Homo sapiens
  misc_feature 17, 29, 281, 355, 372, 392, 411, 412, 478, 520, 530, 546,583, 597, 611, 620, 622, 625, 626, 638, 640, 672, 673, 700,715, 718, 723, 733, 747, 763, 775: n = A,T,C or G
ttctcctgaaacgcttngcacttccctcnctgcaggatcccatcgattcgaattcggcacgagacactgtcccactccatcacccaggctggagtccagtggtgtgatcatagctcgctgcatcctccagttcctgggttcaagccatccctcctgcctcagcctccccagtagctggaactacaggtgtgtgccatcacacctggctttacatttttctgtggggtcttactatgttgcccaggccggtctcaaactcctgagctcaagtgatcctctgnctcagcctccagagtatctgggattacatatgtcggctaccgtgtctggccgttcacatctttggccactattngcttgtgaaaaggtatnatgaggtggtacttatcatngttactgtgtctcatgttnngtatatttttgcttcatcaactaagatgcactgtaacatctgtgaaatctggatatattatcaaanggtttatcatagttttgttaacaatacactgtcgttttactnggtgcctaanataatggtatagttgngaggtgatcttagatttgatgaagcacagtatgcaangtaggcctaatggngggaaagaatgggnaattttcanangcnnggaagtatttgntnttttgtaaatggacttgaaaagcttgttctgnnggattggacccaacccctttccctttnaaaccccgaattctnatngactnttccaacttngaaaactttgctcnaacttaaatacctttnaaaaattaaccntgaccccg

SEQ ID NO: 659 - DNA, 741 bp, Homo sapiens
  misc_feature 21, 31, 620, 660, 671, 679, 681, 740: n = A,T,C or G
tcttcctttgtatacctgctnttgctctttntgcaggatccctcgattcgctttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcangcactgtccattagcttcctttgcaaaagctacttatggncggtcacaatncaacactnanacagagccaaggcaatatcctcttgcccatggctatgatgtcagacagtggatggctcnt

SEQ ID NO: 660 - DNA, 734 bp, Homo sapiens
  misc_feature 5, 6, 9, 13, 671, 715, 716, 731: n = A,T,C or G
tctgnnctntgtntccttgctcgtgttcttttgcaggatccctcgattcgaattcggcacgaggactggagaagtcagaagtagaaaagcagattgctaggagagacaggatgacagattttggtcagaaaatgggatattggagtttaaagtatcaaatacagaatagttccagatgttcagagatccagcatgggattaggtactgaaatggattagaactaaaagtcactagaatttagaaattgagaaccatgagagtggatgcaatgacttgttgcttgattgaaaaataaattaataataataaaggaccatgagactagcctgttataggggttatctccatgaacattgaattttcccaggatcatagcaggaattgggtagagaaaaagattatgagaaggtgccagagtcttcagtgaatgtcaggaaattaccaggaagtcagcatatgacagagaaaaggacagtatgttatctgcatcaaaggaaaatgtgcttttgttgaaaagtacagaaaaagccaatactacaatactgtgctaagcccctacctgtactcctctcccacagctgcattccagccctgtggtataaaaggtgtgagaatgagcttttccaccagaatcagcaggtttagttaaagcatgagcagaacaagcatnctatgaagagactgaggatgtaggtgagtggtctaaatctcatnnaaggacattgcagtngat

SEQ ID NO: 661 - DNA, 762 bp, Homo sapiens
  misc_feature 3, 4, 5, 6, 7, 8, 13, 22, 26, 28, 32, 38, 40, 43, 111, 113,300, 304, 306, 324, 341, 351, 355, 363, 364, 365, 373, 388,391, 396, 400, 405, 409, 411, 427, 435, 439, 440, 445, 450,453, 462, 465, 467, 475, 477, 490, 536, 544, 581, 600: n = A,T,C or G
  misc_feature 604, 614, 616, 639, 645, 646, 666, 667, 668, 680, 689, 692,700, 703, 706, 735, 750, 755, 758: n = A,T,C or G
ttnnnnnnctccnaatcctccngatnanatcnctttgnanctncctgcaggatcccatcgattcgaattcggcacgaggtccatacatggagctccctggagcccgtgtgntntcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggangccntngggctctgcaaggcgcanatcactgccatcatctntcagcaaggngacntatatgtnnntgacctgnagacctcagctgacnctnccttngtanggttngatntnggaagcatcccaaggngatttagngacnntggantcctnatnactgataanacncnaactatantnttttacccttggnagcccaccagcaagaatgagttggagcaatcttttcatgtgacctncttaacanatatactctgaatgaatctacgttgtatttatcaggnggacaatgggaataaagcntttntaaagcaccnantggacatgaaagcaacagacacnaggagnnaagccttgagacatgtctgnnntctgaccgcatnttgatccantgntctgtganganttnttcactgaacattttcaagaggagggtgnatacccctggcaatngcccnaanaaag

SEQ ID NO: 662 - DNA, 745 bp, Homo sapiens
  misc_feature 1, 3, 8, 9, 11, 13, 15, 19, 26, 33, 35, 84, 92, 251, 510,540, 545, 586, 598, 639, 640, 643, 656, 661, 673, 723, 736,740, 741: n = A,T,C or G
nanatccnncnantncttnttgttcntgtccgnangatcccatcgattcgaattcggcacgaggtttcatttaagaagaatganctagatanatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcanagggggtttctgcgggtgacccccagcatatttctaggttacttatgggcagatttgtaagtgacaaaactccagctgatgctgggaatggggagagggcccttgagggactttgtggttttgtgcttctggtttcctggccaaccccagggtcacttgtctggaggcccagctgggcactaatgtctgccaccgactatgttaaagtgtataaatgattcctctatttgggagagatcttccaatccagaggagcccntcttggactgcctgggttaaatctgcatancagangtggttgatgaagttcatctgaagaaattcagccccacctncccaccctgccnttcctgctcccttttgatagtggcttctgggtactcgggcnngtncttgggacaccanccttntctgggggtctnaagccatcccgttggggctgtcggccaagcctaagttaatcgtgtgcctntattgggaggatngctnntcct

SEQ ID NO: 663 - DNA, 748 bp, Homo sapiens
  misc_feature 8, 16, 26, 33, 34, 38, 41, 674, 724, 734: n = A,T,C or G
taatcctnttgataanaatccttgtncttgctnntganccntcgattcgaattcggcacgagggcaagtttccaaagatcagtgtggagtgctacagaaataattataggagaggaaatcataatcacagaaggtataatgcttgtttgaggctccggaataagaactaaaaaaaaacaaaaaacactggtttcatgcttacggggtacacactttggtgcatcccgtgaacacaaattttaataccaaacaatccttgatgcttcacctggggctgccaagcagtttgtaaaacagaggaaaacatttagtgcagtctgtattatccttttccaacttttctgtttgtgcaagtttttgaagattcattggccaaacaatgaacaacaaaggttttctgagagaagacaaggtggacttttcattttgttagtaaataccagtggcactgttgaacgaaacaaatacttttatctcagtctttcaaatcagtattaatgtctgtgtttccttccactgacagctcttcttctagtttcactgaaaaaagggtgttagtatttttatcttggacactctcttccaaatccttcagcagctcctcttctttatattctgccacatcgacctctaaaccggaattgtccttcagtttgccgtggtgcttgagatantacccgctggttctgaaagaacttgatgatggtgtactttgggaaggtcnaactgggcanacagagtctggatt

SEQ ID NO: 664 - DNA, 785 bp, Homo sapiens
  misc_feature 3, 4, 5, 6, 9, 11, 12, 18, 19, 25, 96, 116, 162, 163, 166,169, 181, 199, 208, 219, 233, 235, 236, 245, 259, 261, 263,268, 270, 279, 282, 283, 288, 299, 301, 320, 329, 391, 400,417, 464, 466, 479, 485, 492, 510, 512, 535, 537, 543: n = A,T,C or G
  misc_feature 585, 600, 604, 615, 627, 631, 646, 655, 679, 723, 728, 737,739, 745, 754, 758, 766, 770, 780: n = A,T,C or G
gtnnnnccncnnaccctnntgaatntaatccttgttcttgctgcatgatcccatcgattcggtcaagctggccctggatgtggagatcgccacctnccgcaagctgctgtagggcnaggagtgcaggctgaatggcgaaggcatatggacaagtcaacatcnntgnagngcagtccaccgncttcagtggctatggcgntgccagcgntgtaggcagcngcttaggcctgggngnnggaagcagntactcctatggcantngncttgncnttggatgcngcnntagtnccagcagcggnanagccactgggggtggcctnagctctgtnggaggcggcagttccaccatcaagtacaccaccacctccttctccagcatgaagagctacangcactgaantgctgccgccagctctnagtcccacagctttcaggcccctctctggcagcatagccctctcctnangttgcttgtcctnccctgncctccantctcccctgccctaccgngnagagctgggatgccctcactttntnctcatnaatacctgtttcactgaactcctgttgcttaccatcatgtcncagttatcagcactnaaancatgctaatgnccttttataagncccngtatttattacaagnatcttgaantctgccattaaattcttgaggaangaaaatgacctattatcccccataaagaacctgaaacttcaagnctaangtcccagcntncaacanggaaggagntccntttttttnattngctaaaccantcctc

SEQ ID NO: 665 - DNA, 763 bp, Homo sapiens
  misc_feature 3, 4, 6, 9, 10, 11, 12, 14, 15, 21, 24, 27, 31, 32, 35, 43,47, 49, 51, 57, 430, 541, 614, 689, 693, 694, 695, 699,700, 711, 714, 725, 726, 728, 742, 751, 753, 757, 760, 763: n = A,T,C or G
ggnngntgnnnntnntaattnctnttnaatnncantccttggntctngntntaggancccatcgattcgctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttangtgttgattctcaaataaaaaagtattcctcagtatcagaaccagctaaagtaagtgaatgctgtagatttatcctaaatttgctgtagcagtggggaagagggacggatntttttaattgattagtgtttttttcctcacatttgacatgactgataacagataattaaaaaaagagaatacngtggattaaagtaaaaattttacatcttgtaaagtggtggggaggggaaacagaaataaaatttttgcactgctnaaannnaaannactttccagcnaanctaaaaaactnnancctttaaactatantgagttcgnanaccnggnccn

SEQ ID NO: 666 - DNA, 759 bp, Homo sapiens
  misc_feature 1, 2, 5, 6, 10, 11, 12, 565, 586, 691, 730, 746, 749, 758: n = A,T,C or G
nnttnnatannngctcttgttctttttgcaggatccctcgattcgtctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgnaaagatacacatatgatatgnttattaaaattgaaataatgtaaaacacatgaataaatttgcaaaaccaagatcacagtccaccatatgcactctggtaccttaaattttttttataaataattnaaaagggaatattggaagcttcttaaaaaaaaaaaaaanaaaaaactcgagcctntanaacttttgng

SEQ ID NO: 667 - DNA, 760 bp, Homo sapiens
  misc_feature 3, 4, 7, 13, 19, 24, 43, 45, 50, 52, 64, 69, 233, 391, 406,559, 582, 622, 678, 682, 733, 739, 741, 757, 760: n = A,T,C or G
ggnnttnaaactnctaatnctgtnttgcaggatcccatctatncntatanangctctaggcggngcggntcccactctcggaaccttgtcctgtttgtcccccagctcggcaagcgccatatgagcctggcggcgccagatgcgaatcctgttctgggctttttggcctattcccgcccctcagtcttgccgggatggcaccgcccgcataggacttccagggttgggctgantgggagttcgactgctgggcctcgtaattctcgctttggggctgctccttccaggctgggacacactggggcccgctgtcggtctcccgtcctccgacatcttgtctggaacttccgcctggcagtctccagtaggagtggagctctgtgcggcgtantttggtggaaaaacnggccttgcgtcggcctcacccccagtgtttgtgtttcagaatgaagactattctcagcaatcagactgtcgacattccagaaaatgtcgacattactctgaagggacgcacagttatcgtgaagggcccagaggaaccctgcggagggacttnaatcacatcaatgtagaactcanccttcttggaaaagaaaaaaaagaggcttccggtttgacnaaatggtggggtaacagaaaggaactggctacccgttccggactatttgtaagtcntgtncagaacatgatcaaagggtgttacactgggctttccgttacaaagatgaangtctgngnatgcttaatttccatnaan

SEQ ID NO: 668 - DNA, 763 bp, Homo sapiens
  misc_feature 2, 16, 20, 535, 594, 602, 718, 720, 727, 729, 739, 745, 752,754: n = A,T,C or G
gntctatgtggctctngttnttttgcggatcccatttgacgccttggcacgagaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtnagaggaggaagagcttttgtatatctacacttgcaaatactaaagccactttccagttnaaaggctnccggagaagatcctctctttaatggggaaagggagagagctctcttgactggccttgggaaagggattggaacataatggggagaaaagaaagccgtaattgacattttctggcanantcttgtnancaagaggggnaaagtnacccttntntgcttgaaa

SEQ ID NO: 669 - DNA, 754 bp, Homo sapiens
  misc_feature 3, 14, 626, 634, 659, 664, 669, 681, 687, 694, 704, 714,719, 728, 743, 753: n = A,T,C or G
tgnttctaatgctngctctcgttctttctgcaggatcccatctattcgaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagtttcttatcccagaaattactgccttcaccatccctaatatcttctaattggtatcatataatgacccactctttcttatgttatccaaacagttatgtggcatttagtaatgggaatgtacatgggaatttcccactgacttacctttctgtccttgggaagcttaaactctgaatcttctcatctgttnaaatgtgnattaaagtatctacctaactgagtngtgantgtantgaaagaaaggncatatnttaaacnttgaatttancaagcccacnctcgnattttatgncctttcttttgcctngggattgaanc

SEQ ID NO: 670 - DNA, 752 bp, Homo sapiens
  misc_feature 3, 12, 49, 639, 658, 669, 721, 723, 729, 748, 751: n = A,T,C or G
tgnttctaatanttgctacttgttctttttgcaggatcccttttgacgnctttggcacgagaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctnttgtggcatagaaaaagtnttaagctcaantagtttttttattattattattattaaaagttattcaggactgatgtgactncngatttnagaacatgtggtaatagtntant

SEQ ID NO: 671 - DNA, 752 bp, Homo sapiens
  misc_feature 3, 40, 662, 680, 685, 700, 715, 741, 752: n = A,T,C or G
tgnttctaatgttgctactcgttcttttgcggatcccatnttattcgaattcggcacgaggatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattggtcttatgactagtagataaattcattgccataatgaggctagctcccagataaacagtgtattttcttcttttttttttttggtgagtggtccaaactttaagctactttttccagtantttgccactttctccgangtaantttggctggtctttnagtaatgctaattgngtgtcaaaatttgtctacaacagttnggcaacagatn

SEQ ID NO: 672 - DNA, 792 bp, Homo sapiens
  misc_feature 3, 14, 21, 420, 487, 507, 536, 571, 599, 603, 604, 617, 618,623, 642, 655, 663, 682, 683, 713, 724, 730, 732, 737, 739,746, 752, 755, 757, 762, 763, 772, 775, 782, 784, 788, 790,791: n = A,T,C or G
tgnttctaatactngctactngttctttctgcaggatccctctattcgaattcggcacgaggctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggnccttctgcccccgacctgaccacgccggcctagggttccagactggttggacttgttcgtctggacnacactggagtggaacactgnctcccactttcttgggactttggagggangtggaaccggcacactggacttcttccgtctctanggctgcatggggagccctggggagcttnaatnnttgggggatcccnnaaaangaccccctgtcccccatanacttgggtttttngctttcanccctttccccttggccccnnttgaccacttcatggagtttaattaaaatngcccttggtangaaaananaatantnttcctcnttttantgntnttttnntataatttnatnatcctantnatcntnnt

SEQ ID NO: 673 - DNA, 755 bp, Homo sapiens
  misc_feature 1, 9, 12, 27, 609, 610, 653, 668, 708, 724, 731, 745, 755: n = A,T,C or G
nttctaatnctngctacttgttctttntgcaggatccctcgattcgaattcggcacgaggcagcttcgagccaatggtgagctccttctggatcagctccttcagctccttcttgctcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaagttttttaattcgcggccccggnngccaatgcattgggccccggtacccaacttttgttccctttantgagggttaattgcnccccttggccgtaatcatggtaatagctgtttcctggtgngaaattgtttcccgtnacaattncacacacttttcancccggggacn

SEQ ID NO: 674 - DNA, 753 bp, Homo sapiens
  misc_feature 29, 606, 613, 615, 680, 684, 705, 724, 732, 740, 752: n = A,T,C or G
tgcttctaatgcttgctactcgttctttntgcaggatccctcgattcgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacctgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttaatgtttattaaataactgaccatttgctgtanaaagatnanaaaacttaagctttgttttactacaacttgtacaaagttgtatgacagggcatattctttgcttncaanattttgggttgggggcactangggttcaaaaccctggcanaattgtcnactttagnctgaccataatnc

SEQ ID NO: 675 - DNA, 760 bp, Homo sapiens
  misc_feature 3, 13, 25, 29, 605, 614, 638, 647, 674, 675, 686, 688, 692,698, 701, 720, 746, 751, 752, 755: n = A,T,C or G
tgntttctaaacnttgctctcgttntttntgcaggatcccatctattcgaattcggcacgaggttccctcaccttattcctccaagttcccccttgggaacctctgagattaacttgataagctccttgggcaagctctttatcctaagattcctcagtgagccttatagagttgctgcgagaattacatttgttcatgatgtcaagtgtctggtatgtagctaatgcttattgaacacatagtaatttattgaataattgtcatgatcactggatgagatatagccactgtggaggtaggcacaccagggttttagaggcttgggatcttgcaacaggattttcctcttgcctctccaaactgccctttgcccagatggcttcagcatctttttgcatccctgtttccttgtttggtgaacacctgtctcaacctgtctgcaaggcgtggtgagattctgcatccttggtaagcactcatgtcactccaaaacagctgtttgatgctaatagcacacatgaggtcttgcaaatttgtctgaggaactacaggacattggagagatatttatcaaacacccactacatgcctgatacttaactanggaactatnaaagtgggtggtgaagacaagtgngaagtaaantgcaaacctatttccatatatgtttgnncgctagattgntnccancaattngcntcttggaattgttgaattnggccctgtgtgtgtgcctgtggtaantgganntgngtttc

SEQ ID NO: 676 - DNA, 751 bp, Homo sapiens
  misc_feature 1, 12, 18, 39, 425, 586, 608, 633, 676, 679, 726: n = A,T,C or G
ntttgaaacttnctactngttctttttgcggatccctcnattcgaattcggcacgaggcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattctttttttttttttttgggacggagtctcgctctgtcacccaggctggagtacagtggctctatcttggctcactgcgagctccgcctnccgggttcacgccattctcctgcctcggcctgccgagtagctgggactgcaggcgcccgccaccacacccggctaatttttttgtatttttagtagagacggggtttcaccctgttagccaggatggtctcgatctcctgacctcgtgatccacctgcctnggcctccaaagtgctggaattncaggcgtgagccaccgcgcccgggnctaaattggatattctttaaccattaaaaggtttactgggtgnccnatttgccatattattggaaacttggaaagggtaatttgaaacaaagntttgaagttaactgaaatttgggga

SEQ ID NO: 677 - DNA, 756 bp, Homo sapiens
  misc_feature 20, 27, 29, 43, 591, 662, 664, 673, 755: n = A,T,C or G
tgctttgaatcctttgtaancgccctntntgcatgatccctcnattcgaattcggcacgaggataaactcttcagtgacgaatattagaattagttagttatacatttgaggaaaactataaaagtaccaataatgagtaggaaatcacttctgcagtatttttggagcattttccttaagcatgacataaaagccaaaggtcacaagggaaaaaactgatagatttgtctgtgatattgagagatgtatgcacatatacatacaacagtcatagtaagacaccgttagacaaaaggtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagtttagaagcctgaaacttttctcgtatggggtggtttttgcattaaatnctggggtccattttacaatccattatttttgaccactgctatgtgttcaagtagtatgagaatgtgattgntnttatctggntcatatatatttctttggctaatttaatatgtcaaataaatgagttcatttaaaaaaaaaaaaaaaaacccggactgttttnt

SEQ ID NO: 678 - DNA, 756 bp, Homo sapiens
  misc_feature 2, 3, 4, 5, 6, 7, 8, 9, 10, 11, 12, 13, 16, 17, 23, 24, 645,697, 709, 734: n = A,T,C or G
gnnnnnnnnnnnnttnnaatagnnagctacttgttctttttgcaggatcccatcgattcgaattcggcacgaggggtgttggagcagattgtagttgatccacagcaaagagcatcaccaaagccattccaggaggaactagatccaccacttcctctgctgggcatgctccaaaaatggttgtggcttccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggacatgggaggagccataaaagtagtctatctatcatcagttacatatctaatgaactgtctatctgggataccctatcctgttttaatctgagtgactctctctcagctgagagagctggacagactccattttagcctcttcacttgcagtccccttatccccctcccttaagggaataactagtgcaagctgacttcaagcacattcaggaatgcacttactgataagatattgaggcaagctgtaccagcagcttctgggggacctgctcantggatggtcccaacccctgcatttatctctttgggatagtttaagcccctgnacctggaactgngtatttttctgtactatctctgtancattaatttttttactttttgg

SEQ ID NO: 679 - DNA, 747 bp, Homo sapiens
  misc_feature 7, 551, 627, 640, 663, 728, 734: n = A,T,C or G
tctaatncttggctctcgttctttctgcttgatccctcgattcgaattcggcacgagaaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcagtgcctttcttgtgttatgaaaggcaggtagatattatagccataggtaaaaatccatagttaaattgcacactgaccttaaatctctctgtgtatgcccttgtatcttgcatgttaaaagttggattattgggcatgtgtggcagcctgccctgctacatgctagacaagtgtgctttagtacatagccacaagttcttcattctttaaaatgttttgacagatcatctcataataaaaataattcangaaaactatggggaaatagttacatttcacaaaagatattttaaactctttgtaaaacttagataatagagcctancaagttactttgnatctaattggatacattttatgnttaattttaccaccatacattttattaatcaaaattggttagcatgtgactctttttggcttcanaagttntcaaaaaaattat

SEQ ID NO: 680 - DNA, 750 bp, Homo sapiens
  misc_feature 8, 31, 461, 521, 562, 591, 652, 663, 665, 703, 724, 726,733, 735, 739: n = A,T,C or G
ttctaatncttggctctcgttctttctgcangatcccatcgattcgaattcggcacgaggaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacaagctctggcccaagctctggtcctgggggcccggggtaccccccgagaccgtggctggcgtntccccaacaacaagctgggttccggggatgacatctctgtcttcgtcatccccctggganggccaggcagttactcctgaggggcttgaacaccatccctnccactagcctctccatacttactcctctnacagcccaaattcttgaaagttgtctcccttgacccttctttaatggcaacttaactgaanaaagggatgtncncttatatccaaaattcagctatttggcaaataaaccanatggattaaaaaaaataattntntcttaananaaanaactccggcct

SEQ ID NO: 681 - DNA, 748 bp, Homo sapiens
  misc_feature 6, 29, 430, 465, 538, 545, 551, 560, 563, 574, 616, 647,650, 653, 655, 658, 671, 682, 694, 698, 704, 707, 708, 711,721, 722, 724, 731, 743, 748: n = A,T,C or G
ctaatncttggctctcgttctttctgctngatccctcgattcgaattcggcacgagcccagctgctcaggaggctgaggcaggagaattgcttgaacccaagaggcggaggttgtggtgagccgagattgcacctttgtactccagcctgggcaacgagcaaaaaactctgtctcaaaaaaaaaaaaaaaaaagaaaaagaaaaatggcttccaggacagagcatgctcatttgctggcggacagttccagaaacagaccctgttagtccttctacttacctgctggatttttcaagcactaaatttataactttttgaaacaaaataatgtgtaattttccatttgggggcaaactctattcttgtgagcattattaaaatcttgtttgtaaatatattgtctttctcttaatatttgctctgggtcangaagaagctgttcacggtgtgataatactctttanattgtgctttcattattatagatgcatcatgtcttctgctttcacgtgtctgggatggggtcagaaatgcatnctccagntgacanaaaaatccnagnatgagatcaanaaggatactggtgttttctgacttttacaaaaattactttgntgttttcattaaaaaaaaagctttaacctantgnttncntantccttttagaaantattaaatttnaaaatgaattcnatanaaatanaannacnaaaaaacttnntncctttanaactttagtgangcgtn

SEQ ID NO: 682 - DNA, 755 bp, Homo sapiens
  misc_feature 9, 403, 417, 462, 483, 554, 560, 579, 585, 596, 599, 614,615, 617, 639, 663, 674, 679, 687, 715, 719, 721, 726, 729,747, 750, 751: n = A,T,C or G
ctaatgctnggctttcgttctttctgcaggatccctcgattcgaattcggcacgagcaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctaccgaagaccttaagacgaagctcaactncccgtggcgaactnacatccgagtccacaaaaagaacatgccaaggaccaagagtcatncgggctgtggggacaccgtanggctgatagatgagcagaacgaggccagcaagaccaatgggctgggggcagcagaggcattcccctttggntgtcangcgacagctgggagagaangcaagnaagccctgaangcnagtccaggaggaccnncnaagggcagtttccggagcccgntgttccggagatgctgatgtgggntgtgtctgcanttcanggccaaanttggggacccctgggaactgtaccctangggntncttgnagnttaaaacttgaccttaanggnngcct

SEQ ID NO: 683 - DNA, 755 bp, Homo sapiens
  misc_feature 3, 7, 8, 9, 35, 52, 577, 637, 659, 660, 702, 707, 724, 730,747, 755: n = A,T,C or G
ggntttnnntctttctaatgcttggctctcgcctntctgcttgatcccatcnattcgaattcggcacgagaattagtatcaacttacaatccaagtccaagtatcatcttataatcacttttttctactatattaagatctaatgaatttgatttcttttttgaagttttttcttgtaacatctgagattagaagtttaagatcacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggncttactttgattttaaaacaagagactcaggggaaagtactaaaccaaaaactctgattntactttgcgttttctggaagtnnttggtttactgagatgcttttgtaaaggaaaataatgcttgngacantttagtaatttctacanaattcnttaatatttcttcctcntgggcttn

SEQ ID NO: 684 - DNA, 774 bp, Homo sapiens
  misc_feature 3, 7, 9, 10, 15, 16, 20, 29, 34, 40, 529, 638, 676, 696,709, 713, 717, 718, 719, 720, 728, 737, 739, 750, 759, 773: n = A,T,C or G
ggntttnannctttnnaatncctttgctnctcgntctttntgctggatcccatcgattcgcaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttnaggttgaaaaaacaaaaaaaatgacatgggtgcagaagcttgtaacattgatcacattcttaatgtaaatggtgtctttcttctggggtttcagtatttgcaaagaaantgaagaagaattctggaaatgccattcaattaaccctnaggaaaaaagccgaccttanaaatttaccttantgcnttgnnnnttaaaaanaaaaaaaantnaaaaaactttnaccctttanaccttttgtggggnc

SEQ ID NO: 685 - DNA, 759 bp, Homo sapiens
  misc_feature 3, 7, 8, 10, 11, 21, 30, 112, 113, 114, 473, 581, 690, 741,754: n = A,T,C or G
ggntttnnannctttctaatncttggcttnagttcttttgcaggatcccatcgattcgaattcggcacgagagtacccagagttgcgaggagttttttaactgatttagccnnntggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatnactgaacagggagacgctccaaggactctctgtgtggctggggtcctgactatagacccaccatatggtccagaaaattgcagcagctctaatgagaatattctgtcncgtgttcaaggatcttattggaaggacatcttacagcttccaatgagaagccaagaagttgtgaacatactgattgaaaaaagactttattttaatccctcattaaaanggttttaaatgttaaaaaaaaaaaaaaaaaacttcgagcttttaaactatngtgagtcgattcntataa

SEQ ID NO: 686 - DNA, 749 bp, Homo sapiens
  misc_feature 3, 4, 7, 8, 9, 10, 11, 26, 30, 36, 644, 700, 723: n = A,T,C or G
ggnnttnnnnnctttgaaatcccttngctnctagcnctttttgcaggatcccatcgattcgaattcggcacgagggcaattagcctcgcttaagttgccttttttacacaccaaaactttttacatgaagggctggtttcacatgaatactatactgaaatctgtgctctcaagatctagcagtgaccagggctgcccggcgggggctctcctggcaagtcaggaaggtttctgttgctaatataacatagaaacacattagtgcactgggcctctctgaggtcagcatatttgtactcttggaatatttgtttttttcttcagtaacaacagaaaccccagttgggagtttaacaaataactgactaccactcactcatgcatttttatttccaattaaagcaaagcactgtgctgtgctcagataataatagtttgtaagtaaaagtttttagttttcagtgttcaggttatagaatataactgaccataaaaattacctgcaggtattttctttttatgaacttgtttttaaattaccaagtaattactggtgtcattttgttttatgacagacacacgtatctaacaaacaaacaaacagtgaccttctccatgggtcaaggacttccttacaatttctnctgagttaacttttgtgaaaataatcctaaggttttctggcttattgaggaaattnctacaaacaacaaaccaacaacngaagagaagatcatcaaccactgttt

SEQ ID NO: 687 - DNA, 760 bp, Homo sapiens
  misc_feature 3, 4, 33, 484, 529, 576, 608, 661, 705, 715, 744, 753, 759: n = A,T,C or G
ggnnttctaatgctttctaataccttggctctngctctttctgcaggatcccatcgattcgaattcggcacgaggaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtattacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtntttttttttctttttggatgtgaaggtgaacattcctgatttttngtctgatgtgaaaaagccttggtattttacattttgaaaattcaaanaagcttaatataaaagtttgcattctactcangaaaaagcatcttcttggatatgtcttaaaatgtatttctgtcctctatacanaaaagttcttaaattgatttttacagtctggaatgcttggatgntttaaaatantaacattttatattttttaaaagacaaancttatattnatcctng

SEQ ID NO: 688 - DNA, 752 bp, Homo sapiens
  misc_feature 3, 32, 543, 583, 642, 672, 676, 686, 715, 730, 733, 740: n = A,T,C or G
tgntttctaatgcttctaatagcttggctctngttctttctgcaggatcccatcgattcgaattcggcacgagacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctnccaagtagctgtgactaaaggtgcacgccgccatgcccanctaattttttggattttaagtagaaaccgggtttcacccgtgttgcccaagctgctctnaaaactcctgagctcaagcagtccacccgncttngctaccggantgctaggattcagacgtaagcccccgaancctggctagtttgcnttnttttctntcattttataag

SEQ ID NO: 689 - DNA, 806 bp, Homo sapiens
  misc_feature 4, 22, 42, 78, 79, 83, 90, 97, 105, 106, 112, 113, 117, 121,122, 123, 124, 127, 130, 131, 134, 135, 136, 141, 143, 146,147, 150, 157, 158, 159, 163, 168, 170, 171, 179, 182, 184,192, 193, 195, 196, 202, 224, 228, 257, 258, 268: n = A,T,C or G
  misc_feature 271, 273, 276, 277, 279, 282, 294, 295, 309, 339, 343, 363,370, 371, 382, 398, 405, 406, 410, 411, 412, 416, 421, 424,430, 437, 442, 444, 445, 446, 448, 459, 480, 493, 497, 500,503, 518, 523, 524, 531, 542, 545, 549, 554, 556, 558: n = A,T,C or G
  misc_feature 559, 563, 564, 570, 571, 589, 590, 592, 599, 603, 604, 608,610, 612, 621, 630, 631, 633, 634, 637, 639, 645, 647, 651,653, 654, 673, 692, 706, 711, 723, 729, 730, 746, 749, 754,756, 758, 760, 761, 764, 766, 772, 783, 789, 794, 797: n = A,T,C or G
  misc_feature 798, 805: n = A,T,C or G
gtgntttctaatgcttctaatngcttggctactcgttctttntgcaggatcccatcgattcgaattcggcacgagganntctntgctatngaacagnggctggtnnacactnngganttannnntgnacnntannnattgnancanntantactggnnntccntaatncnnttaatgtnacntnttgcaagnngnnctgatnaaatacacgacaggagggaaanctantgcgtcataggcacaggcagacctaccgnntaaggagatnatntnccnnanggntggctgttgagnncatgcaactctggnatgtatttccctttataggaccaccttgtncatngtggataaagcccctaaagnaggatgnnaaagatgatcngatccaatacgttacnctgacannaaannntgtnatacntcngctgancaatctntccancnnntntaatatcgtgnatcacctagggtgtatgatcntaggaactctgcncctncantcnggactgtccatcacngactnntgggctnctactgtacantangcgnagaanancnntcannctacanntaaccagattggtgctgnnanatggtantgcnntttnancncccacgacncaataaagnncnnctntnccccanancctntnnagggaagaaaggaattttncatagtgggctcaatgaanggggtacccttggnctttntaaaaaacgttncatggnncctaccttaaacctgngtnaactnanancnnttngncataangggtctaacgnctatanggggnacnnatttttnc

SEQ ID NO: 690 - DNA, 772 bp, Homo sapiens
  misc_feature 1, 3, 31, 39, 430, 674, 675, 681, 683, 685, 709, 716, 725,731, 749, 772: n = A,T,C or G
ntntttgaatctttgaaatacctttgctatngttctttntgcaggatcccatcgattcgaattcggcacgagaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccactncccgcctacctggtggccgccttcgccaagcggctggcccgcctggccctgacggctccccctgaggccctgctcatggtcctgcctttcatctgtaacctgctgcgccggcaccctgcctgccgggtccttgtgcaccgtccacacgggcctgagtttggacgccgacccctacgaccctggagaggaggacccagcccaagacccgggcctttggaaaacttccctgtgggaagctttaagnnccttcnanangccacttacccaaccttgaggggntccaaangcccgccanccggtnattaaccaaggccctggncaatgcctgaaggtcaaacaatn

SEQ ID NO: 691 - DNA, 755 bp, Homo sapiens
  misc_feature 1, 9, 17, 38, 107, 571, 590, 597, 604, 607, 627, 633, 648,655, 660, 709, 717, 718, 734, 735, 739, 744, 747, 749, 754: n = A,T,C or G
ntgctttcnaatctttntaaatgcctttggcttctcgntctttctgcaggatcccatcgattcgaattcggcacgagaaaaagtaaagcttttcatgagcacaaatnccttgcattgtttgatgttactgatattcgtaaaatgaatattttttgttttgttttgttttatttttttgagacaagtcttgctttgttgcccaggctggagtgcaatggcatgatcttggctcactgcaacccctgccttgcgagttcaagtgattcttctgcctcagcctcctgagtagctgggattacaggcgctcaccaccacacccagctaatttctgtatttttagtagacacagggttttaccatgttggccaggctggtctcaaactcctgacctcaaactcctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgagcantaagatcacttgagcccangaggccnatgcttncantgaactgtgattgtttccantacagnccacctgggtgacanagtaaanaaaangaaacattacataatttggctagagcataataaattgatttctgggttntgaaattnnagttgccataaaaggnntttnaatgngcnanttcant

SEQ ID NO: 692 - DNA, 748 bp, Homo sapiens
  misc_feature 3, 12, 20, 616, 677, 701, 718, 724, 741: n = A,T,C or G
tgnttttaatcnttctaatncttggctcttgttctttttgcaggatccctcgattcgaattcggcacgaggtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaacagaacccaaaggaaccatcaccttggagctncttgaacacaatgaggcatatacatggacaaatccacctgctgtgtgcataatatcattgngggtaaactgtggatcgaacagtntggcaatgtggaaattntaaccncagactggggacaaatntgtgttg

SEQ ID NO: 693 - DNA, 881 bp, Homo sapiens
  misc_feature 3, 4, 5, 6, 9, 25, 26, 142, 227, 294, 310, 315, 349, 383,412, 417, 438, 458, 464, 470, 479, 482, 484, 491, 494, 500,501, 504, 506, 537, 540, 547, 560, 586, 588, 592, 597, 599,618, 621, 625, 628, 633, 652, 658, 661, 668, 672, 686: n = A,T,C or G
  misc_feature 691, 692, 694, 697, 705, 720, 724, 733, 735, 741, 742, 747,751, 753, 757, 770, 774, 785, 789, 797, 799, 801, 808, 816,818, 825, 832, 834, 835, 843, 844, 847, 848, 849, 851, 857,861, 863, 866, 868, 870, 871, 872, 875, 880, 881: n = A,T,C or G
tgnnnngtnaaccagggaaaagctnngtttgaactccttgggcatgatcccatcgattcgaattcggcacgaggcggtgacccacgtgtccttttgattgccctactgctgtggagacctcgtgctgaccatctggcagtgntcttcgtattctctggcctgtggggcgtggcaagatgcccgtctggcagacacaaaacaatgctctctacggcgttctgtttganaagagcaaggaagctgccttcgccaattaccgcctgtgggaggccctgggcttcgtcattgccttcnggtacagcacgttttngtgcntgcacgtcaagctctacattctgctgggggtccngagcctgaccatggtggcgtatgggcttgtggantgcgtggagtcccaagaaccccgaatcanacccnactctttcaggacaggtcaancaagtcagaggatgaagaanattcanacaaanatgtgatanccngngaggccnaangaggannaantnataaaagcaccagccagaagaattttcttanaanatgcctnagggacatatcanccggggttctcattacccatcttaancnccanatttngncccattcttgaaataagantcnttgnttnaattntcaacttctttttatggtnatttcnatntatctanttantaaaaccacaaatntgttnncnatnaccaccanttcttttaaaccatntagnaattcaaangntgtgtnnttacnaatntntaangggttattcaaanttcnaaattttaaanattnttatgcantncncacaatntatataananggtcctnaaaacgngnnccaatatnncannncnataatntagnanatntntnnnccntgtann

SEQ ID NO: 694 - DNA, 742 bp, Homo sapiens
  misc_feature 3, 14, 388, 456, 535, 547, 565, 571, 616, 623, 629, 677,678, 689, 691, 702, 703, 737, 740, 741: n = A,T,C or G
atngcttggctctngttctttctgcaggatcccatcgattcgaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcantaataaattgcagaatattttgcaaagctttcttttggaaagcaaacttttgtgcctgcctatatgcnaagtattttatcagggacttgaacaaagacctcactctttttcacttgtcttatgtcgagagaaaaggttattggcagncacattcctaanactggggaatggtgtgtncttttnaaatttgaagataacttttagggtaattatggaaactcctcaaangaggganaaagtnatttttttccagacatttttcctcaattctgggtctttcacacactanntttccatagtncnagaatttctgnntttttaccatttgggctgtgaaatgttcacaatntcnng

SEQ ID NO: 695 - DNA, 745 bp, Homo sapiens
  misc_feature 9, 626, 667, 670, 688, 699, 728, 743: n = A,T,C or G
tttcaaatngcttggctacttgttctttttgcagggatcccatcgattcgaattcggcacgaggctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaaagttgccagtaaatgagaaagacataccgacctcttaatgatgtacacattaagggccntaactattcatgccaacccatttgctcagtagctattgatnganctggacaaattactttgnccaaattgctngaacacactttattggggggttaccccgnttttaattatgtcanaa

SEQ ID NO: 696 - DNA, 795 bp, Homo sapiens
  misc_feature 9, 19, 21, 364, 464, 483, 496, 519, 586, 596, 604, 615, 621,664, 694, 710, 719, 751, 777, 790, 793, 794: n = A,T,C or G
tttcaaatngcttggctantngttctttttgcaggatcccatcgattcgaattcggcacgaggctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatanctgcctcccgggagccgcttgatcacaggactagcagtgagcaggcagatccctcagcaccctgccttgccccatccagcttgctgtcccctgaggcctnaccctgccggaatgacatnaacactaggactncccctgaaccctcagccaagcancggtcaatgcgctgttacccgaaaaagcctgcaggtcaagccagccccttaagccagggcttggcangggcccgccnaaggccgnaacaagaccgntctgtnaactcttgggttccaaacccggaactttgcccgaaagcatttntttcccttaattccttcaattcaatccggnctttccttaatttccnggattcttngggtccaagggtccccttttttcccccccaanaacaaagaaaaggttgggcccgaaanggtcccaaccttnttnnt

SEQ ID NO: 697 - DNA, 734 bp, Homo sapiens
  misc_feature 26, 492, 562, 592, 625, 631, 635, 690, 709, 712, 717, 720,732, 734: n = A,T,C or G
ctaatagcttggctactcgttctttntgcaggatcccatcgattcgcagccctcttccctcccctgtcaagtcacttaccatgcaaaccacaggctctaagagtttgtccccagggacatccatccaagtcatctccatggctcctgggtcccctggtgagcatggagtcaggaggtcatcaatcatcatgctggggttggtgcgagaggggccacagacctgaaaccaaatggatctgactggggcagctgcccctcagtgtcagaggggctcgacccctccggtctctaaggaagtcccaaagagaatgctctgtgggtccctagcatctgaggaggacgggctccttcagaactcgggctgggtggtccgagcgactcatgatttgcatgggactctggcaatctgtagccccaatgccttgatgtcttcctcattaacactgtcacgtctcaccaggaatacagtgacattaaaagtgtgatatggtntagctgtgcccccacccacatttcaacttgaactgtatctatctcccagaattcccacatgttgtggganggacccagggggaggtaactgaatcatggnggctggtcttttcccgtgctattctcgtgaatngtgaantttnacgagatctgatgggtttatcaggggttttccaatttttggttcttatttttctnttgcaatctgcatttaagnaantgccnttnggtctctaacantn

SEQ ID NO: 698 - DNA, 728 bp, Homo sapiens
  misc_feature 4, 8, 12, 20, 103, 670, 695, 711, 728: n = A,T,C or G
ttcnaatngctnggcttttngttctctttgcaggatcccatcgattcgaattcggcacgaggtttaatttaaacctctcatctttttttaagcactcactgantttgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaggggactggactgtctcccttgaacatattttagcttcacttctgactgaacagtcattagtcaactttttttgaaaagccactggacatgaaatccaaacttgaaaatgccaagatcaatcagtncaatctcaaacttttgaaatgaccncaatccaatctggacntaagctgagtacttgtn

SEQ ID NO: 699 - DNA, 746 bp, Homo sapiens
  misc_feature 10, 18, 21, 488, 544, 583, 654, 660, 694, 695, 702, 712,718, 735, 737, 745: n = A,T,C or G
tttcaaatcncttggctnttngttctttttgcaggatcccatcgattcgaattcggcacgagggaaaaacaacaggtttgagtcctataaagccataatttaactccagtagctgatgtcagacaagcttgtcctatgtcctatttgagtggcagcagcgccagcccagcaagaaggctgggggttgtcaaggttgtccccagaccttgcttgcagtggttggagaacccagggggctgccttgggccctctggccagagggaagcgggcagctctagccctggagattgtggtcacattggggcttgtttaggattggagggccaggtcacctccccagccaccctcccttctctcctctggggtccccactttagggcgactttgcccgagcccacgcatccatccactcctttagtgccttgaatctcattcacaagcagccccctcccttcccctccccttctcactctgttgatgtaatcctnccacccccagtgtccatcctaagacaggcatcaaaaagaggccctaactttacttnccaaatggtgctttttaaaaaacaccatcactacattangggcaattttttcacaccttcctgtcttcagaatgtaaaagggtgggggaattattgtctctggttaaatntgcacncccttgacttgtgggggttttggggcatgttcanntatttangaatgaattncaattngacaaaagggggtttantnaattgttnt

SEQ ID NO: 700 - DNA, 759 bp, Homo sapiens
  misc_feature 2, 22, 36, 40, 647, 653, 708, 721, 731, 742, 745, 751, 757: n = A,T,C or G
gntttgaaatccctttgctttnaaatcctttgctanttgntctttttgcaggatcccatcgattcgaattcggcacgagataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttcatcgtggacctccagcctccagaattgcaagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaatgtatgtctataaaaggagggatttctggactagatgatgatgaaaaatgttcatataaaggcaccttcagcttcgagttgccaacacaggaggaagaatgctccctgctgttcagatgctgatatgtgtcctgtgctttctggatggccagtgggatcataagctggtagaagccagaactttcatccactgacttcatattcttncacatnctggaactgtgggtgtttgaccttttaaaaaataaatttaagcaaattgaaatgntttcctttgaganttttggccanaaacccacatnganattttncgtctncc

SEQ ID NO: 701 - DNA, 751 bp, Homo sapiens
  misc_feature 5, 6, 13, 22, 33, 39, 49, 109, 111, 604, 611, 670, 674, 716,718, 733, 739, 745, 750, 751: n = A,T,C or G
gcttnnaattccnttccaaagnaaaccctttgnaaattnccctttctgnttggatcccatccgattcgaattcggcacgagggtaagtcaggtgattgaatcccggaantnttcattgtcttcaagctcacaatactattttgggacaaacagttgtctagtgtttggactcatgaaccctgattcttgagggtggtattttactgcttttgtgatttggtttcaacatatatagtcttttctccggagttaccttaggtcagtggccagtgtttcagcccctggaaagggcatgggctgccactgaggttggtcacaggcctctcagctcatggtgggagtgggttcaggagttggtaagtagggttcagttctgttgttgccaccgatggcaacaggggtttgtaataatccctagttgtgtcaattatgtcacttaattttcacaacaggtctctgaagtgtttctcatctcatttttacagatgaggcctgcctgtgttaatacacctagtgaggagtggagctgaatttgaatgcaagccttggcaccttaattgagcaagtttgaaacctcgcttgttgcccttctggaaggagtcangaatttncagttctgggcctgggctgtgggtctggcagacagacctctggccctaaggtttgggtnccangttctctgcttccagaatgagaagctttgctgtgcaccaagnanctgggcccctctggnatctcntgaatnaaaann

SEQ ID NO: 702 - DNA, 748 bp, Homo sapiens
  misc_feature 2, 9, 17, 18, 21, 39, 627, 644, 747: n = A,T,C or G
gntttgaancccctttnnttnaaatcctttgctacttgntctttttgcaggatcccatcgattcgaattcggcacgagcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatcccagatggcactgttaaaaccgtatatgcaaacggtcatcaagaaacgaagtacagatccngtcggataagagttaanggcaaggagggtaatgtgctaatggacccgaactgtgacgatcctcatgtgatcatgaagtaccagtactgactttttatgttaaaaaatgtccatttactgng

SEQ ID NO: 703 - DNA, 769 bp, Homo sapiens
  misc_feature 3, 4, 5, 7, 8, 9, 12, 13, 20, 28, 29, 37, 48, 669, 692, 702,705, 706, 757, 767: n = A,T,C or G
ggnnntnnnagnntttgaantccctttnnttctaatnctaggcttctngttctttttgcaggatcccatcgattcgctcagctgaggcaattaaactggaaaagaaatagattgaaaagatactacagaagaagcagtacagaagttgggggactgaaggagagggagccactgcaggtgctagctgcttaaggggataccagtccttttacagatataatagatacagcttctgaggtggagggtgataggagtgtgtagagaaattgcagttcagaactggagcatgcagttaggcaagaggcatcccatgtgaagatgtcaagcaagtactggaaaatgctgaactaaaactcagggatggatatgtagatttagagaacttcattgtagaggcagtcattgaaagctaaaagggctgataataaaattgccaaggatggaaatagtaagagggagtcagtgttattaggattagaattctgttttgttttttctttaaacagattctcgctctgtcaccctggctggagtgaagtggtgtgatctcggctcactgcggcctcgacctcccaggctcaagttatcctcccaactctcagccttccaagtagctgggaccacagccattcaaacacatgcctgccttatgtttggatttttttgtanaaaccaaggttttgccatgtttnccaggctggnctnngaacttctgggcttaagccattcccccacccttgggtctcccaaaatgctngccattatangg

SEQ ID NO: 704 - DNA, 759 bp, Homo sapiens
  misc_feature 2, 5, 6, 7, 9, 10, 13, 17, 22, 23, 607, 660, 700, 720: n = A,T,C or G
cnaannncnnggnttcnaatannaggctacttgttctttttgcaggatcccatcgattcgaattcggcacgagacccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaaagagtggtcngaaaaaagcgcttgccccttacacgaagcaccagacactggagctggaagaanggagtttctgttcaatatgtacccttactcgaaaagcggngcctagagaataacccgcancgttccaccttaacggacaggacaagtggaaaaatcttg

SEQ ID NO: 705 - DNA, 777 bp, Homo sapiens
  misc_feature 12, 16, 19, 32, 543, 687, 689, 692, 694, 700, 707, 708, 727,730, 731, 733, 737, 744, 748: n = A,T,C or G
tttgaaatcccntttnttnaaatcctttgctncttgttctttttgcaggatcccatcgattcgtcctgaagctcggggggctgcaggtcctgaggaccctggtgcaggagaagggcacggaggtgctcgccgtgcgcgtggtcacactgctctacgacctggtcacggagaagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctactgggctctgtcaacagcttgctgaaggagctgagatgaggccccacaccangactggactgggatgcccgctagtgaagcttgaagggtgccaaccgtgggttgggctttcttaagcatggaggacatttttggcaatgcttggctttgggccatttaaatgggaaaccttgaaaggccaaaaaaaaaaaaaaantnatntnaaaaanaaacttnnaccttttaaaacttttaantgnngnccgnttttacnttanattccagacttgattaggaatccattttt

SEQ ID NO: 706 - DNA, 760 bp, Homo sapiens
  misc_feature 2, 11, 14, 17, 18, 26, 29, 79, 675, 737, 747: n = A,T,C or G
gntttgaaatnccnttnnttcaaatnctnggctacttgttctttttgcaggatcccatcgattcgaattcggcacgagnaatgcaaagggctgcagttctcattcaggctactttcaggatgcacagaacatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctattgtaatacaaggcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtccccaacaagttatttgtatacagtcttattacagangctttaaagttccaaaaggatattcaaaaatatgccaccgggcttgccacacttaattcagncattctatcnaatgccccagggc

SEQ ID NO: 707 - DNA, 856 bp, Homo sapiens
  misc_feature 23, 25, 32, 37, 47, 49, 53, 184, 213, 239, 246, 274, 283,297, 309, 313, 315, 324, 341, 351, 358, 373, 376, 378, 390,391, 397, 402, 404, 408, 410, 419, 420, 425, 438, 442, 450,466, 468, 472, 473, 491, 500, 508, 510, 514, 520, 528: n = A,T,C or G
  misc_feature 531, 533, 537, 539, 558, 562, 569, 576, 582, 595, 597, 598,600, 605, 607, 610, 613, 614, 617, 627, 628, 630, 634, 637,639, 640, 641, 643, 645, 646, 651, 654, 655, 657, 661, 664,665, 667, 670, 671, 672, 677, 679, 680, 682, 683, 687: n = A,T,C or G
  misc_feature 688, 699, 705, 707, 709, 710, 712, 716, 717, 718, 720, 721,723, 725, 727, 728, 737, 738, 740, 742, 744, 746, 749, 756,757, 758, 759, 761, 765, 766, 771, 773, 778, 781, 784, 791,792, 793, 796, 799, 801, 802, 803, 804, 808, 810, 811: n = A,T,C or G
  misc_feature 813, 819, 820, 823, 825, 829, 830, 831, 832, 833, 834, 837,841, 842, 847, 848, 849, 850, 853, 854: n = A,T,C or G
gttgctttgaagcctttgaaatncnttgtttnaaatncttggctttngntctntttgcaggatcccatcgattcgcctccctggatgtgcagacatggaggaggacagaaggcccagctcagtggcccccgctccccaccccccacgcccgaacagcaggggcagagcagtctggaggtggtgntcccacttgatgaagagcaggcgactggnttggagagggagatcatgctggctgnaaagaanggactggacccatacaatgtactggccncaaagggancttcaggcaccagngaagacccaaanttantnccctacatntccaacaagagaatagnaagctgcatntgtgaanaggacaataccagcntcnantggttttggctnnacaaangccangnccancnatgcccccnntttgnaacccattacaanctgntgccccantagctggcacactgancncctnntctaaattacttaaaatnatgctgtanaagtatantntttncagaanagactaancantncatngnctacttctccaaaaaaaantganaaaaatnataaaantcaaantaaatactaaatnannanataanancantannaanttatatttcnnanatantanannnancnntttanaannanttanggnnancannnattantnntnnatannttacattaaanttattnanannanaaannnannananannatatattannananantnacntaaactnnnntnaatnntccananacttnaanaanaataagnnntanatnannnnttangnntnatatannttnanatannnnnnacnatannacatnnnntannga

SEQ ID NO: 708 - DNA, 766 bp, Homo sapiens
  misc_feature 25, 30, 35, 36, 40, 42, 43, 44, 47, 48, 558, 622, 662, 735: n = A,T,C or G
ctaatactggctacttgttctttcnaagcnctggnntttnannnatnnagctacttgttctttttgcaggacccatcgattcgcccaaacttatcgggggtgccagaggcagagtagacaagccttagtggccgccatttgttgaatatctactgtgcgccaagcagtgcgtcacaactttatgaagtaggtattattatcatccccattttacaggtgaagaaactgagtctctgagagaccaacttttccaaggtcacacagaggtgggatccagcccacttccgtctgaccccaagcccctgctgttaacccctgccccattgtggggaggttccggcccactctggagttctctggtctgcgtcagtcctcaggagaagaaagaatgggggtgatgctccaaatattgaggctcccatctgtctgtcctgcactaggcagagccaggcttctccatggggcacaggagagagggcaccagatctgaggagcaaataggttcttggtctgagatctcatgggatcaggttgccagccctgcaaacccccgctcangtctagaggacatggagctgcctttcaaggtgcatttgcttcctttacagactcggactctgtnctctggctactttgggccgtcccggactcgggaatgcgtnctacacttgtaggggcaaaaccccggtttgactctttccgggttcctacccttaaccaagcctttactttctngggatcaccctgttgggactttttgtccacc

SEQ ID NO: 709 - DNA, 743 bp, Homo sapiens
  misc_feature 4, 5, 8, 11, 12, 13, 22, 23, 25, 592, 636, 706, 721, 737,739, 741, 743: n = A,T,C or G
gaannccnttnnnttgcaaatnntnggctacttgttctttttgcaggatcccatcgattcgaattcggcacgaggttttttttttttttttttggagaatgaatgcaagatttattgagtggtggaagtagctctcagcagatggctggggagccagaagggggatagcatgggaaggtagtcttcctctggagtctggctgctcagcagccgggatctcctactgtccttggccgaatttcccttggcgtccgaatcgttccaccatcaatggcctgccagcgtctttcgatgtgttcttctgccagtgtgttcctcttgacgtccagccgcttgtgtgtgtgcccgctggggtctcagggtttttataggcacagaatgggtggcatggcaggccagagtggtcttggaaaatgcaacatttgggcaagaagacaggagtccttgttctcattaggtccatgggcacaagcctgagggtggagcccttgccagtgaccctgcccttctctacccagcacttccctgtccccctcccatatcaccgttgccatcttgtccttgatgaggaatacaactcccaattcagtgnttgcttgtgggaagatgcaatcctctttatgacaagtttctaanaagttgataagaaaaatggggacctgcctaagggctagtatctcatttaatactctatagaatattatgnggttttcccttttangttttaaatgttgaanancnan

SEQ ID NO: 710 - DNA, 753 bp, Homo sapiens
  misc_feature 2, 3, 4, 5, 6, 7, 8, 9, 10, 11, 14, 22, 31, 45, 57, 683,685, 690, 695, 702, 715, 719, 721: n = A,T,C or G
gnnnnnnnnnnagngtttgaantcctccttngaaatcctttggcnactcgctctttntgcaggatcccatcgattcgaattcggcacgaggggcaatgcagttataatactgtgttaatttcagacatcttctggtcctccgagccttgtatttacatactagctgaaactgcaagtggaaatgaatggagctgatgatatttgccttatcctaatttttctgtgaggaggagaaaaacacttgtgcttcaaataagcagatgtgaaaacacttctcactaatcaaaatgtttaccactaggttatgagagtctgcctctcataggcagtgaatctgatatgtatacttagtaatataagtctatttagtttgacaaaaccttagagcagaatttttgcagcttagttcaggatgatcactagcaatgccaaacttcattttttattgaacttggatccaagaaggcctgctgtgtctatttcagtatagactctcataccaatatatttatgctccaagtcactacacccagaagtgatgcagtgggggaaatgcaaagacaacatcactgtaagattcacagaatggatcttttgtaaaatattttatattgacttaaggaaaacctttcattgggaattaattaaattaagtctctaatatcctggaagacagtaaaaantnaagcnggtgntctcaantttgaacccggcnattngnaatttcattataggaatttctgaaaataatcc

SEQ ID NO: 711 - DNA, 718 bp, Homo sapiens
  misc_feature 1, 5, 592, 611, 653, 691, 716: n = A,T,C or G
naatngctaggctacttgttctttttgcaggatcccatcgattcgaattcggcacgagcctacttattggatgttggctctttggtgtcatggagatggctttactgtaggtttgttgtgttgcattacttttcattgggattgaactgagaaataacaaacaagctttaagtgggaaattaaaaaaaagaagtaacctatgtagatccaaacttaaaatgtgagaaattattgaaatttcattttctacaaacttgaaattagcctgctaattgtaaagttgttttaataatgctgacaaatgtcagttacgtttgcaaaggagtgtatggttctaggtatttgcctactgttaaccgttgagaaaaacattgtcaggttagcaagtctattgaaatagagacctccttagtttacagcaaagaataaatagctgatgactggagattgggactaaggttttatttatttatattctttgaaagaaatcggacagttaataagtggtttgtggtagagttgaaggatgtctgagagatggaaagagagtgacaaaggaggagaaggaatagtatttcttttttagtattgntttgaaattaaaactctgntattttaatatggtaaagagcaagaatttgggttgggccgcngtgactcacgcctataatcccagcactttgggaagccntggtgggcaaatcacctgaaattangg

SEQ ID NO: 712 - DNA, 783 bp, Homo sapiens
  misc_feature 8, 10, 19, 20, 33, 37, 45, 48, 106, 107, 108, 206, 215, 257,276, 298, 304, 395, 400, 416, 420, 447, 454, 460, 479, 569,571, 576, 585, 601, 609, 612, 615, 625, 626, 631, 632, 637,644, 664, 676, 693, 699, 701, 704, 706, 712, 718: n = A,T,C or G
  misc_feature 721, 723, 725, 726, 730, 748, 751, 780: n = A,T,C or G
agttgaantncttgctacnnaaaacctttggcnactngctctttntgnaggatcccatcgattcgcaaagatggtcgtattactaaaggtgaataaccagcgcggnnngcacgtggagtcactggaacatttgtgcaatgctggtgggaatgtcaacccgtgcggccctctggaataagcctggcagctcctccaagagttaccgngtgacccancaattccactcctagctccacccacaggaattgaaagcaaanacgcaaacagatgcctgtncaccaaagttcacggcagcatncttcgncatagtggcagcatccgtcgtcacagcggcatcatccttcatcatagcggcagcatccgtcgtcacaagcggcagcatccttcgccacagnggcangcatctgtcgtcacancggnagcatccttcgacaaagcggcagcatncttcgtnatagcngcagcatcctttgccatanccggcaaggtggaaaccctgtccatccactgaggcgtgcatagactaaacatgggcagtccagcactggaattccaagccgtacaacggngnccacngtcaaaaangaatgaggaccctgangcacctgngcnganaacaagaacnngcgannccaanacttttnagacattattgccttaagtngaaaaacccagngcaccaacgggaaaccngaccgncntgnanccctgnttaacnttnantnngttncccgaaaatgggggcacnttnccaaaaaggggaataaaaggggagaattncct

SEQ ID NO: 713 - DNA, 765 bp, Homo sapiens
  misc_feature 7, 23, 37, 41, 43, 457, 626, 653, 679, 685, 686, 695, 698,700, 707, 720, 752, 756, 765: n = A,T,C or G
gttgaantccttcctttcaaatngcttggctactcgntctntntgcaggatcccatcgattcgaattcggcacgagcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcatangtgacagggtgtgtctctgacagtggtaaatcgggtttccagagtttggtcaccaaaaatacaaaatacacccaatgaattggacgcagcaatctgaaatcatctctagtcttgctttccttgtgagcagttgtctttctatgatccccaaagaagtttttctaaagtnaaaaggaaaattcctagtggaattcancccccaagggaaaaaagcccacttgnccacannaggaagccnggntnccccttngttccggcttaanggccccttgttcaggaaaccacactgggggancttnttttttttn

SEQ ID NO: 714 - DNA, 740 bp, Homo sapiens
  misc_feature 8, 9, 14, 16, 21, 28, 44, 740: n = A,T,C or G
gtttgaannccttngntttcnaatgctnggctacttgttctttntgcaggatcccatcgattcgccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaaagatttttaaactgactaacttaaaaaaatagattgtaattgatgtgccttaatttgcataaatcataaatgtatgtcctctctgtaattggtttaatgtgtgcttgaan

SEQ ID NO: 715 - DNA, 708 bp, Homo sapiens
  misc_feature 10, 708: n = A,T,C or G
tttgcaaatngcttggctacttgttctttttgcaggatcccatcgattcgaattcggcacgagggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgacactcaacagaattatagattctaatctgatgagttactgagctttggtcccttaaaacaagctgacttggtccctaaaccagatgaaaatccagatgctctatacttggctttaagaactgctttcn

SEQ ID NO: 716 - DNA, 730 bp, Homo sapiens
  misc_feature 9, 13, 697, 719, 721, 730: n = A,T,C or G
ttgcaaatngctnggctacttgttctttttgcaggatcccatcgattcgctcccatggaggtggtgggaatggcaccgagaagtttgatgacagttatctaatggactagaggttggcaaactttctgtaaatggccaggtagtaaatagttctgcttttgaaggcatatggtctcttgcacctactcgaggctgaaagcagctatagacaatacataaatgaatgagcgtgagtgtgttccaataagaaaaaaacatggctgtttgcttcggccccagggttgtagcttaccagtcctgtaacagatcacagtttgctcttttggtcacaaatacttgaacccctccctagttcagagcatttgataccgtaatatttaaagctcacttgtaaaacatcgtttgttgcctccatccatagtatctcaaacagaatgtctctcccaaatatacctaaattccatattctctgaagcacaaccagctattttcttgacatacttcctaacacaccccacagttcacaatttgatctgaaaacttgttaagggaggttctttggcatgtgatgccataaaaagagaggtatgggctctcctttaaaaaagagaccctttttatgagactcacaataggataaaagagcccatgcctatttttaaacatttttttcactatataagacatgcatgcctgnaaaatggtttttaattagtatnantgcttaatn

SEQ ID NO: 717 - DNA, 728 bp, Homo sapiens
  misc_feature 1, 5, 9, 485, 617, 633, 688, 699, 722, 728: n = A,T,C or G
naatngctnggctcttgttctttttgcaggatccctcgattcgctgcagtgagattctctgcaatgactggcctcagcaagggggcagcttaggaccctgacatcccaggtcactaagccacataggataagtaatgggtggacagaagcgggaaaggagaagggcagggcacatgtttaaaacttgaactttctgaggctaagactggaaaaggaatggtttcagctgatatatttggataccagttgactatttttaggaaaaaaacacaaatggcttttaaacatcacagtgtgatacagtctaactcagaattagagacaggcaaaacagaactccatcttaaaaaataaataaataaaataaaataaatgacatcactttggttcagagctctaaaatggagggaggaagccattctaaaaaggactccctacatgacctgcaacttgaaaaaaaattaaaagctccaaaaaaaacaatncaggagcttaccttgaaccttttgaattgggccaaattgccgatgaccactgcatcctggaaaattttatttcaccagcactacaacttctcaacagcaccaaccaatttaactatggatttttgtactaancccagttgcctctttnaaaacaacttgtcaactttgtctaatcaccctcagcttttttttaaaaacccctnctctacccctntctcttcagaacaccaaagtggncttttn

SEQ ID NO: 718 - DNA, 730 bp, Homo sapiens
  misc_feature 4, 10, 11, 12, 16, 22, 721: n = A,T,C or G
gaantccttnnntttnaaatcnttggctacttgttctttttgcaggatcccatcgattcgaattcggcacgatctagatattgcccaatcgctgcccacagtgcacatacctttccaccagtcacatgtgagagggcagattttccaaatgctcatcaccacttggcactgtgtggactataattttggccagttaggaaatggcatctcattgttttcatcttaatttgcgtcagcctgattactcattgaaacttgtgaggttgagaaacttttcttaagcttattggccattcaagtttcctcctttatgaaatggttgttcatgtcatttgctcatttttatattagattgtttttcttttttccagctgacttgtaggaactctacatcttatcaatattaatcatttatcgaaaactatttgggtgccattatcttctcctagtcaatgttttttgtttgtgatatcttttataatatataagtttttaatgttggcagaagtaaagttaatctttttggctgtgttgtgtgtcttgtttgatgtaaagatagtttctgtaatagttttgcagtttgattggtcatctttaggtcttcaattacaacctgcacattcatccctctatcctctttcttactctggttttctccatagcacttatcatccaataatatggcatgcacttatttaatctggtttgcatatatattttngctggtacg

SEQ ID NO: 719 - DNA, 733 bp, Homo sapiens
  misc_feature 28, 531, 577, 684, 717, 724, 729, 731: n = A,T,C or G
ttcaaatcgcttggctacttgttctttntgcaggatccctcgattcgcttcagtgcacacaacaggagagaggagaaagaagaaacgctagtaattccaagcactggaattaagttgccttcatcagtgtttgcttcagagtttgaggaagatgttggattgttaaataaagcagctccagtttcaggacctcgactggattttgatcctgacattgttgcagctcttgatgatgattttgactttgatgatccagataattctgcttgaggatgactttattcttcaggccaataaggcaacaggagaggaagagggaatggatatacagaaatctgagaatgaagatgacagcgagtgggaagatgtggatgatgagaagggagatagcaatgatgactatgactctgcaggcctattgtcagatgaagactgtatgtctgtgcccggaaaaactcacagagctatagcagatcacttgttctggagtgaggaaacaaagagtcgcttcacggagtattcgatgacttnctcagtcatgaggagaaatgaacagcttgaccctacatgatgagangtttgagaaagttttatgagccatattgatgatgatgaaattgggagctctggataatgccagaatttggaaaggttctattcaagtgggacagcaattcgctttcnaggaagttttgaatgactactattaaagagaangcccaanaattntntt

SEQ ID NO: 720 - DNA, 740 bp, Homo sapiens
  misc_feature 5, 6, 7, 10, 11, 13, 16, 37, 528, 558, 572, 629, 634, 656,663, 666, 683, 700, 723: n = A,T,C or G
agttnnnttnntnctnttcaaatccttggctacttgntctttttgcaggatcccatcgattcgaattcggcacgagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcaacgcattggcccgaagaaggcccagctaatcgtgggctggcgggagcttcacggncccttcaccaggtggaggacctggaacgcntggagggcataacngggaaacagatggagtcctttctgaaggcaaacattctgggtctcggcggccgccancgctntggcgccttctgaccgtcgctnctacttncgncttttcaaatttttggnataacccccgtgtttgngtaaaatccagtttttgttccgntaaaaaaaaaaaaaaat

SEQ ID NO: 721 - DNA, 736 bp, Homo sapiens
  misc_feature 1, 2, 5, 6, 7, 12, 13, 642, 643, 646, 722, 730, 732, 734: n = A,T,C or G
nnttnnnttttnnaaatcccttggctacttgttctttttgcagggatcccatcgattcgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtcaaattgtgattgaggaaatgaaaaggtttatactttttaaaaaaaaaaaacnnaanccaaaaaaccaaaacttcaaatggaataaattattcatgaagcccttaaaaaaaaaaaaaaaaaaactcgaacctntaaaactntngngg

SEQ ID NO: 722 - DNA, 751 bp, Homo sapiens
  misc_feature 4, 32, 40, 624, 655: n = A,T,C or G
attnccttggcttttcaaatccttggctactngttctttntgcaggatcccatcgattcgaattcggcacgagattatagagattaatctcctttgctcgaagtctatttaaatattagtcacatctaaaacatacttttacagcaacatctagactggtgtttgaccaaacaactgggcatcatagctgacacataaaattaaccatcacaaccatgttctaggcactgttcctcactgcctgagaagacaccgttatgtttattagggtttttgagttttatccacagcttttggttatctgcaaccatgtctcccaccattaacatagttcacactgagatgaggattccctatttaacacttggtcccaacttcttcacagtccatctggttttgtagagggaacataactggacattctggtcaggttaggtgaggtcaggccttcaggacgctattttcactgagttgctttataaggcacattatgcaaaattccatcagctcttctgttcactacattcactgttgaaattctaagagtgagactgctgtctcacaccaaagccagtgggtactatcttcagtaggcacgcagcatcatgtttgtatttgatccanctagatgacatgtaagagaaaactttattgnggactctgtaaagtgtgacattcgtttgtgactcaatttgctcatgtatttggtcctggggagtcattacatagctaactttcagctgctttcaat

SEQ ID NO: 723 - DNA, 749 bp, Homo sapiens
  misc_feature 7, 14, 15, 24, 30, 31, 34, 39, 314, 449, 487, 493, 544, 643,653, 669, 737, 747: n = A,T,C or G
tttaatncctttcnntaatccttngtttcnngcnctttntgcaggatcccatcgattcgatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcanaaaggctgccctcagctccagcctggaccttgcccccaggtgctgcggctgttgaacctgatgtggctgcccaagcctccgggacgaggggtggctcccggaccaggcttcctagcctagaggagctctgcctgncgagctcaacctgcaactttgtgagcaacgaggtcctnggccgnctactccacggctctcccaacctgcgcttactggatcttcgtggctgtgcncgcatcacgccggctggccttcaggatctgccatgtcgggagctggagcagcttcatctgggcctgtatggcacgtcagaccggctgacttttaccaangagggcaagncccttttgaccagaantggtgcatacactgcgaagaactggactttgaatggccaagggttcaattgagaaagacctggaacangcccttgctnct

SEQ ID NO: 724 - DNA, 761 bp, Homo sapiens
  misc_feature 3, 4, 5, 6, 18, 43, 350, 663, 720, 721, 722, 723, 724, 726,727, 743, 746, 753: n = A,T,C or G
ttnnnnccctttttaatnccttctactaatccttggctctcgntctttctgcaggatcccatcgattcgaattcggcacgagcctcagccttctaaaaagctggggctacacccagctgaagaaattgtaactaaagatagattgtttaaagcaaagcaagaaacttctgaagaaatggaacaaagtggagaagcctcaggaaagcccaacagagagtgtgcaccccagattccttgtagtactcctattgctactgaaaggacagttgcacatttgaacactctgaaggaccgtcacccaggtgatttgtgggcccgcatgcacatctcatccctggaatatgctgcangagacattacccgaaaagggagaaaaaaagacaaagctcgagtgagtgaactgctccaaggcctctcattctctggtgactcagatgtggaaaaagataatgagcctgagatccagcctgctcaaaagaagttaaaggtatcatgtttcccagaaaagagttggaccaaaagagacattaaacccaattttccaagctggtcagcactggattctggacttttgaatctcaagagcgaaaagtttgaacccagtagagctttttgaattattttttgatgatgaaacattcaacttaattgtcaatgaaaccnataattatgcttctcagaaaaatgtcagctttggaagtccagttcaggaaaaaaaannnnnannaaaaaactcgagcctntanaactatngtgagtcc

SEQ ID NO: 725 - DNA, 760 bp, Homo sapiens
  misc_feature 5, 10, 17, 24, 38, 42, 124, 627, 638, 760: n = A,T,C or G
tttcnccccntttttanccccttnctctaatccttggntctngttctttttgcaggatcccatcgattcgaattcggcacgaggcggactctcaggacgaaaagagtcaaacctttttgggaanttcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctactgggctcctttttgactgaggagtcacctgacaaggaaaaacttctatcagtactttgatatgtcacagtttcatgtttatccagttcaatgtatttttaaatttttccttgagacttctttgactgatagattattgtgaagtgtgtttttaaatttncaaatgtttanggattttcatatctttcttatgctgatttccaattggattccttacaatgatttttgggtttcatctgctcttggatgattactatctcttttaaatttggtgtggccaagttttagggccn

SEQ ID NO: 726 - DNA, 741 bp, Homo sapiens
  misc_feature 3, 14, 16, 24, 667, 691, 708, 735, 737: n = A,T,C or G
ttntgccctttgtntnatccttgntcttgcctttttgcaggatcccatcgattcgaattcggcacgagacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggttttttttggttataaaaggaaaatttttgcttaagtttgaaggataggtaaaattaaaggacatgctttctgtttgtgtgatggtttttaaaatttttttttaagatggagttcttgttgcccaggctagaatgcaatggcaaaatctcactgcaatctcctcctcatgggttcaagcaattctcctacttcagcctcccaagtagctgggattacaggcatgtgctaatttggtgtttttaatagagatgagggttttccatgttggtcangctggtctcaaactcctgccttangtgatcgcctcggcctnctaaagtgctggaattcaggcatgaancnccat

SEQ ID NO: 727 - DNA, 751 bp, Homo sapiens
  misc_feature 10, 13, 17, 26, 33, 34, 35, 94, 95, 97, 108, 209, 244, 290,296, 486, 552, 569, 582, 602, 608, 612, 614, 624, 627, 633,663, 667, 669, 675, 690, 692, 694, 695, 697, 699, 700, 721,734, 741, 749: n = A,T,C or G
ccttcttccnaangctntgttgaacncctttcnnnatcgcgcttgcgctttgagctaggataaaaattgggtaaagggacatttgcttacctgnntnatgaatcactntttgaaatgtgatcttgccatatcatcaagaaacttgttttctggatgaatactgggagaataaaatgagaactctggagtgagctaaattgatcccaatnaagtttttctgcttagcagacagaaggtataattntttgacaccctttcccacctggtgcctatgctaggcttgtcctganaacatncctcagtaacttgatattcacatgacctacaggatgtcccatctgcagggctgagtcagttggggaacaccagaggctacacagtagctattcctgctactcggttaatgagcttggcaggttctttgtctcactgaattcttatcatggaaacagcagcagcagccgctaggaaatcttcaagtgtagnggcctgtgctaacccagtggtaaatcccttagatcccctgctggtctctggcaaaactccttgatnttgggtaccatgtatantttgcctttgacntttaacgctttctacgatanggtaancacncntttaatttangcnctggancattaactttctttgcaaaggctacttatngccngncacaantgcagcctcggacanancnnangnnatatcctgttggccatggctntgatgtttgacanccgatangccttctncg

SEQ ID NO: 728 - DNA, 765 bp, Homo sapiens
  misc_feature 2, 4, 5, 9, 16, 163, 256, 278, 298, 301, 309, 315, 330, 333,339, 341, 348, 349, 363, 366, 368, 369, 392, 397, 408, 413,420, 428, 436, 444, 445, 453, 455, 457, 468, 489, 492, 511,512, 540, 551, 552, 555, 600, 609, 615, 628, 645: n = A,T,C or G
  misc_feature 658, 661, 664, 665, 688, 692, 693, 694, 697, 702, 704, 707,711, 712, 716, 720, 725, 731, 738, 740, 741, 742, 750, 757,761, 762, 764: n = A,T,C or G
tngnntttntttaacnttgtttgacgcctttctgcaggatccctcgattcgcactggctacctgcagattgcagagcggcgagagcccataggcagcatgtcatccatggaagtgaacgtggacatgctggagcagatggacctgatggacatatcggaccangaggccctggacgtcttcctgaactctggaggagaagagaacactgtgctgtcccccgccttagggcctgaatccagtacctgtcacaatganattaccctccaggttccaaatncctcagaattaagagccaanccnccttcttnttcctncacctgcaccgactnggncacccngnacatcanngagggtggggagtnccncnntgttcagtccgatgaggaggaanttcangtggacactgncctgnccacatnacacactnacagagangccactcnngatggtgntnangacagcaactnttaaattgggacatgggcgtngtntggccacactggaatccanntttggctgtatgcggaatttcacctgcnaagccaggttnnttnatagacgttcttgattattacataattgccaatcatgtggtgagnaacttgtgngaacantttaacaattaantgtgaagaccgtacaangaattagttaaangcnatnnagggctaaacaagctattacttntgannnaanttaangnatntaanntttnctgnttctnaaaatnttcaatntnnngggaacanttgtaantttnncnt

SEQ ID NO: 729 - DNA, 743 bp, Homo sapiens
  misc_feature 3, 4, 5, 6, 9, 12, 15, 16, 17, 25, 32, 498, 515, 521, 655,666, 715: n = A,T,C or G
tannnnttnctntannntttctgangcccttntgcaggatcccatcgattcgaattcggcacgaggagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccaactgcttcccccanggactgggggctcccangctganctggcccagagcaccatgtcaatgagaaagaaggaggaatctgaaccttgggtaaggatttggggcacagtaccaggaagggggcttggtgccagaccttatgaggaagaaggattttcctatgtacagagaangggaccctgtnctgttgggaagtgcttgtgcaaacctaaccaagttactaacccctctgntttctgtgctacacaaaggggataaatt

SEQ ID NO: 730 - DNA, 744 bp, Homo sapiens
  misc_feature 4, 26, 96, 97, 98, 127, 136, 280, 289, 296, 310, 318, 344,356, 366, 379, 392, 401, 405, 406, 441, 444, 446, 448, 455,470, 473, 475, 483, 489, 492, 536, 572, 576, 594, 600, 635,645, 652, 669, 670, 671, 674, 675, 684, 694, 703, 709: n = A,T,C or G
  misc_feature 721, 722, 731: n = A,T,C or G
tttnttccttcctctaatccttttancgcctttctgcaggatcccatcgattcgaattcggcacgaggggtcctccaagagtttggggcgcggacnnnagtaccttgcgtgcagttatgtcggcgtntgtagtgtntgtcatttcgcggttcttacaacagtacttgagctccactccgcagcgtctgaagttgctggacgcgtacctgctgtatatactgctgaccggggcgctgcagcacggttactgtctcctcgtggggaccttccccttcaactnttttctctngggcttnatctcttgtgtggntgagtttnatcctagcggtttgcctgataatacngatcaacccacngaacaaagcngatttccaaggcntctgcccagagcnagcctttgntgannttctctttgccagcaccatcctgcaccttgttgtnatnancntaggtgnctgaatcattctcanttncntaattgangagtanganactaaaagaatgttgactctttgaatctgctggataagagactngagatggcagcttattggacacatggattttcttcngatntgcacttactgctagctntgctanctatgcaggagaaaagcccatagttactgcgtgtnacaacaactntctaacnaacattcattaatccannnganncctttcaangaatggtaancctatgccnttcaanatactgaacttnntgccacttntggcaaaaaaaat

SEQ ID NO: 731 - DNA, 746 bp, Homo sapiens
  misc_feature 14, 19, 27, 99, 635, 713, 737, 739, 741: n = A,T,C or G
cttattccctttgnaactnactctttntcatccctttgtgcaggatcccatcgattcgaattcggcacgagtgtccttatctgaaattcagcgatcttnttgaataagcatttctctgattgtggtatatgcctttaattttatttctagagtgacaaatttttggttttgacagtttttttctagctttatagtttcttcttggggagagaatatgtcaacctcactccatcatgctgaagtaaatcttcatctcttaattttatctctcaaaaatatcctaaggattccctctggagcctgataagtaattgcagtatctggtttctatggttggatgattcaggattccaggaataatagttactttttagacctctaaagaagaagtaacaaccacgtaaatgaaaagatgcttcttaaatcatggagaatcagggcttagtatcactgtattttcaaactgtttcagccttactttataactgatttagtatatttttcttttaatttcagacttcagtgaagttccttatgacttcccctgaaattgcttccttatcatgggggcaaatgaaagtaaaaggctctaatacaacctataaggactgcaaagtatggccagggggtagtcngacttgggattggagagaaacaggaactgagcattctcctggtgtgcacctgcagatgtgaaggaagttgttgagaanggtgtccagactcttgtgattggncnanggata

SEQ ID NO: 732 - DNA, 756 bp, Homo sapiens
  misc_feature 3, 4, 5, 6, 7, 9, 10, 11, 12, 20, 26, 33, 35, 39, 491, 513,544, 596, 639, 652, 707, 712, 727, 735, 756: n = A,T,C or G
ttnnnnncnnnnatcctttngatttnattcctntntcangtcctttgtgcaggatcccatcgattcgaattcggcacgaggtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcancacgagcggaaccacatcgcanggtattggaagcaagtcggacccattgccgntggctccttctgcctcttcatatttgacatgtgtgagaaaggggtacaactnacgaatcccttctacagtatctggactacagacattggaacanagctggccatggncttcatcatcgtggctggaatctgcctctgcctctacttcctgtttctatgcttnatggnatttcaagtgtttcngacatcantgggaagcaatccacctgccn

SEQ ID NO: 733 - DNA, 742 bp, Homo sapiens
  misc_feature 2, 11, 12, 23, 29, 34, 35, 536, 631, 671, 672, 673, 674,675, 676, 677, 678, 679, 681, 682, 684, 685, 686, 687, 688,689, 690, 691, 692, 693, 694, 695, 696, 697, 698, 699, 700,701, 702, 703, 704, 705, 706, 707, 708, 709, 710, 711: n = A,T,C or G
  misc_feature 712, 713, 714, 715, 716, 717, 718, 719, 720, 721, 722, 723,724, 725, 726, 727, 728, 729, 732, 733, 734, 735, 737, 739: n = A,T,C or G
cntatcctttnntttattccttnataagnccttnngcaggatccatcgattcgaattcggcacgagctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctncggcacaagcttccagctctgcagctggggtgacatccccagtggtttgtcgccaagacatgtggtggacttttcgccccccaaactgatgagtnccggagaatatatggagagagagatgtaaaaaaaaaaaannnnnnnnntnntnnnnnnnnnnnnnnnnnnnnnnnnnnnnnnnnnnnnnnnnnnnnnnaannnnananctc

SEQ ID NO: 734 - DNA, 749 bp, Homo sapiens
  misc_feature 1, 2, 5, 11, 15, 16, 19, 31, 610, 619, 652, 674, 688, 692,727: n = A,T,C or G
nntanaatccntttnnctntaatccctctancaaatcccttgggcaggatcccatcgattcgaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaagggtattggcagccacattcctaagactggggaatggtgtgtccctttaaatttgaagataactttangtaattatnggaactcctcaaagaggagaaagtaattttttncagacattttctcaatctgggnctttcacacactantttncatagtcgagaatctggttttacccattgggctgngaatgtccaatatcagtcctgg

SEQ ID NO: 735 - DNA, 770 bp, Homo sapiens
  misc_feature 2, 4, 6, 7, 9, 10, 14, 15, 16, 19, 24, 28, 39, 41, 44, 468,494, 566, 619, 630, 659, 686, 722, 743, 763, 768, 769: n = A,T,C or G
gngntnngnngttnnnttnttttnaatntaatccttgtntnaantccttttgcaggatcccatcgattcgaattcggcacgagggtgcccatcaccacacccagctaacttttgtatttttagtagagacggggtttcaccatgttggccaggctggtcttgaactcctgacctcgtgatccgcccgccttggccccgcaaagtgctgggattacaagcatgagcccagcgcctggctgtatctttcattttacccaagtcactttacccaagtaagtaattaggggaaagcctgagtcttgtaccacctgttcatttggggaactgtgggaaacggagccaacggacctaagtgccctttgacagtgagtttcataccatttcagtagtgtatttctttcttaatctgaataaaccagaatgatactctcagcacagaagaataaagggagcgagtcattaacgttntctttttaaacctttatgatgacttncttatgaattactgaacgaacactggaatgggactcacgtatcctgaggacatctctcaactctggccttantttcccctctgtaaaattagggtgccaactaaatgatctacaaggtccctttncaagcgcccgncattctgtaattacatcatgtggaactgnattaaacatacaccagtgaactggcangcattgggaatgtaactttcccagtaaaatgctttnggtttggttcaaaatacactntgaacttcttttcaaagacnggttnng

SEQ ID NO: 736 - DNA, 746 bp, Homo sapiens
  misc_feature 4, 5, 19, 25, 59, 71, 75, 90, 113, 114, 139, 219, 280, 411,475, 546, 552, 586, 587, 620, 631, 651, 692, 696, 700: n = A,T,C or G
tttnncttttattcaaatncttgcnggatcccttgattcgaattcggcacgagggatgnccatcgatgctnatcnggcacgaggtgatgncagcttgcaaactggtctacatnncaaactgatagtacattgccatctncaggaagacttgacggctttgggattttgtttaaacttttataataaggatcctaagactgttgcctttaaatagcaaancagcctacctggaggctaagtctgggcagtgggctggcccctggtgtgagcattagaccanccacagtgcctgattggtatagccttatgtgctttcctacaaaatggaattggaggccgggcgcagtggctcacgcctgtaatcccagcactttgggaggccaaggtgggtggatcacctgaggtcagganctcgagaccagcctggccaacatggtgaaaccccatctctactaaaaatacaaaaattagccangtgtgatggtgcatgcctgtaatcccagctcctcagtaggctgagacaggagcatcacttgaacgtgggangcagangttgcagtgagcccgagattgcaccaccgtactnnaacctgggtgacagagcgagacttatcttatanataaatagatngatcttcacctgggtgacanaacgagacttatagatagatagatagatagatggatagatngatngatngatagatagattgataaacggaattgggccttttgctttaatgaaa

SEQ ID NO: 737 - DNA, 751 bp, Homo sapiens
  misc_feature 1, 3, 4, 5, 6, 18, 25, 35, 623, 666, 685, 705, 726, 748: n = A,T,C or G
ntnnnnctttttgatcantcctttnttggatcccnttgctacttgttctttttgcaggatcccatcgattcgaattcggcacgaggctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgacccttcttcaggtagccagcagacagaaacatcttcctaaggatacccttctatctncagactcttcttttgaatatgtcccacctaagccaaaaccttntcgtgttaaagaaaagttnctggacaaaacatggacatngaggatctaaaatttggtcanagcatctgtgaatgagcatgangat

SEQ ID NO: 738 - DNA, 795 bp, Homo sapiens
  misc_feature 17, 42, 48, 50, 53, 77, 80, 100, 112, 115, 172, 254, 257,260, 262, 270, 319, 322, 335, 337, 349, 359, 373, 378, 380,386, 387, 391, 401, 402, 403, 409, 410, 419, 422, 438, 448,450, 451, 455, 456, 458, 469, 482, 485, 486, 498, 501: n = A,T,C or G
  misc_feature 513, 516, 519, 540, 541, 542, 548, 551, 561, 566, 573, 582,598, 604, 606, 611, 619, 620, 624, 625, 646, 647, 662, 682,693, 700, 701, 704, 709, 718, 734, 737, 748, 749, 752, 756,759, 763, 768, 770, 781: n = A,T,C or G
aatccctttgctttaanccttgtttgaacccctttggaactncctctntntgnaggatcccatcgattcgaagagcncangcaggaagagagagaccctnactgctgggganttnctgccacactcaagtccccaacccactggaatctcccctactacaagtgccatgtanaccccttgaaaaggggaggggcctagggagccgaccttgtcatgtaccatcaataaagtaccctgtgctcaaccaaaaaganaantananaaaactcnagcctctagaactatagtgagtcttattacgtagatccagacatgattnganacattgatgagtntngacaaaccacanctcgaatgcngtgaaaaaaatgcnttatntntgaaanntganatgctatatnnntcattnnttaccattntantctgcagtaaacaaantttacagcancnnttgnntngatttcatgtntcaagttcaaggnganntgtttggcgttnatntaattcggcccnacncgngacccttttgcattgggcccnnnacccanctntagttccctnttagngaggggnaattgcgcnctttggcgtaataatngggcanangctgnttttcccnntgtnnaaattggtttatccagtttannaatttcaacacgatnaatatcaaacccggtaagcnattaaatggtnaaaaacnntgnggggngcccttaangagttgaacttaaccnganattaaattgcnnttncgcnttnaatntcccncnttttaaatccnggaaaaccttcccc

SEQ ID NO: 739 - DNA, 763 bp, Homo sapiens
  misc_feature 3, 4, 5, 6, 7, 14, 35, 38, 52, 64, 101, 189, 258, 332, 333,336, 346, 351, 359, 363, 371, 373, 382, 385, 399, 400, 402,410, 425, 436, 456, 457, 471, 472, 473, 479, 480, 494, 496,497, 554, 556, 558, 565, 580, 584, 587, 593, 610, 625: n = A,T,C or G
  misc_feature 695, 706, 714, 727, 734, 739, 761, 763: n = A,T,C or G
ttnnnnncctcatnaatcccttctttgatccctcnccncaaaacccttggcnactcgctctttntgcaggatcccatcgattcgaattcggcacgaggcanccttcgcctcctgggttcaagtgattctcctccctcacatcccaagtagctgggactacaggcacgtgccaccacacccagctaattnttgcatttttagtacaggcagggcttcatcatgttggccaggctggtctcaaactcctgatctcaagtnatctgcccactttggcctcccaaagtgctggcattacaggaatggagccaccgcgcccagcctgatttctttanntangtcttgtcangaaanatattgantctnttgattcntnaacatggcnttnggtcgtctttaatnngnctcatcantgcctccatgtgttnttgatgccttngaactggtatttttaaaatnncaatttctaattgnnnattatnnaaacacaattgggntnnatatattggcattgtattaatgcaactttcctaaactcactagtaattctagtagcntnanttggtanattcttaaggatttnctgngtnaatagncatgtcatctgtgaatnaagccattctttganccttttcaaattttgagccttgtatttcttattcttaccatatcacattggcaaagacctccagtatganattgaataaangtggtganagaaaacaccctnctaaaantgctngaattacaggcatgaaccaccntn

SEQ ID NO: 740 - DNA, 765 bp, Homo sapiens
  misc_feature 2, 3, 4, 5, 6, 7, 8, 9, 10, 16, 21, 25, 29, 32, 34, 38, 679,726, 765: n = A,T,C or G
tnnnnnnnnntttttnaaccntttnttgnatncntctntcaaatcgcttggctacttgttctttttgcaggatcccatcgattcgctagcctgggcaatatagtacgaccctgtctttactaaaaatgcaaaaattaaccacgtatggtggctcacacctgtagtcctggctactgaggaggctgatgcaggagaatcatttgaacccaggaggtcaaggctgcagtgagctatgattgcaccactgcaatccagcctggacaacacagtgagaccctgcctcacaaaaattatattctgattttctgagtccatgaacacattgtccaaatggatttttctagctcctccaagttacagatagttccacgcacacacagaactcaccactctcaaatattttccccactagtattactattaaatttttcaaacatgcaaaagatgaaagaattgctcagtgaacaccatgtacccaccacctagattctacaattaacattttaccctactttctttatcacatatatgtacctatccatctatccattcttccatgaatccatcaattcatctaattttttatatatttcaagttaagttgcagatatgtagcttatgtttcaccttaaatgtttctgcctggctattattaactggagtgcaatatgtttttggntcttctttatggtaaaatctatgttcagtgaaatgcacaagacttangtatgccattaatagggtttgacgaatagacaaaccttn

SEQ ID NO: 741 - DNA, 753 bp, Homo sapiens
  misc_feature 3, 6, 9, 12, 13, 14, 16, 17, 20, 21, 22, 24, 46, 92, 537,569, 639, 674, 677, 686, 708, 719, 732, 741, 753: n = A,T,C or G
ttnganccnttnnntnnttnnntnaatgaagccatttgctacttgntctttttgcaggatcccatcgattcgaggaaggtggaggggcaggnaacaggacggacaggccccgggctctggcacatcctggggaacaagggaccacaaggacgggggcagtctccagacttcccctgggcgcttgaccccaggccttgcaggggagagagccagggcctccctcaggtctttgttcatgctgttttccctgccgtggacaccctttcccgctctccgattctctaaatcctgccccatctcccagatcttgttcatgtccaagcttttccaggaagtcttagcagctcccacaccgcagagctcgagatgtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttccccancgcgtgaagaaccagggcacagcagacttctncccaaccggcacggcacacctgggagtggcacaactgccaccagcattaccacagcatggacgagttcanccactacgacctactggatgcaaccacaggcaaanaangtggcccanggccacaaaggccaatttctgnctggaggacancacctgtgacttnggcaacctnaaacgctatgcn

SEQ ID NO: 742 - DNA, 767 bp, Homo sapiens
  misc_feature 2, 5, 13, 18, 20, 267, 342, 355, 371, 390, 417, 423, 474,503, 527, 531, 551, 566, 572, 596, 603, 619, 622, 626, 642,673, 688, 690, 699, 704, 713, 715, 724, 725, 730, 735, 739,742, 747, 758, 765, 766, 767: n = A,T,C or G
tngancctttcgnttctncnctcctaagcctttgctacttgctctttttgcaggatcccatcgattcgcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttanggcctgaatccagtacctgtcagaatgagattaccctccaggttccaaatccctcagaattaagagccaagccancttcttcttcctncacctgcaccgactcnggcacccgggacatcagtnagggtggggagtcccccgttgttcaanccgatnaggaggaagttcaggtggacactgccctggccacatcacacactgacaganaggccactccggatggtggtgaggacagncactcttaaattgggacatgggcnttgnctggccacactggaatccangtttggctgtatgcngaattncacctggaaaagccaaggttggtntataganggtcttgatttttacntanttgncaataatgggttgagnaaacttaaagaaccagtttaacaataaaatngttagggacccgttnanaaaatggangtctnccttccatntnaacctggannccttnaaacntttntgngtccnaattttcgttncatccannn

SEQ ID NO: 743 - DNA, 768 bp, Homo sapiens
  misc_feature 1, 4, 11, 12, 13, 20, 25, 28, 29, 31, 33, 44, 51, 56, 59,60, 73, 74, 75, 81, 84, 88, 94, 99, 106, 113, 120, 124,125, 126, 132, 148, 149, 153, 162, 170, 173, 192, 193, 208,211, 212, 214, 219, 220, 222, 226, 227, 229, 233, 234, 249: n = A,T,C or G
  misc_feature 254, 274, 286, 287, 300, 313, 325, 334, 336, 356, 358, 367,382, 386, 425, 426, 431, 443, 445, 446, 454, 457, 461, 470,485, 488, 489, 500, 504, 507, 522, 533, 537, 549, 552, 558,559, 570, 571, 588, 590, 592, 604, 614, 615, 616, 628: n = A,T,C or G
  misc_feature 630, 634, 635, 642, 662, 675, 687, 690, 698, 699, 704, 711,713, 715, 716, 719, 724, 729, 736, 742, 744, 749, 765: n = A,T,C or G
naancctttcnnncttcgcnattcnaanngntnggaaagctcantcgctcnatagngcnngggcttcgcgagnnntggganatnacanaggctngttancataccngtttttnactgcanaggnnnccacangcagcatggcccatgnnatgnccatgccantgatggcnggnggccatgctgtcagcgganncgcacttgtgagganccnntntgganncngtanncnacanncacccccagtctggnacccnagtgttcttactacaccaantgaaacgctggnnagccaagagcccngatggcccacgtnccctgcatgganccccctgancngactccaccagcctatacangnggaagccanaagcagctgttttcngccntgccctgctgataatgccttgaagaccccatacgacctnnacggnctacattgacantnngactgtgncancctngatcagatnatcctggaactgggnccnngattccaggancttnccntcaatggacctgggngcttgtaatcngttntggaccatacanccnttgtannagataaaaganngaggaaatctgaaaccntngnaataagatctgnggcattagtnnntcaaggggaggntnggtnncaaaacnctatgaggaagaacgatggnactatgtccatgnaaggggaacatntantgttggannatgcnatgcaancntnnccntgatntaacnctttganaaactnangcttnacaaagggggaaaaanact

SEQ ID NO: 744 - DNA, 757 bp, Homo sapiens
  misc_feature 2, 3, 4, 5, 6, 8, 9, 12, 13, 14, 15, 18, 21, 23, 563, 603,685, 728, 757: n = A,T,C or G
tnnnnncnnttnnnnttnatncntctctcaaatcgcttggctacttgttctttttgcagggatcccatcgattcgcttgacctctgtactttaaaggaaatcactaaccaaattttcaaagtttccttttaaatgcgtttagctagaaatctatgtatttatccctttcctattttgcattcttctcccactatttttaaaaactcatttacagtagaaaccattcttctttctcccaacagtatcctttgccaagaccatgagaacagtaaggagcatgttgttggtcagggtttcagaatacgcgtgatgtcactgagaatgtttgctcacagtcaataattgtctttgtggatgtgataattttggagatacacttctggtcagaactcaggtgagataatcttgcaatactccaaatgcagatactccagccacccgcaaggttccaggaaaggacaatgtcctgcgagaaaatcaggaggcctccacttcctgggccacttgagaagttcctgggcatgtcactacatgttggttgactcagccatttctcatgctgntttgtttcttgcggtggccacttaaccccaaagaatgaanggaggatccacagtgaaagtgcctgagtttctctatgagaccagatgctgtcgaaaccaaacatcttttcctttgctctatnggaacattttaagggttggtttgcacaactggttttcagactnggaagattaccaagtttgggtcccccctn

SEQ ID NO: 745 - DNA, 751 bp, Homo sapiens
  misc_feature 4, 7, 8, 9, 13, 14, 21, 29, 46, 54, 91, 260, 576, 622, 626,676, 680, 694, 700, 742: n = A,T,C or G
cttnttnnntttnntttgatncctctacncaaacccttggctactngctctttntgcaggatcccatcgattcgaattcggcacgaggaanaacagacaggtttcaacatggatggatctgaaatgctgttgaagcatatcatttgcataaaaatcagggacagtttccaaagaattatatatttttttcagttggctctctagttagtttttttgggagtaaggacaaacctggaatagatagcaaaactgaaaatcancagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaatangtttattaaagcatgaaatgaaagggtgcatatcatgcattcaagntatntcctaatttttggtctgacagtgcatgtctttggagcatgctgaaacaanaatnacacaggaattgantaaccngaaagaaacattgttaaatgtccaacatttgttatgcatttntattggggg

SEQ ID NO: 746 - DNA, 760 bp, Homo sapiens
  misc_feature 2, 3, 4, 5, 6, 8, 10, 11, 12, 13, 14, 15, 19, 20, 21, 25,27, 28, 29, 30, 38, 150, 152, 158, 177, 294, 385, 534, 611,631, 672, 688, 709, 720: n = A,T,C or G
tnnnnntntnnnnnntttnnnttcntnnnnctttgaanccctttgctacttgctctttttgcaggatcccatcgattcgctgaaacaaaagatgtatttcaattaaaagacttggagaagattgctcccaaagagaaaggctttactggntntgtcangtaaaagaagtccttcaangcttagttgatgatggtatggttgactgtgagaggatcggaacttctaattattattgggcttttccaagtaaagctcttcatgcaaggaaacataagttggaggttctggaatctnagttgtctgagggaagtcaaaagcatgcaagcctacagaaaagcattgagaaagctaaaattggccgatgtgaaacggaagagcgaaccangctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgatnacatattccaataaaatcttgggccaaaagaaaatttgggtttgaagaaaataaaattgatagaacttttggaattncagaagactttgactacctngactaaaatattccatggtggtgaaagattttcaagcttgngaatttgtaaattttnaactattatctaactaatgtnctgaattgccnttggctgtactgggttatcattttattaatggtaaataaa

SEQ ID NO: 747 - DNA, 786 bp, Homo sapiens
  misc_feature 2, 3, 5, 11, 12, 15, 19, 20, 25, 26, 27, 28, 29, 30, 31,46, 50, 58, 146, 152, 193, 222, 228, 334, 340, 405, 477,483, 503, 545, 566, 631, 635, 646, 664, 673, 679, 711, 723,741, 742, 743, 745, 746, 755, 759, 763, 765, 766, 771, 776: n = A,T,C or G
  misc_feature 777, 778, 784: n = A,T,C or G
tnngnctttannccntttnnattgnnnnnnnttgaaacccttggcnactngctctttntgcaggatcccatcgattcgaattcggcacgaggaggctgtgtcaaagaatgaatggaacgcctactatgaggaggtgggtgtacgtnctaganggagatcgagtacatgatccagaagctccctgagtgggccncggatgagcccgtggagaagacgccccanactcancaggacgagctctacatccactcggagccactgggcgtggtcctcgtcattggcacctggaactaccccttcaacctcaccatccagcccatggtgggcgccatcnctgcanggaactcagtggtcctcaagccctcggagctgagtgagaacatggcgagcctgctggctaccatnatcccccagtacctggacaaggatctgtacccagtaatcaatgggggtgtccctgagaccacggagctgctnaagganaggttcgaccatatcctgtncacgggcagcacgggggtggggaagatcatcatgaccgctgntgccaagcacctgaccctgtnacgctggaactgggaaggaagagtccctgctacgtgggacaaataactgtgaactggaccttggncttnctaacattggncttggggggaaattcatnaacaagttngccaanacctgcgtgggcccctgaaatacattcttttnggacccccttgnatccagaaccccaattgnnngnngaaaacttnaaanaaantnnctttnaaaannntttttnct

SEQ ID NO: 748 - DNA, 722 bp, Homo sapiens
  misc_feature 8, 16, 343, 368, 398, 400, 426, 446, 457, 462, 465, 478,500, 504, 506, 508, 519, 536, 632, 636, 639, 647, 663, 686,687, 705, 720: n = A,T,C or G
tggaactngctctttntgcaggatcccatcgattcgaattcggcacgaggaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcanaaaaggccagaccctgctgagttanaggctgctgggatccactgtttccacacancnggaaggctgctgggaacaggtggcanagaagtgccatgtttgcgtngaaccttgcantcttncanctggggactggtncttgctgaaacccacgagctgnacantnangagctgtccancttgcttggctcactgngaccaggaaagcctgtctttggttagctcgtgtcttctgcaggaaaaaaaaaaggatgtgtcatttggccatgatatttgaaaaaggggaaggatngccnaantttgtttnccatttattccagtanttggaaaattttttgaccccctnngcttaattcttttgcaanaactactggggggtntg

SEQ ID NO: 749 - DNA, 821 bp, Homo sapiens
  misc_feature 4, 7, 8, 20, 50, 135, 208, 211, 221, 229, 355, 407, 408,431, 490, 522, 556, 625, 628, 636, 666, 732, 763, 773, 781,784, 785, 801, 803, 813: n = A,T,C or G
tttnaanncccttgctactngttctttttgcaggatcccatcgattcgtngacatagaaaacatacagtaagaatatggtattataatcttacggggaccactgtcaaatcgcggtctgtctttgaaaagttgtnatggcggcgcatgactataaataccctagctggttagcatttacattccttgccagggagtttgaaatttatnctnggcgggctgnctttaggntttaggtagagttaaagaggtaaagcacatgtttgccacaacccaggaaagtatttttaagaaagatttggattttcctacctttagagatctaaaaaaaatttaatataaaaaatcattttgagntggtgtttattactagttcagaatgagtggctgctgaagggggcccccttgnnattttcattataacccaattttncactttattttgaactcttaagtcataaatgtataatgactttatgaattagcacaggntaagttgacactttgaaactggccatttctgnattacactatcaaataggaaacattggaaagatngggaaaaaaaattcttattttaaaatggcttagaaaagttttcaagattactttggaaaattctaaacnttnctttctgngttccaaaactttggaaaatatggtagatnggacctcattgccatttaagactggttttcaaaagctttccctcaacattttttaaaggtgtgganttttccctttttaaatattccataatttaantttccttttnaaaggccnctnnttttcccaaacccatngncttttggggnaaatcccc

SEQ ID NO: 750 - DNA, 770 bp, Homo sapiens
  misc_feature 2, 6, 7, 8, 9, 10, 11, 12, 17, 20, 21, 22, 25, 28, 42, 45,46, 52, 197, 634, 638, 730, 735, 743, 744, 769, 770: n = A,T,C or G
gntttnnnnnnnctttnttnnntgnctntttctaagagcttngcnnatgctnggtcggcacgaggcaacatttgtctacaactctactgtaaaattggaaatgcttttccacagaaaaacctctcaaaatgctgaatgcaaaagttgggatcacagaaacattgtgcctatttttggtctgctggaaactgtatttntacaaggtaatccctgttctcaatatagttcctgtcttgccactggcggttttcttgtagcatttttctagttctgagattgctactacccaaagtattcatttctttcttactggggtgtcctctgtcttcacagcctgcttctggattgtaggttttttcctttctttctgttgagatatttatggcatttgatagagtcaaaccagatgtattgcagccggacatacttatgtggcttcagatgtgtaaaataagtaacttcctatctttgtctgtctagctcaagagttgactgtggacgaggaatgcctgtattgattcattaatgtaataactatttactgactgcctaccatgtacaaccagaaacacagttcctaacctcatgaacttaccatgtaacatgggaagacaagcctaagttcttatttggntggnaattgcgataacgctcacagaacaaattcccgattcctacgaacccatgtataggggggaaatatttaaggtcccatttaatactgacattngcccncccccctnntattttaagctgagaatctgaaggnn

SEQ ID NO: 751 - DNA, 774 bp, Homo sapiens
  misc_feature 5, 6, 7, 13, 42, 46, 208, 213, 214, 215, 594, 617, 689, 692,694, 707, 708, 719, 724, 729, 733, 736, 753, 757, 761, 769,771, 772, 773: n = A,T,C or G
cgttnnntttccncctttgaagccctttttgcaggactttcnaatncttggtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagacngctcnnnggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtccttttaaatgggtgccaaaggtcaactgtnatgagataattatccctgcctgntgtccatgtcagacttttgagctgatcctgaataataaagccttttaccttatctggaaaaaaaaaacattntanancaaaaaaaaactnngagccctttanaactnttagngagnccnttttccgtagaatcccngacntggntaaggaancnnnc

SEQ ID NO: 752 - DNA, 778 bp, Homo sapiens
  misc_feature 2, 9, 10, 13, 22, 33, 46, 59, 123, 210, 714, 725, 735, 764: n = A,T,C or G
gntttgaannccnttgtttcgnatcctttttgnaggactctgaagncctttgttcggcncgagaagaaactctgcctcagaaaatgtttacagcttccagtggaatcaaacataccatgaccncaatttatccaagttctaacacattagtagaaatgactcttggtatgaagaaattaaaggaagagatggaaggggtggttaaagacnttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactgggaaatatttttaagtggaaccaaaataggcatcccttaccaaatcaaggaagactgacttggacaccgtttggaaaatgggtaaaaacggtggnttactggtganttggggagcnagaaccggacccactggtatactggggantaacaatttttttc

SEQ ID NO: 753 - DNA, 775 bp, Homo sapiens
  misc_feature 207, 380, 627, 678, 701, 704, 725, 738, 753: n = A,T,C or G
gcttttgaaacccttttgttaacgcctttctgcatgatcttctcgtccttgaaagggccctaaaagagatgaacaataccgtatcatgtggtttgaattagaaacccttgtcagagcccatatcaacaactcagagaaacatcaaagagtcttggaatgtctgatggcatgcaggagcaaacccccagaagaggaagaacgaaaganacgcggctgaaagagggaagacaaagaggacaagtcagagaaagcagtgaaagattatgaacaggaaaagtcttggcaagactcagagagattaaaaggaatcttagaacgtggaaaagaagaattggctgaagctgagattataaaagattcgcctgattccccagaacctncaaacaaaaaaccccttgttgaaatggatgaaactccacaagtggaaaaatcaaaagggccagtgtcgttattatccttgtggagtaatagaatcaatactgccaattccagaaaacatcaggaatttgctggaccgtttgaactctgttaataacagagctgaactatatcaacatcttaaagaggaaaatgggatggagacaacagaaaatggaaaagccagccggcagtgaagagtgacttgangaactaaattttagcatattgcaaaaatattttgtgcgggaattcgatatnagtacttttaccagcaagatggnatngttatgtttgcctggactggnttttacatttttnaaattttttcagtgnccttttttggtcctaaattatc

SEQ ID NO: 754 - DNA, 1032 bp, Homo sapiens
  misc_feature 3, 4, 31, 36, 42, 44, 48, 49, 52, 67, 74, 78, 86, 94, 109,110, 134, 142, 149, 189, 191, 193, 199, 206, 215, 256, 257,267, 295, 301, 316, 346, 349, 389, 391, 426, 436, 445, 448,659, 736, 749, 820, 859, 864, 915, 934, 937, 940, 953: n = A,T,C or G
  misc_feature 954, 986, 996, 997, 998, 1004, 1006, 1022: n = A,T,C or G
ggnntttttcccaaaaaaaaggggccccctnggggntttttncncaannggncccctttttctttgnccagggnaacnttttttgngaaaaganccccctttttggatnnaccggggccccccggaaggttccnaaattttnagggttnaaacccaaatccttggggaaaaaaaaaaaacccagggccntntntggggnccccctngggggggtngggaaaaaaaaaaaagggggaatggcccccaaaaaaaaatnnggggcccctngggggaaaaaaaagggaaagcccaggtngggaanggaaagggggaaggntcccccggggggaaaggaaatgggtgggtnggnaatggcccaatggttggaaaaggcccaaaccaatttgggntntaaaacaatttcaacctgggggggtcctggcccanaaaaaatgcngggcacccncgnggggtctggcttaagaattggttacaagggcaaagggaaagggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgncattggactaacaaacagaatttacaagttggaaattttcctacaatgaatggtgtatctcaagttttacagaatgntcttaatcacagnaataaaatttctctgtgcatgcctgagtcttcagcagcaaaaatactcctccgaagtctgagaaaaatggnggcagcagcccaagaagagtgatgtaggcacagataacnaaggntaacctcctccagaatccccagtcaccactgcactggttaagcagaacttngcaggagcaaaaaagcccnganganggaaaaaaaaaannaaaaaaaactcggagccctcttagaactatanggggggccgnnntaccgnangatccccgacctgaanaggaaccccc

SEQ ID NO: 755 - DNA, 798 bp, Homo sapiens
  misc_feature 1, 3, 4, 5, 6, 7, 11, 12, 16, 19, 44, 47, 57, 70, 104, 114,119, 219, 220, 227, 229, 230, 284, 363, 382, 446, 488, 583,602, 624, 625, 633, 636, 657, 663, 685, 694, 710, 721, 725,733, 735, 750, 751, 761, 771, 774, 781, 789, 790, 793: n = A,T,C or G
  misc_feature 794, 797: n = A,T,C or G
ngnnnnntttnncccnacnaaatcccttttttgaagccttctantgncttcatcgtnctggtaaattggntgaattattgtattgaagcttgagctgtattttnaagtaatttnggttncccctaagatgttattatgttagggacataacacttttgggaggttgttgtgggagatggttgatttaggttttcaaaagctagaaataaaatttacatnnccccggntnncataaaattctgctctaattgggtggaaggtgctgtatctaacttgtgttcctnctaaggttatgtcctaataactattcttttaggagtatacttctactttatagaaggttgctttttctttttaattttntctaacaaagaaaagaatnaagtatttattaataaagaaccagaaagcacttgaaactgatgtttttaaatgggctcacttanggtagatttatttatctcattaacttaaaaacagctatgtgnattgaaataagtcacaacagaacttgaacaccagggtgggtgtctgagcaatcccctttcttatggggaaaaacaaatggttcttgtttgaacangaaggtatcattgcagtcngcattcacccgtgtataattgnnatataagntgnataatatgctcgtaaaggctnaaggtnagctggatctggatgccctttnaccaattangattttaacttttaanaataaaatttnaaanctaattgncnaaataaaaaaaatannaaacttcggncctctacaanttntagatgngtcgattnncgnncanc

SEQ ID NO: 756 - DNA, 834 bp, Homo sapiens
  misc_feature 11, 15, 18, 39, 42, 79, 86, 88, 91, 92, 94, 98, 102, 112,114, 115, 139, 153, 170, 172, 173, 175, 181, 195, 214, 225,261, 301, 325, 339, 351, 364, 378, 387, 414, 418, 434, 437,456, 463, 475, 482, 483, 497, 500, 501, 507, 517, 525: n = A,T,C or G
  misc_feature 529, 537, 538, 539, 553, 575, 596, 598, 610, 617, 621, 624,630, 633, 640, 642, 644, 645, 649, 651, 657, 658, 659, 661,662, 668, 671, 676, 683, 684, 686, 687, 690, 692, 697, 700,702, 716, 719, 728, 735, 751, 753, 755, 766, 771, 773: n = A,T,C or G
  misc_feature 774, 785, 797, 811, 813, 819, 821, 823, 824, 829, 830, 831,832, 833: n = A,T,C or G
tttgaaacccntttnttnaagcctttttaatgactttancgncctttattcggcacgaggtccttcagctggtagcttncattcgnanttnnanatantatntgtgcatgcncnnttgaatttttgtggaagaacagantgcagaagaaggcnaggaaagccgaagagantnntncggcancagaagcttaaagnaggccaaactggtggtgcnctttcctcggnacagaagctggatgactatggccaatttggagaaanagctccaggagatggaggcacggttcgagaaggagtttgnagatggatcggatgaaaatgaaantggaagaacatganctcaaagatgangatggatggtaangacagtgatgaggnccgaagacnctgagctctatgatgaccttttactgnccancatgtgacaaatcgtnaanaacagtaaaggccatgaanaatcacntagaagtcaaangaaagcnnttgggaaaaatggnggnnctttgntaaaaccacnagctggangganggaagaannnaaaattttttaagnacctcaaattgattgaaaaatncattatgatgacaattcctgnangaataaattggnagatgcnctanaancaaaangcnttttttnantnnaaananacaaannntnnagcctnttngaacntatagtnnannctncntttanctntntatcccggactttnttntggataccnttgactnagcttttggacaaaancncnactttgtattncattngnnaaaaaaatgcntttatttttcgnaaatttggtgaatncntaattngntnntattnnnnnc

SEQ ID NO: 757 - DNA, 1062 bp, Homo sapiens
  misc_feature 17, 23, 36, 39, 41, 43, 44, 74, 83, 101, 111, 138, 140, 146,150, 159, 170, 184, 203, 209, 258, 262, 270, 274, 277, 290,298, 345, 361, 383, 387, 392, 405, 428, 444, 454, 466, 483,492, 542, 562, 577, 608, 694, 721, 742, 757, 798: n = A,T,C or G
  misc_feature 867, 874, 889, 891, 896, 900, 901, 904, 905, 907, 908, 911,912, 915, 918, 919, 924, 925, 928, 931, 934, 936, 937, 938,941, 943, 946, 947, 949, 951, 953, 954, 956, 957, 958, 959,961, 963, 964, 965, 967, 968, 978, 981, 982, 983, 987: n = A,T,C or G
  misc_feature 992, 998, 1001, 1004, 1005, 1010, 1011, 1014, 1017, 1018,1024, 1026, 1027, 1028, 1031, 1032, 1040, 1044, 1053, 1060,1061: n = A,T,C or G
tttttccaaaaaaatcncccccnttttttggccttnaanananngggcccccttttttttgggccaggggaatncccccaatnccggaattttccggggtntttggggggnttggaaagggccccttggggaaagggncntttccnaagnaaaggggtnggaaaattttntaaatggccttttnggggggaaaaagccccctnggaatncccccaaaaaacccttgggaaaaaggggggaaaaaggggggaacctttngggnaatccttncccnttnaataatttggggnaattaaanccctggtttgggaaagggaaaagggttggtcttggtcttgggggaanggaattgggggccaanttaaaatggaaggtttggccanaatnggccncttcgggggcttnttcaaaagccaagcctttggganccctgcttcatttttngggccctttnctgccaaggaancccaacccttaacttancaggaaaanggagatgaaaggccttcttccaaggaaggtaaggtcctttggctgccccnacttaaatgctttttgaaantctcttagatgtggnaaatattttttccgaaccttgaaatcaactnggtagaatttcaattggaagcataatccattgtaaaatatattttagttgatatttggtaaaatgccttttttggtggtgtggttngaatcctgggtttcccaagaatcttgnatttcaaatggtttaacaaangggaaggaaagggancttttcccttaaccttccctttttgaccaggaaagattttnaaaagtacctttctttttaaggaaaaaaaaaaattaaattttgaagaaaaattgggatttggattttanaaaaaangggaaaaaaaatatnantattnatanntcnnannatnnttnatnntctanntanttnctntnnntantnctnntntntnnannnnanannnannaaataaatantcnnncatncttanctacanatnccnntcttnnttntannactttnannntanntatctaantctntccctattntaccctnnc

SEQ ID NO: 758 - DNA, 845 bp, Homo sapiens
  misc_feature 4, 10, 14, 27, 29, 51, 70, 76, 97, 120, 122, 154, 162, 163,203, 210, 212, 217, 220, 226, 243, 255, 263, 266, 270, 273,284, 290, 314, 328, 403, 413, 418, 421, 468, 471, 472, 475,494, 499, 511, 517, 539, 561, 568, 584, 585, 590, 611: n = A,T,C or G
  misc_feature 620, 623, 633, 640, 641, 651, 655, 664, 669, 670, 684, 696,709, 715, 717, 719, 721, 726, 756, 769, 771, 778, 791, 793,795, 806, 808, 829, 836, 837, 845: n = A,T,C or G
aaancccttntttnaaatcctttttanangattcatcgattcgaattcggnacgaggcgctagcgtcggntccgcntgggcccttgcggtgcgctgngggcaggcggtgaggcttacgcntntgcttacgggcaaaaacctgcacacgcaccanttcccgtnnccgttgtccaacaaccagaaggtgattgcctttggggaancttctangncaacnacntgaacntatggacagtgcgctgntttggacagaantgggaacnttnaggntgntgtgcgcttcnagcatntgggcacctttgtgttcctgtcantcacgggtgagcantatggaagccccatccgtggggcagcatgaaggtccacggcatgcccaattgcaacacgcacaaatacttggaangccatggaangcatnttnatcaagcctaatgtgggagcccttttgcaagtcacgaattaactctnaanngtntggatggattgggtgggantgganggttgcaagttngggccnttttgaaaggccactttttggnaaaaaacttttgggtttttaangggttcntcaaaatgccctttgnnaattnaaagaaatgttgggcctattnaaaaaaaanatnatactttatntaatctnnataataatanttantaataaaantcttnnagcctttttaaaantttttaatgaanctctttattttancgttanantncntaacntttaattaaaggaataacaatttgttgaanttttggtataaanancccccantttttaaaattcntntngaaaaaaaatncntttattttggtaaaaatttgnggaatcnnttttgctn

SEQ ID NO: 759 - DNA, 947 bp, Homo sapiens
  misc_feature 2, 15, 17, 37, 53, 54, 55, 56, 57, 63, 66, 81, 95, 97, 106,111, 112, 113, 114, 120, 121, 125, 127, 131, 133, 139, 143,154, 168, 170, 179, 180, 181, 187, 195, 198, 200, 201, 202,203, 210, 212, 219, 222, 231, 237, 238, 247, 248, 254: n = A,T,C or G
  misc_feature 262, 265, 273, 280, 293, 312, 322, 323, 332, 353, 356, 370,402, 408, 413, 422, 428, 454, 466, 472, 488, 500, 514, 538,559, 566, 577, 606, 607, 609, 612, 619, 626, 628, 660, 664,666, 667, 674, 678, 679, 680, 697, 710, 715, 724, 733: n = A,T,C or G
  misc_feature 736, 740, 741, 756, 757, 758, 759, 762, 763, 766, 768, 776,778, 783, 792, 801, 824, 826, 841, 842, 857, 870, 873, 874,879, 891, 893, 896, 898, 899, 907, 912, 913, 914, 915, 921,926, 935, 941, 942: n = A,T,C or G
tnggggggggccccnantttggggccccaaacccttnggggaaaccccccttnnnnntttttnccnttttgggggggaaangcccccccccaaangnaaaaacccnttttnnnnaatttnngggnangggntntggggncccnttaaccccaangggggggggttttnancctgggggnnnaaaatngggggaanaantnnnnaatgggnantcccttnaangggaaaaanaatttnnccttaaggnnatgggncattaatnttnatccctantggattncaatttcattcgnattaaaggcttttactggnataatccttnncggcccgcnctggtagtttaaagtgcccanaanttgaatgggaaatnacgggttttgaaaatcgcacaaagcagtgccnggcacngaggngtcacgccngtaatnccagcattttgggaggcctgaggcangcggatcacganggcaanagagtccagaccattnctggctaacacngggaaaccccgggnctaataaaaaatcaaaaattaggntggacatggtggcacgtgccngtaatcncagctacttanggaagctggatgcaggaagaattgcgtgnnanccnggccccngtggaangntgcattgatacgaagaaccgtgccaaatgaanttanannctgggcngaannngagcggaaaaagccctntttaaaaaaaaangggantggaaaaantggtgccanagncatnnggggaaaaaattttnnnnttnnttnancggttttnancttgnggaaggccntctttaatnttggggaaaaggcacttttgggntnggttttggaaaacgnntggcttttccctttnaaaagggaaaaanggnnttaancccctgaaaaangngcngnnttttaaanggggnnnnaaacanggggnctttggaanccccannaaacc

SEQ ID NO: 760 - DNA, 759 bp, Homo sapiens
  misc_feature 2, 3, 18, 19, 20, 21, 22, 25, 29, 180, 366, 567, 646, 660,681, 683, 720, 726, 751: n = A,T,C or G
gnntttctaatgcttgtnnnnngcntttntgcaggatcccatcgattcgaattcggcacgagaagatatgcagagatattccaggatcttttagctttggtgcggtctcctggagacagtgttattcgccaacagtgtgttgaatatgtcacatccattttgcagtctctctgtgatcangacattgcacttatcttaccggctcttctgaagggtctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcanagcatgattatggattatttcatttaaaaagttctttaaagaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtanaaggagctcatacatcacggacgatgagtattaatgctgcagagttaaaacagcttctacaaagccaaagaagaaagtncagaaaaatttgtnccttgaactagagaaacttgntntggaacatttcaaaagatgaatgacaatctggattcnttggtngacagtgtaatttggactttaaccngatgctcg

SEQ ID NO: 761 - DNA, 752 bp, Homo sapiens
  misc_feature 4, 18, 21, 25, 28, 29, 90, 102, 199, 364, 568, 570, 607,627, 638, 682, 746: n = A,T,C or G
cctnactaaacctttgcnaangccnttnntgctgatcccatcgattcgcaggcctggacttcgcccccaggcctaggaccgcggtgggtnttaaccctgctnctgccccaacagggactccaatcaatcggagttctccccttgccggagctgcccttcacctttggggcccgagacagtcataagggatggacttacntttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcangaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactggttacagctggccagtgcananctgctgctcttttacctttttaggcccctgtaacttnccacctttaaactgcccaanaagcatgcctnttccacaggaagaagggagcagacagggaaatctgcctaccaanaagggtgttgtgtgtctttgtgcccacacgtggtggctggggaatgcctggatggtgccgtggntgatct

SEQ ID NO: 762 - DNA, 1032 bp, Homo sapiens
  misc_feature 20, 27, 29, 33, 78, 86, 112, 128, 131, 133, 135, 138, 140,144, 149, 152, 158, 160, 162, 163, 164, 167, 171, 176, 182,186, 190, 194, 204, 208, 209, 210, 211, 217, 220, 233, 239,242, 244, 248, 254, 256, 260, 264, 265, 269, 272, 273: n = A,T,C or G
  misc_feature 277, 280, 292, 294, 296, 303, 305, 306, 307, 310, 313, 314,317, 321, 323, 327, 329, 333, 335, 345, 348, 352, 355, 364,373, 379, 383, 391, 393, 394, 398, 399, 400, 401, 425, 435,439, 440, 451, 453, 458, 459, 460, 461, 462, 464, 468: n = A,T,C or G
  misc_feature 471, 473, 474, 477, 481, 487, 490, 494, 500, 506, 507, 508,510, 511, 513, 514, 518, 523, 530, 545, 546, 547, 551, 553,556, 562, 566, 571, 578, 580, 583, 591, 594, 602, 606, 607,608, 612, 613, 621, 624, 627, 629, 645, 654, 658, 662: n = A,T,C or G
  misc_feature 663, 665, 666, 667, 679, 681, 683, 684, 689, 695, 701, 702,706, 708, 712, 719, 723, 726, 730, 733, 734, 741, 749, 754,761, 767, 771, 772, 775, 788, 791, 798, 800, 804, 815, 816,817, 822, 828, 829, 830, 832, 836, 853, 859, 865, 867: n = A,T,C or G
  misc_feature 869, 874, 879, 882, 885, 900, 902, 907, 912, 915, 916, 918,923, 925, 935, 937, 945, 948, 953, 956, 962, 968, 971, 973,979, 988, 994, 998, 1000, 1001, 1015, 1020, 1030: n = A,T,C or G
ttctaatgcttggaaacgcnttgatgnangatnccatcgattcgaattcggcacgagggcaagtggtagtggcgcttntcgggtgntgtgcttcacgttttggtctaaaggncgagactgttgtggcnacngngnaantntacnggaanggnttaaantntnnntgnagtnggaanaattcnatcngaangaanttgggggggntagnnnnggttanatnattgatgaatggnttcaanatngnaaantttatnancganatgnnatanttnnaaangangaccaactgggntnanatggagnannnatnaannggntaancnatananatantncatttggtanganaatngangaaggattntcaaatagncatgtnggangatgaacntnnaggnnnnagaatatttggataaaattggtantatgaagatntggnntaataataccnanaaatnnnnnantttnatnanngangaantagganttnatgnctatgnggatannntnnanntatnatagngataaantatgatactgtttannntatntnganttagtnattnaatgntcttgtnanaanttattttncgntagttagntagnnntatnnactttggnaancananatgtaattctctctanacgggaatntttntatnntnnntatcaagaggtntntnnattgnaaatantatacnnttgnanaaantatatcnatanaanaaanggnnattattntatatgancaaanaaaaaantattgngganntanattatctctcatnatngattatncngtantgtataatggnnnataantatgtnnntntaanataaatggatataagtnttatantatgcncntnaaggnggtcnganaantatgtaattatattnangctanatacnatnnanatgtntnactaaatatngntgtgaaangtntgcgnggnaaaatntgttantantnaaacanggtataganatatanatgngnngaatatctactatntgtanatacttatanca

SEQ ID NO: 763 - DNA, 817 bp, Homo sapiens
  misc_feature 3, 4, 10, 19, 33, 90, 208, 209, 214, 317, 333, 371, 433,462, 480, 505, 506, 512, 520, 538, 558, 562, 569, 573, 580,585, 603, 606, 608, 627, 631, 658, 659, 663, 664, 671, 675,677, 679, 684, 692, 695, 697, 703, 713, 720, 746, 747: n = A,T,C or G
  misc_feature 778, 781, 782, 791, 794, 801, 813: n = A,T,C or G
aanncccttntttctaatncttggctactcgtnctttctgcaggatcccatcgattcgaatttcggcacgaggggagggacccttggggncaggttgtgggtagccagttgcagtctgtggcctccctcagaggtttggagtcgggcgtggcatgctgctgttggcctctttccgagggagtgccatccactccctgtcccaccgctnnccctngtgaggacagtgagggcagtgctacgtggtggggaggtgtgtgtgaagccacggaagggcttcacagggcaaatgccaaggccagtgggccccggacagagtnaggctccctgggcggncttgtgtcttggtggccctgatcatcctgccaatgcanaaagccagcaggcaagagacccctactccctttaaggaccattagcataaacaaaccattgngttgaatgcaatgatccaggtgcactttnagggtacaagctggactngttggaacaggattacatggaaaannggaaangggggcangctgtctcttgggacatnagtaatgtctttttacccanttgncactctngaanttcaaanttggncatgttttctggggcctnctngnaaaagcagttttttcaccncatnatgaagaaaaaacttgttggcttgganngtanngggattnttgntnanacttnccctaaanggntncctttnggggcatttntgaaggntaaataatgggggatacctttttaannttccttgcagatttaaaaatgttccttaaanganncctcaatgnttnggtcttnttccaaaaaacnattc

SEQ ID NO: 764 - DNA, 777 bp, Homo sapiens
  misc_feature 11, 17, 22, 203, 205, 377, 551, 603, 606, 672, 682, 687,721, 723, 735, 739, 759, 765, 768, 776, 777: n = A,T,C or G
taatgcttggntctcgnttttntgcaggatcccatcgattcgaattcggcacgaggtccacggtgctgaacatcatcatctttgaagactgtaggaaccagtggtctatgtcccgaccactacttggcttgatattgcttaatgaaaagtatttttctgacctaagaaacagtattgtgaacagccagccacccgcgaagcancnggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctncttggactctacctgtacagagcagcgtccctttggtttggcccagaggggcgaacaattgcaagggagagggcctggctgatcctggctcttttctccaggggtgtggggaaaaatggcaaaggtcaactagctgcttccccaagggaataggggtgtgagtacactcactanggggcaaggcgctgcttggttcctggggggactgggtgggaaagggtggtgnganggagataaagagattcaaactgagactccagtctttccttctgggggccacccaaagttggggagnaaccccctantggtncctgccaacaaccttgccttgggattaaacattntncatttttttcantaanatttttgaacaaagggttantattgnctnaagtttann

SEQ ID NO: 765 - DNA, 774 bp, Homo sapiens
  misc_feature 1, 22, 32, 199, 200, 656, 685, 699, 725, 737, 739, 774: n = A,T,C or G
ntttctaatgcttggctctcgntttgatgcangatcccatcgattcgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatgganngtgaactcggagagtctagtgccacaatcaataaaagactctgcaaaagtacaatagaactttcagaaaattctttacttccagcttcttctatgttgactggcacacaaagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaaangggacatatttgaaaaatcctgggagaanggactatttggctncttttgccaacttacttcatactggnaagccagattantngctcaaggaagttttgatgagccaaaaaagttttn

SEQ ID NO: 766 - DNA, 779 bp, Homo sapiens
  misc_feature 3, 4, 5, 10, 11, 16, 29, 43, 45, 54, 55, 104, 116, 639, 659,738, 743, 764, 770: n = A,T,C or G
ttnnncgctnntgaanaccccttctcctnaaatcctttttaantnccttgctgnntgatcccatcgattcgcgaaattcggtggcgccacgtccgcccgtcttngccttctgcatngcggcttcggcggcttccacctagacacctaacagtcgcggagccggccgcgtcgtgagggggtcggcacggggagtcgggcggtcttgtgcatcttggctacctgcgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaaatggatatgcaagttgctgatgattcctctgatcatgtcagtactttatgtctgggcccanctgaacagagacatgattgnatcatttttggtttggaacacgaatttaaggcctgctatttaccctggggtatccttggattcaactatatcatcggangctcngtaatcaatgagctaattggnaaattnggtggacac

SEQ ID NO: 767 - DNA, 799 bp, Homo sapiens
  misc_feature 2, 3, 4, 5, 6, 7, 10, 20, 25, 137, 201, 230, 237, 245, 260,650, 653, 761, 777, 798: n = A,T,C or G
gnnnnnnttncccgcctttngaaanccccttctttctaatgcttgttcaacgcctttgctgcaggatcccatcgattcgtggatactgacaatggtggcaggcatttcaagccttttaaattagtactttttgtcgncttgcttattaaaattttgttaattttagcaaagaccaattgttgtgataaactggtgtttttnggatgcttcaagcacacgttaaccaatcngccaatncccctttnggttcctcccattgntctaaaataggactttcatattattaaaacctcaaaagatgatccacccaggatgaacaaagatcaccaaggggaaagaaaacattttttatctttacagaaaacatgttaagattatatatagatgtattctttacattggatattgtattagagtcctccttacaagaaatgaaataggtttttagcactcttagcattagagttcctagattggtgttgatagctacagttttaaaatgtataacctgaaaatgaaggttaattttgcattgtaaagagcacatttgatctatgtaaaaagtgtccatttggtgtattttttttaaaaaagagaaagcactttcatattaagtagcatgtgtatgaatttaagattttcatatttgntgngtctggtattcagtgaagtaaaattgagcattttaaaagtttggtggatggcaaccattaactattaaattaaaagccaccttatactctgctgcttaacttgcttgnaaattgcacctttggnaccctgcacattttcatattnc

SEQ ID NO: 768 - DNA, 826 bp, Homo sapiens
  misc_feature 2, 3, 4, 5, 7, 8, 10, 45, 70, 227, 474, 484, 495, 521, 554,623, 645, 681, 682, 683, 686, 689, 707, 712, 714, 721, 740,753, 762, 766, 776, 787, 795, 798, 810, 814, 816, 820, 824,826: n = A,T,C or G
gnnnntnncnccctttctaatggcttgtttctaaatgctttttcnaatccttggtacatgatcccatcgnttcgcgctgtgcttgagaccaacctgacgggtaccttctacatgtgcaaagcagtttacagctcctggatgaaagagcatggaggatctatcgtcaatatcattgtccctactaaagctggatttccattagctgtgcattctggagctgcaagacngggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacaagtnggtggatgtngatgggggccnggagtctctatactcactcgtatgangtccagatcatgacaactggcccaagggagcangggacctttctggtgtcaaaaaagatgaaaggagacctttaaggagaaagctaagctcttgagcttgangaaaacaaggggtccttccatnccccaaatgcctttacatttttggaggatatgcctnnnggnacntttttaaaaaagcttatnagttngntatgggnaaaacaattttttccttantttttaaagtggntaataaatnaaantcctaatggnaaaaaaactantccttggnaantattttccaggncttnantgtncccncn

SEQ ID NO: 769 - DNA, 802 bp, Homo sapiens
  misc_feature 2, 3, 4, 33, 39, 345, 395, 398, 588, 592, 596, 663, 673,685, 700, 702, 714, 753, 757, 761, 775, 778, 781, 784, 787,789, 791, 797, 799: n = A,T,C or G
gnnnttctaatgctgttctaatgcttgtcaatncttganacgttcatcgattcgggaagccaagcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcccgggtgcactgagggtggtgggaggggatcacctgggttccaggccatccttgctgagcatctttgagcctgccttccggtgggagcagaaaaggccagaccctgctgagttagaggctgctgggatccactgtttncacacagcgggaaggctgctgggaacaggtggcagagaagtgccatgttngcnttgagccttgcagctcttcagctggggactggtgcttgctgaaacccaagagctgaacagtgaggaggctgtccaccttgcttggctcactgggaccaggaaagcctgtctttggttaggctcgtgtacttctgcaggaaaaaaaaaaaggatgtgtcattggtcatgatatttgaaaagggggaaggangccnaaanttgttcccattttattcaagtattggaaaatatttggcccccctttggctgaaattctttttgcaanaactaactgngtggcttgttcncttaccctttttcangnttaattggtttnaattttttgcattgaaattaaagacgtttttaaatttcntttncaanaacaaagggcttanatnccngantcnananattggnanttc

SEQ ID NO: 770 - DNA, 1157 bp, Homo sapiens
  misc_feature 19, 20, 28, 36, 40, 51, 63, 78, 93, 94, 96, 104, 105, 106,107, 108, 109, 110, 111, 118, 130, 131, 132, 133, 134, 135,139, 140, 142, 143, 144, 145, 146, 147, 149, 150, 151, 154,155, 156, 157, 158, 159, 160, 161, 162, 163, 164, 165: n = A,T,C or G
  misc_feature 166, 167, 168, 169, 170, 173, 174, 177, 178, 179, 184, 185,186, 188, 189, 192, 209, 210, 214, 246, 247, 248, 265, 274,276, 281, 307, 314, 344, 346, 347, 360, 374, 376, 385, 388,390, 434, 436, 451, 456, 459, 466, 509, 515, 516, 528: n = A,T,C or G
  misc_feature 535, 547, 550, 561, 591, 598, 628, 636, 652, 657, 721, 737,764, 769, 785, 804, 810, 811, 816, 821, 823, 824, 836, 837,848, 849, 854, 868, 869, 873, 877, 890, 915, 932, 936, 941,952, 973, 976, 984, 986, 998, 1005, 1026, 1027, 1037: n = A,T,C or G
  misc_feature 1041, 1047, 1052, 1060, 1064, 1066, 1069, 1073, 1074, 1075,1080, 1091, 1092, 1096, 1099, 1102, 1105, 1109, 1112, 1114,1138, 1140, 1145, 1146, 1147, 1149, 1151, 1153, 1156, 1157: n = A,T,C or G
cccttttttttttttcccnnaaaaaaanattggggncccntttttttgggnttttttttcccnaaaaaaaaattgggnccctttttggggggnntnaaaaaaannnnnnnnccccccntttttttggggnnnnnnaaanntnnnnnncnnnttnnnnnnnnnnnnnnnnnggnnttnnnggggnnnannccnccccccaatttcccggnnattnttccgggcccaatttttgggaccccccagggnnnagaataaggcccggggnttttttttncnagggncccaaaagggcccttgggccaaaggnaaatccnttgggaaattttgggaatttggcccttggnanntcccaataccggnaaaaatggggaaangnaaaaaaggnttncnccaaattggttgggggggggttccaaagattttcattgggggtncntgggctttcaacccnaaggnaangggtttnctttcaaaaaattacctttaattgccattaagcaattcccaanggttannaaagggtgtttnttctcanctatgcttcganagngaaaatcaacnaatggaaaatgtgttgtaattggtctgcantctacangagaagctagaacattagaagctttggaanagggcggnggagaattgaatgatntttgnttcaactgccaaagagtgttgttgcagtcactcatttgaaaaactattttcctgctccagacangaaaaaaactttatangtttactaggaatcgatttgacaagcnttcangtaacaaacagttctnccaagagatatccttgttnaagaannattanaatancnngaaagcggaaanngtgaataaatnncttcnagaagcccaaaaanncacngaanaagtatggtgggncttactggttagcacgttcttgacnacagatggaaattgaantctngattncctctgattantgaatgaaaaggtgactattnaanagctcttnanataccatgagtntttggancattgattgaccaatttcaannccatttttangatngaattnttatnaatgattnattnanaantgannnccttngtttaaattannaaanaanccntcnaaanacnanaggggatttataaaatctaataananttttnnncntntnaann

SEQ ID NO: 771 - DNA, 760 bp, Homo sapiens
  misc_feature 1, 3, 9, 12, 17, 22, 25, 30, 35, 39, 40, 41, 42, 43, 105,520, 588, 664, 670, 759, 760: n = A,T,C or G
ngncctttnatnccttntgaanccntttgnaattnctcnnnnngttgatcccatcgattcgaattcggcacgaggtggaagaaaattttttgctgcttctggttnccagaaaagggagccattttaacagacacatctgtcaaaagaaatgacttgtcgattatttctggctaatttttctttatagcagagtttctcacacctggcgagctgtggcatgcttttaaacagagttcatttccagtaccctccatcagtgcaccctgctttaagaaaatgaacttatgcaaatagacatccacagcgtcggtaaattaaggggtgatcaccaagtttcataatattttccctttataaaaggatttgttggccaggtgcagtggttcatgcctgtaatcccagcagtttgggaggctgaggtgggtggatcacctgaggtcaggagttcgagaccaacctgaccaacatggtgagacccccgtctctactaaaaataaaaaaaaaattagctgggagtggnggtgggcacctgtaatcctagctacttgggaggctgaaccaggagaatctcttgaacctgggaggcanaggttgcaagtgagcccgagatcgtgccattgcactccaaccagggcaacaagagtgaaactccatcttaaaaaanaaaaangaaaactcgagcctctagaactatagtgagtcgtattacgtagatccagacatgataagatacattgatgaattttggacaaaccccann

SEQ ID NO: 772 - DNA, 777 bp, Homo sapiens
  misc_feature 5, 13, 14, 15, 16, 17, 22, 27, 38, 45, 51, 219, 457, 602,659, 700, 709, 715, 734, 743, 744, 776: n = A,T,C or G
gaaancccatttnnnnnttccncttcnaatcccttggntactcgntctttntgcaggatcccatcgattcgaattcggcacgagctctactaaaaatacaaaaattagctgggcgtggtggcacacacctgtaatcccagttacttgggaggctgaggcacaagaatcgcttgaacccgggaggcggaggttgcagttagccaagatcgccctgctgcnctccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttcttttttttttttggtgagtggtccagagctttaagctacttttccagtagtttgccactttctccgaggtantttggctgctctttcagtaatgctaattgtgtgtcaaattttgtctacaacagtaggcaacagatgaagataagttggttgaatgtctccagcactatgcatccctattttctatttattggggtacactcactttcagtaatgngtttcaaactggtattttttaaaaaacaaatcaatgtaaggactgaagttgaaatanccaatgtaataaagttaattagggttatttttaaaaaaaanaaaaataanaactcnagccctctagaaactatangtgagtcgnnttaccttgaatcccagaccttgataagatacnc

SEQ ID NO: 773 - DNA, 782 bp, Homo sapiens
  misc_feature 2, 3, 5, 6, 18, 22, 40, 201, 203, 396, 419, 516, 538, 540,543, 556, 561, 595, 620, 633, 641, 647, 652, 659, 669, 687,692, 694, 699, 703, 710, 713, 740, 743, 744, 770, 774, 781: n = A,T,C or G
gnntnnattcccctttcnaatncttggcaaacgctctctntgttggatcccatcgattcgaattcggcacgagacagtctcgggtttcatattttgctgtttttgatggacatggaggaattcgagcctcaaaatttgctgcacagaatttgcatcaaaacttaatcagaaaatttcctaaaggagatgtaatcagtgtancncccgccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtnaaaaacatgcagccttaagcctnagcaaagagcataatccaactcagtatgaagagcggatgaagatacagaaagctggaggaaacgttaagggatgggcgtgttttgggcgtgctagangtgtcacgctacattggggacngncantacaagcgctgcngtgtnacctttgtgccccgacatcagacgctgccagctnacccccaatgacaggttcattttgntggccttgttatnggctcttnaaaggnctttnccccatnaaggaagccngtggaactttcatcttgncctgnantcgangatnaaaaagnatncagaacccggggaaggggaaaatcctnaannctgacttcccggtttccaaaccagtnttgnaacaaanc

SEQ ID NO: 774 - DNA, 793 bp, Homo sapiens
  misc_feature 2, 4, 5, 6, 10, 13, 28, 42, 43, 54, 119, 120, 221, 626, 640,706, 744, 762, 787, 792: n = A,T,C or G
gnannngccncgnttttgattccccttnttcaaatcctttgnnaatcgccctcnctgttttgatcccatccgattcgaattcggcacgagatggcagttgcttttgaagtatatgatgnnttcctccactacaaaaaggggatctaccaccacactggtctaagagaccctttcaacccctttgagctgactaatcatgctgttctgcttgtgggctatcngcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaaagtaatagagtnttgcttaatcattnggaattcaaacatgctatattttttttaaaaatcaatgtgaaaacatagacttatttttaaattgntaccaattacaataaaaataatgggcaattaatttttnaaaactttttaaaatagnatgctcatatttttaaaaataaaanttttnc

SEQ ID NO: 775 - DNA, 1009 bp, Homo sapiens
  misc_feature 4, 11, 15, 25, 26, 29, 57, 63, 65, 67, 69, 71, 72, 79, 80,84, 92, 94, 96, 100, 102, 108, 113, 114, 119, 121, 123,124, 128, 140, 143, 147, 152, 154, 157, 163, 165, 168, 173,177, 178, 179, 181, 186, 191, 193, 202, 204, 207, 215, 217: n = A,T,C or G
  misc_feature 225, 227, 235, 241, 245, 252, 256, 260, 263, 271, 278, 279,285, 290, 293, 305, 310, 318, 322, 323, 330, 337, 342, 345,350, 351, 353, 356, 367, 374, 376, 391, 392, 395, 399, 405,422, 440, 441, 442, 445, 446, 452, 458, 460, 467, 479: n = A,T,C or G
  misc_feature 482, 486, 487, 489, 492, 493, 494, 495, 505, 513, 519, 520,527, 541, 543, 546, 547, 548, 553, 555, 571, 572, 574, 576,581, 584, 597, 598, 614, 617, 621, 624, 630, 632, 633, 634,635, 644, 647, 649, 650, 652, 662, 663, 664, 672, 673: n = A,T,C or G
  misc_feature 678, 682, 686, 690, 702, 704, 706, 708, 716, 722, 724, 733,739, 742, 745, 748, 755, 761, 765, 768, 775, 781, 785, 790,793, 795, 796, 807, 813, 815, 820, 822, 823, 830, 831, 834,842, 843, 844, 845, 850, 853, 854, 856, 859, 870, 872: n = A,T,C or G
  misc_feature 874, 876, 880, 885, 886, 887, 888, 889, 892, 902, 905, 906,910, 917, 918, 919, 921, 934, 939, 950, 956, 957, 963, 969,974, 978, 981, 984, 1001, 1009: n = A,T,C or G
agcnttttttngaanttcccctttnnttnaaaaatccccttttttggcaaaaaattncccccntntntnanngtttttnngatncccacatncngnaatntncgggcncgggnnactgncnannggcncccttcgggggnccngtgntaagncnatncttgtntntanaaagntggnnntnttttncgatngngactattgncnacnctcttccntnttggcagngngtctgganggttgnggtngctcatntggntaanccnatcctggngaccaannggccgnggtgngcntgcaagctttgnccacntgggaaanccgnnagtggtngtctcanttgcntgntgggnncntgnccccatcttgnctgctgnanccttggggagcaggnnctnggtngtggtnctgcctgcttgctgctngttccccgggcatgcgtnnncannaagggncatgcntngggcaanaaggtgcgtggncancgtnngnatnnnnaggaccaccntgggtcgngaatcnntgggttncctgataggaaccntnaannnctgcngnttttattaaatgggannanangggtncanttcaaagccagtnnaatgcccttatggaanggngtgnatnacatancnnnntatgtgtcntanannangaaatcgttnnncaaatttnnacaanaatntttntaanaaagggtatttnantntnggtgaaanaacaangntttaaagtnaaatgnttntancanaattaantaaacnggtnttnatgattncttacnaaantaacnatncnnaagcatttacngcttanangtccncnngatactnncanaatatggnnnnaattntannanatngcgataatctngnananactntcatnnnnnatngtgtaatcantanntacntgatttnnntnaaatgaaaacatntgatncaagattaatncattanntatacnaaaatnttcanatantanatntacatataatggtttcnaataaacn

SEQ ID NO: 776 - DNA, 785 bp, Homo sapiens
  misc_feature 2, 3, 4, 5, 6, 7, 8, 24, 31, 32, 40, 42, 45, 47, 56, 115,164, 169, 207, 208, 214, 215, 244, 282, 453, 475, 498, 511,516, 526, 530, 535, 568, 600, 606, 620, 647, 674, 675, 678,686, 702, 703, 745, 759, 764, 772: n = A,T,C or G
gnnnnnnnttcccctttctaatcncttgganntcgctctntntgnangatcccatngattcgaattcggcacgagagaaacacaggtgtcgtgaaaactacccctaaaagccaanatgggaaaggaaaagactcatatcaacattgtcgtcattggacacgtanattcnggcaagtccaccactactggccatctgatctataaatnnggtggnntcgacaaaagaaccattgaaaaatttganaaggaggctgctgagatgggaaagggctccttcaagtntgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgncctgattgttgctgctggtgtnggtgaatttgaagctggtatctncaagaatgggcanacccnaaagcatgcncttntggcntacacactgggtgtgaaacaactaattgtcggngttaacaaaatggattcacttgaccaccctanaggccngaagagatattgangaaattgttaaaggaagtcagcacttncattaagaaaattggcctacaaatccnnganacaataancatttgtgccaatttnngggttgggaatgggtgaccaacattgcttggagcccaagtgnttaacaatgccttnggttnaaagggantggaaaagttacc

SEQ ID NO: 777 - DNA, 1366 bp, Homo sapiens
  misc_feature 2, 4, 7, 9, 10, 12, 13, 14, 15, 16, 17, 18, 23, 24, 27, 29,31, 32, 33, 34, 35, 37, 38, 39, 40, 41, 44, 46, 48, 52,54, 56, 58, 59, 60, 62, 63, 65, 68, 69, 70, 74, 75, 77,81, 83, 84, 108, 109, 113, 114, 115, 116, 117, 144, 145,146: n = A,T,C or G
  misc_feature 148, 150, 157, 166, 169, 172, 175, 188, 189, 190, 192, 195,201, 202, 203, 204, 206, 207, 208, 209, 211, 216, 225, 228,236, 240, 257, 270, 272, 292, 298, 300, 303, 305, 308, 330,340, 348, 350, 354, 355, 371, 373, 379, 382, 384, 385: n = A,T,C or G
  misc_feature 388, 417, 429, 433, 450, 451, 454, 460, 461, 462, 468, 478,483, 485, 488, 490, 492, 493, 501, 504, 512, 520, 528, 531,533, 537, 540, 541, 543, 545, 547, 565, 575, 576, 586, 592,603, 612, 614, 620, 628, 631, 633, 637, 639, 640, 654: n = A,T,C or G
  misc_feature 664, 674, 676, 681, 686, 690, 697, 706, 708, 717, 720, 726,733, 742, 744, 747, 758, 760, 762, 767, 771, 777, 781, 794,796, 801, 802, 805, 807, 815, 828, 846, 855, 858, 866, 874,876, 880, 884, 892, 898, 899, 904, 910, 914, 917, 920: n = A,T,C or G
  misc_feature 932, 938, 953, 959, 961, 968, 970, 971, 976, 978, 980, 986,990, 999, 1000, 1003, 1006, 1007, 1022, 1023, 1024, 1031,1032, 1033, 1038, 1042, 1048, 1049, 1051, 1052, 1067, 1068,1076, 1083, 1088, 1090, 1094, 1098, 1122, 1124, 1133: n = A,T,C or G
  misc_feature 1136, 1140, 1146, 1147, 1171, 1183, 1185, 1190, 1192, 1195,1197, 1199, 1210, 1214, 1230, 1240, 1242, 1243, 1247, 1249,1265, 1271, 1272, 1273, 1274, 1277, 1279, 1290, 1291, 1292,1296, 1300, 1305, 1318, 1325, 1339, 1341, 1342, 1351: n = A,T,C or G
ananaanannannnnnnnaaggnnaananannnnnannnnnaanangnaaanananannntnnanaannnaagnngnttcnanncttttcaaagcttggaaaacgcanncaannnnngggaaagcaagaaagaacagctaaagnnngncncagaganagcttttangangtntangaagaaggaatannngnggncaatannnnannnncngaaantatcatganacncaaatgangganaaggcagcacaagctgngcaaacagctatngngacgggggggccgggagagnctaaangncananatncaatatataaggactgcatgcnaagggatacnaaacaagnanactnntctaggaagaaataantnttgacntancnnacnttcataacgaatagcaccgtacatcgagncaaccaactaanaggnctaaggaaatggcaaannacnttaatnnntgagcnaaggaagggngtatngnccnananngaaatgcntcntaaccaanttttaatngtaacggnatnangatnaanncntnancccacgcaactcaaaaanattacattanntaaaaaaganctatancaaaactagtnttcaaaatngnacgagnaaatgggnaanantttntnnccgggaaaattggnagagatccanaaacactggntnagggnaatanatgnccgcccnaaaaaaccntnaccataggnatnggctancatagangagatatancnatnaggggatcaanancntaggnattngaaaantaancgagttaaaacancnagatnnggnantacgaganatagcttggacgngtatcaaatcggaccctnggatgggcntanggaaaaanaaaaaggntngagngaanttcctcanaggaanngtganagagcnaaanaanatnaagggccttggngaaaanggaaaaacagatagngtcatncnatatatncnnatgananantggggnaatntaatctacnntanatnngggggaaaaaaatcnnncatgacnnnaaaangagntaatgnnannatgagagattaaacnnataaaacnagagaantttgngnaaanctgngagataaaaaataaataaattctntntggaacatntanaccntctatnnaaaaaaaagaggggaaaccatctngattatgcacananaaatntnacntngnggaaataaatngggnacaataacatatatgnggatgtacantnntggncngaaaaactatacaacntgagannnnacnangatataaagcnnnaggnagtntatangggcatcatcaangggaagntataaagcaactgnannctcatatanaaaactgnncnncaa

SEQ ID NO: 778 - DNA, 775 bp, Homo sapiens
  misc_feature 2, 6, 7, 10, 23, 24, 37, 41, 46, 48, 451, 549, 663, 678,688, 691, 719, 724, 734, 757, 765: n = A,T,C or G
gntttnnatncctctttctaatnncttggctactcgntctntctgnangatcccatcgattcgaattcggcacgagagattatgagcatgtagaagatgaaacttttcctcctttcccacctccagcctctccagagagacaagatggtgaaggaactgagcctgatgaagagtcaggaaatggagcacctgttcctgtacctcccgccgccgaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcanacctgtttaaaacgaattcgacttgatctccctattttacatgaagatttttgttagcaataatgatgaagttgcggagaataatgaacatgatgtcncttctactgaattagatccctttctgacaaacttatctgaaagtgagatgtttgcttcttgagttaagtagaagcctaacagaaggagccaaccacaaagaattgagagaaatnaacaactgggccttnggaaagaaangcnggccaagctgcttgagtaatagtcagancctanggaaatgatntggttaatgaattcaccccaggncacacccngttgaagagc

SEQ ID NO: 779 - DNA, 781 bp, Homo sapiens
  misc_feature 7, 9, 10, 11, 16, 22, 25, 43, 53, 58, 59, 218, 219, 221,716, 737, 745: n = A,T,C or G
gcttttnannnccctnctttcnaancctcttcaaatccttggntatcgttctntctgnnggatcccatcgattcgaattcggcacgagagacaaagaaaaaggtggcaatcatagaagagttagtagtaggttatgaaacctctctaaaaagctgccggttatttaaccccaatgatgatggaaaggaggaaccaccaaccacattactttgggtccnntnctacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttataggaaatcactgatgaccagtttgactttcatacatactggatgaaggaagattacccttagatcatatgtggacttattnaaactatgaagatgtactttnacagcatncattttacttcaaggcagcaagaattgcttttagac

SEQ ID NO: 780 - DNA, 783 bp, Homo sapiens
  misc_feature 2, 3, 7, 8, 10, 11, 12, 15, 17, 26, 29, 33, 37, 43, 44, 46,53, 60, 141, 217, 680, 736: n = A,T,C or G
gnntttnnannnccngntttctaatnctnttcnaatnctttgnnancgttctntatgcangacccatcgattcgggaatctcctagaaaagttgtgattttcgagccatatccttctgtggtagatcctaatgatcctcanatgttggccttcaaccccaggaaaaagaactatgatcgagtaatgaaagcactggatagcataacttctatcagcnaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggtactcagggatgaacaagaaacagaaggtgtcagccaaggacgagccagcttcaagcagtaaaagcagcaaatacatcacagtcacnggaaaaaaggacagcaatcccaattcctgccaaagccgtaacttaaaatgcatagnccttatgtgaaagggatcaccttcatctggacctgcacaaacatggc

SEQ ID NO: 781 - DNA, 796 bp, Homo sapiens
  misc_feature 2, 3, 4, 6, 17, 20, 25, 29, 45, 124, 135, 201, 202, 203,515, 562, 572, 592, 623, 637, 662, 663, 673, 713, 716, 721,728, 740, 742, 769, 793, 795, 796: n = A,T,C or G
gnnntncgccttcaatnctnttcantctnttcaatctttgaatcntctttgttgtccatcgttcaattcggacgagacccttatggcagatccccacagtctggggcagaagaggcgtcgaggngccagaagtgncggcagcagcagccgcagcagcccaaagagaggcaagagaaagagaaagcggccggtggaggggtnnncggaagagctggtccccgtggttgagctgggtccccgtggttgaattggaagaggccatagccccaggctcagaggcccagggcgcttgggtctggtggggacgcgggggttgcccccaatggtgcagctgcagcagtcaccactagggggtgatggagaggaagggggccaccccagggccattaacaaccagtactccttcgtgtgagccaaccccacccgctccaccctttttaaaccccccagcccttgctcgtgagattgggcttgggtagggacagaagaggcccgaaatccctcccccatgcttnctgacccttgtttggccaaagggcatctttgatggtacaaagcagangcttcggganaagcttccgtcacaacactncaaggtcccttcccaagggcaaggggatttnggcttcatgagctnctttgaggggcttttttttggtcannccccaccttnggggccatttttcccaattaacttacccccaaccccaagncanggttnagggggnaaagggctttcnanttccattaaagggggtttgtttgttgntgttttaaaccaaaatggggaaancnn

SEQ ID NO: 782 - DNA, 886 bp, Homo sapiens
  misc_feature 4, 5, 6, 7, 8, 9, 10, 12, 18, 24, 28, 43, 58, 60, 62, 71,81, 84, 87, 88, 89, 95, 97, 102, 103, 107, 108, 113, 114,116, 118, 120, 127, 131, 135, 136, 137, 138, 140, 141, 144,146, 147, 148, 154, 155, 158, 160, 165, 166, 167, 168: n = A,T,C or G
  misc_feature 169, 172, 175, 177, 178, 179, 181, 183, 185, 186, 195, 196,201, 203, 206, 208, 209, 210, 213, 216, 217, 222, 223, 224,225, 233, 236, 237, 239, 245, 248, 249, 250, 252, 255, 265,267, 271, 272, 302, 305, 309, 311, 320, 324, 329, 330: n = A,T,C or G
  misc_feature 333, 334, 339, 348, 371, 374, 379, 383, 388, 400, 408, 413,418, 422, 425, 426, 427, 428, 430, 432, 438, 439, 440, 441,443, 449, 459, 460, 461, 462, 463, 465, 481, 482, 484, 486,487, 489, 490, 498, 499, 510, 511, 529, 530, 533, 534: n = A,T,C or G
  misc_feature 536, 537, 538, 547, 549, 560, 568, 569, 572, 573, 576, 581,587, 588, 594, 595, 610, 615, 618, 619, 620, 621, 622, 625,626, 629, 633, 634, 643, 645, 651, 659, 660, 663, 664, 679,683, 684, 692, 699, 701, 703, 704, 707, 708, 709, 714: n = A,T,C or G
  misc_feature 719, 721, 724, 727, 729, 730, 732, 733, 737, 741, 743, 745,747, 748, 750, 755, 756, 764, 767, 768, 772, 776, 779, 781,790, 791, 794, 796, 798, 801, 805, 806, 817, 820, 824, 825,828, 830, 832, 835, 837, 838, 840, 842, 844, 845, 851: n = A,T,C or G
  misc_feature 853, 854, 859, 862, 866, 868, 869, 871, 873, 874, 875, 876,877, 880, 886: n = A,T,C or G
cggnnnnnnngnagcccntttggnaaangcctctaagggaaangcctttttgaaaacnanangaaaacctntgggaaaagnccncannnattttngngaaannggcnngagcnnanantnggacacngttntaannnnannagngnnngttttnngananagggnnnnnagnggnannnangngnnggagggaannaaggnanagnannnggnagnnaaggnnnnaaagaagnagnnanggaganggnnngnggnggggcatgangngggnncagaggcacgaggagcccaagaccatcacngangagnangagcagggnaccnacatnnacnnggacnacgagaagnggggccagcggaagaaggaaggnagnacctngagnaccgntaccaggaggancgggaccnacagngacanaggnccnnnncnanacggannnnanaaacgngaagcaggannnnnanggaccaagggaagggnncngnncnnggaaaganngggagggaggnncgaaggcaaagggggganncgnnannnccaggaagnanggaaggggggncgggaggnnaannganaagangaaccnngggggnncaggggggcgagggnagcanaannnnnccnnagncaanngaaggggananaagagngggaaaannaannagaaagagggaaaanaagnnaaggaaanaaaagangngnnaannnggganaaaananggngananngnngganaaangngnannanaaaanngaggaggncanngggnaaanaananggggagggnnganananagngaannagacaaggaanagngaannagngnanagnanngngnannaaaggnannggggnaanaagnannanannnnnagngaagan

SEQ ID NO: 783 - DNA, 805 bp, Homo sapiens
  misc_feature 2, 6, 17, 21, 26, 30, 37, 49, 62, 63, 66, 67, 69, 211, 213,434, 544, 555, 563, 564, 599, 600, 607, 615, 617, 618, 626,627, 636, 639, 640, 643, 646, 652, 653, 654, 659, 669, 671,672, 673, 701, 706, 709, 712, 719, 775, 777, 785, 793: n = A,T,C or G
  misc_feature 802, 804: n = A,T,C or G
cnaatncttgctcttgncctntttcnaatncttggcnactcgctttctntgcggatccctcnnganncnatcgttcgaattcggcacgagcacaaggagaagaaagttaattaacattgaaagatgagaagacatcttggaagacttgaattgggccttggaagaagaacagccattcaaatagatagaattgtggtagcaaaggcatacngntcggaaagtatagatctccagggacagtagtcatggggttggggcactgttggaatttaaggttggaaggatatattggagccccttgaatacggtaacaaggcacaccttgggcagtggagagttatcagagtgtttgaaaaggagggttattgagtaaataaatagactggtactttaggaattttaaaatgtggatcattgtactactaataactatntattttatatttactatctactaagtaatttacatgtattttcttgtactgactgtaaaccttctgggtgtgggtgttttaagtgccattttactgataaagaaactgangcttaaatagntgaaatanntcaccctgttagtgagtggcacaatgacaagtcannatcttanggttgccnanntccaaaanncatttaaanttnnagnatnattgannnttttnccttatggcntnnnaaatttggggagccattattgaaatccnttacnacntangaattgnccaaaaaaaatactttttggggaaaactggatttattaattatccaaaataatttnantggcttgnttggcttntttccactntnc

SEQ ID NO: 784 - DNA, 776 bp, Homo sapiens
  misc_feature 42, 45, 49, 52, 55, 104, 106, 146, 151, 167, 185, 202, 204,210, 232, 246, 275, 278, 285, 323, 329, 331, 356, 388, 390,398, 399, 400, 401, 415, 418, 496, 510, 526, 550, 552, 553,561, 563, 579, 584, 585, 591, 600, 620, 645, 663, 666: n = A,T,C or G
  misc_feature 672, 697, 706, 707, 712, 719, 724, 731, 746, 756, 763, 767,775: n = A,T,C or G
taatgctggttactgcccttcaaatccttgcaatcccttggnaancggnccngcngacccatcgattcgaattcggcacgaggttatattaaattattctttgntnttctttgtcttttaataaagcctgcaagttactaaattgnagttncataaattctgtagtnaagtatcatcttggcagngtgccaaaggtgaaaangntgcttnctctaacagagaaattcttagngactccagtcgtanaaaaacgtctttacaacctgaataagatngangaattgngaacataccatggcctattggatgaatcatttgccggnggctanancagactgtagggtttgtgatggatntatggagtatgtgggtatagaaatcatgaatntnccatttgnnnncagagattcaagcntanacttaatgggtagatcataaatgacagaatgaattcaaaacctagcacgtgcattgtaaatgtgtgcccagatatgtnttggaaatggcagntccttggggtcatgtntctactggcaaaatttgctatagngnnactattgnantgtaattataaaattnatcannattatncaccgattngccaagtaaactgtactgtncataggaattttgggaattgtgcanaaattggatcaattgaanttnagaacngatgtctgggcttaaaaatttatcngggaccacnnattangaaactnacatntttcggngctgaggttcattgnccaaggccangaaggtntttnccgaaaanc

SEQ ID NO: 785 - DNA, 778 bp, Homo sapiens
  misc_feature 3, 10, 15, 20, 24, 32, 51, 57, 59, 60, 69, 72, 223, 752,768, 778: n = A,T,C or G
ttngaaaacnccttngcttngttncccctacngaaacccttttgaaaaccntttgcnanntcctctttntgnaggatcccatcgattcgtgaaagaggagatcggtgacctgggctccttatgtgcctgaatgagtttgagtttcctgttaactccaaatcaacagtattttcaacaagaaatgtgcaattgaaatcaagtgctgtttaagtgcagctaggantccacaggaagacacttgcagtgaacagagttatggagcagcaaaaacacagatctatttggaaaaagagaaaacatatgcgttgtattttgcttcaattataaaataccatcctctcaaaggtggttctaaattacaaaggactttgatttctaggtagattctgggtagagacttcctttcatattgaggcattaatgacaccttttaacctgggaagcaatatgactggagttgtactttgagaagattaatcaggtttggttgcagaatgaaagagaagatgaagtcaagagattggtttagaggctctagcagaagcttagtcatatttcaaaatgatcaaatatcaagaaaaattctgagctgcataacttgtataaagtaattttcagtgatttttttcatggttatgataaaagaactggattagcagaaacttttaccctgaatcaagatttaatttttctttgagctcatcttaaggatatcggaacatagggagcaaacgatggtgtggctgcctcantgcttgaattttaacngttttgaaan

SEQ ID NO: 786 - DNA, 805 bp, Homo sapiens
  misc_feature 1, 20, 27, 37, 39, 41, 42, 45, 46, 56, 61, 73, 80, 83, 723,747, 760, 761, 774, 782, 801: n = A,T,C or G
ngccccccctttcccccctnttgaaancccctttggnanannccnntttcaaatcncttgnaaatccttggcnactcgtnctntctgcaggatcccatcgattcgaattcggacgaggagaggatcacttgagcttaggagttcaaatccagcctgagccaacataacaagactttgtctctaaacaaaacagttattgtttaaagaatctgaaatcttcatctttaattcaggtagccgtgaatcgagcccaagtttgtttgatatccagttccaagtctggagagaggcatctttatcttattaaagtatcgagagacaaaatatcagacagcaatgaccaagagtcagcaaattgtgatgcaaaagggctatcaaagggaggctttttacagagaactaaggaagagaaggaggttgttaaagagacttgagatcagaaaaagatcaagaacaacttgaatctcaaagtatgaatttgaagtattttgctgagcaaacatttgaatgcctgtatgtaccgtaatcctctatcactggggtccccaaccccggtaccagcccgtggcctgctagggactgggccgcacagcaggaggtgagcagtgggtgggcaagcgaccattcccacctgagcttcccctcctgtcagatcagcagcagcgttagattctcataggagtgcaaaaccctattgtaaactgcccatgccaagggatctangttgcaacgcttccttatgagaanttgaatgcctganngaactgtcactgncttccatnaacccccagatgggtactngttc

SEQ ID NO: 787 - DNA, 775 bp, Homo sapiens
  misc_feature 7, 8, 11, 12, 21, 25, 47, 53, 54, 56, 58, 59, 60, 266, 578,612, 633, 682, 736, 742, 761, 765: n = A,T,C or G
ccttggnnagnngcccccttnaaancctttgaaaacccttggcaaangccctnncngnnngatcccatcgattcgaattcggacgaggagaggatcacttgagcttaggagttcaaatccagcctgagccaacataacaagactttgtctctaaacaaaacagttattgtttaaagaatctgaaatcttcatctttaattcaggtagcaccgactcgagcccaagtttgtttgatatccagttccaagtctggagagaggcatctntatcttattaaagtatcgagagacaaaatatcagacagcaatgaccaagagtcagcaaattgtgatgcaaaagggctatcaaagggaggctttttacagagaactaaggaagagaaggaggttgttaaagagacttgagatcagaaaaagatcaagaacaacttgaatctcaaagtatgaatttgaagtattttgctgagcaaacatttgaatgcctgtatgtaccgtaatcctctatcactggggtccccaaccccggtaccagcccgtggcctgctagggactgggcccgcacagcaggaggtgagcagngggtgggcaagccgaccattcccacctgagcttncccctcctgtcagatcagcancagcgttagattctcataggagtgcaaccctattgtaaactgccatgcnagggatctaggttgcacgctccttatgaggaattgaatgccctgatgaacttgncactgncttccatcacccccagaangganctggctaacc

SEQ ID NO: 788 - DNA, 774 bp, Homo sapiens
  misc_feature 14, 17, 22, 32, 56, 63, 88, 208, 210, 217, 588, 633, 706,723, 745, 772, 773: n = A,T,C or G
gaaacccttttgtnaanagccncttcaacccnttctaatgcttggcaatcgctctntctgcangacccatcgattcgaattcggcacnagattatttccaaagcagcctacagtagaaaatagtcattatggcagcagcttctgatgtttttgtttggtaggttttctgatttcaatatatagaatcatattcatagagtatcttctntnccgcctngcacaaagtacccatttaaaatttacatgcacagttcattgccacctttcttaggcctatgcatagttaataaggttataatctactcaacatggaaaatggagcctatttgcaaacacacaagtaattaaagtaccaattctctcttagtttctttttttatagttggtttattttgcaattataaatgttaaacatccctagagatgaaagttaaaatggttgatcacagatcagtagcaaaatacaaattgacaattcaaaattataaataaaactctgttgaggatgtttaactttgagtctccaaatttaagagctaagcttggaagaaacaaatttataggttatatttccctcttaaattaaanaaacaaacttcctctggcagtagtttggtgaattcctttcattgnaatgataccatgattacaggatcaaaaatgcttaacttacttgccattctgctcacatcatcacaggttgttntttttttaaagcactcnatgtaggcattttaaaccttcnggataaccagagtatcttttgagaaannc

SEQ ID NO: 789 - DNA, 773 bp, Homo sapiens
  misc_feature 1, 13, 16, 19, 33, 35, 38, 40, 43, 49, 89, 97, 99, 100, 103,109, 114, 125, 126, 140, 141, 143, 158, 179, 180, 182, 184,186, 196, 203, 207, 256, 265, 289, 294, 302, 306, 308, 311,316, 329, 336, 337, 344, 361, 363, 365, 366, 371: n = A,T,C or G
  misc_feature 383, 384, 387, 390, 391, 392, 393, 400, 405, 409, 431, 433,435, 453, 457, 462, 464, 467, 474, 492, 511, 530, 547, 551,574, 581, 592, 594, 597, 599, 620, 629, 633, 635, 637, 642,648, 657, 658, 661, 668, 672, 675, 680, 681, 682, 691: n = A,T,C or G
  misc_feature 695, 703, 706, 716, 721, 723, 726, 730, 741, 748, 758, 761,763, 767, 772: n = A,T,C or G
ngcccctttgaanccnacngaaatcctttggcnantcncnctntctgtnggatcccatcgattcgaattcggcacgagagcagatttgngataaacntnntgnaggttnaaccnaaggggaactnntggtgcaactatgnngnttggaagatgctgcntatgtttattgaggattgcannanananatcctgaatnctcgccntttncaaaggcttggataaagcactcaagccagctacatatgtatagaacggnttaaaatcnatgaggaagcctggactaaatatnccatnggactggngccnanaangctgncgatgaactttgnatctggnnagaagtntaaagaatggcaggatnantnnctaangatgaatttcannacnggnnnnccaccantcttnaatnctttaagatcattatacgaagncnangaaaaggtggcaatcatngaanaatgngnatnatgttangaaacctctctaaaaagntgacggcactttaaccccnatgatgatgggaaggaggnaccaccaaccacattantttngggtccagtactacttggcacanccttatnacgaaactggncngtncntctattgctttgggagtaccntaaaatacngccntngngagtncacctncaatgaatnnaanctctttntcanganagctnnngatccatangacntgctgganatntttaaggaancttcnanggnggantggattaggcncaggccnttggacacanccntncttnatttnc

SEQ ID NO: 790 - DNA, 953 bp, Homo sapiens
  misc_feature 3, 5, 6, 7, 8, 12, 13, 14, 15, 16, 17, 18, 19, 20, 21, 22,23, 24, 26, 27, 28, 29, 30, 31, 32, 33, 34, 35, 36, 37,38, 40, 41, 44, 46, 47, 50, 54, 59, 63, 64, 66, 68, 69,71, 73, 78, 88, 91, 93, 100, 101, 107, 108, 112, 114, 118,119: n = A,T,C or G
  misc_feature 120, 127, 139, 140, 146, 149, 154, 156, 177, 181, 184, 189,198, 202, 203, 208, 231, 233, 234, 241, 245, 261, 306, 315,324, 329, 332, 351, 373, 388, 394, 398, 411, 418, 442, 446,465, 482, 485, 487, 494, 496, 497, 514, 515, 526, 536: n = A,T,C or G
  misc_feature 537, 542, 543, 549, 550, 554, 558, 560, 566, 569, 574, 588,612, 622, 624, 625, 627, 638, 659, 665, 669, 673, 680, 681,689, 695, 697, 700, 705, 711, 712, 716, 717, 721, 723, 724,734, 738, 753, 757, 759, 763, 767, 771, 775, 778, 779: n = A,T,C or G
  misc_feature 783, 788, 791, 792, 793, 794, 797, 800, 805, 808, 811, 814,818, 823, 825, 828, 830, 833, 845, 846, 849, 852, 856, 857,858, 864, 865, 866, 868, 869, 872, 875, 879, 881, 883, 884,885, 901, 904, 905, 906, 911, 913, 916, 919, 927, 935: n = A,T,C or G
  misc_feature 941, 946, 948: n = A,T,C or G
aanannnngggnnnnnnnnnnnnnannnnnnnnnnnnnannggngnnttnaaanccttntaanngncnntncngcttnaaaccttggnaancnccgcccnnttgcannaaangngaannnatgcttngtgaagcctgannccaaanctnaaggnanggacctggatccccttatatngaanaancggtntggaggaangagnntgtcngggaggatggggcagaaaatgangnnggcagantggncccgggggctctgcanaccagccttggagcctgctcattctgggcccttgctgccaaggancccagcctnacctagcangaaanganatgaaagcccttctcccangaggtagggtctaggctgcccnaacttaaatgcattnagaaanctcntagatgtggaaanatttttncgaacctgaaaatgcagctggtanaatntcaatgggaagcataaatncatgtaaaatataattnagntngaatatnanngtaaaaatgcacttttnngcggtgtgacngatcctgggnncccannatctgnnattnaagngntttacnaanggaanggaaaggacctttncctaaactacctttttgaacagancattaagaangnncnttcttttaagnaaaaaaaaatcaaattttgangaaaantggnattngaatgtnnagaaaaanggatananaanaaaanccaatnntaannaccnannctctctgganttcnactatctccactacntacntntacntatngcgntaanatnnactnttacntcnnnntantcncacanacntcntcnaacntaatnangcncncanaatcctctatannatntantgtnnntcacannncnnacnggntaantntnnncaacgccatatcaccnctnnnatcgncnagntanataacacntatatcgncactcncacananactcc

SEQ ID NO: 791 - DNA, 798 bp, Homo sapiens
  misc_feature 4, 6, 10, 13, 15, 173, 178, 235, 397, 408, 409, 497, 509,525, 544, 546, 578, 592, 598, 602, 603, 615, 619, 621, 650,657, 665, 668, 678, 680, 692, 693, 694, 697, 702, 704, 706,710, 713, 723, 724, 730, 735, 736, 739, 740, 753, 765: n = A,T,C or G
  misc_feature 767, 772, 775, 789, 797: n = A,T,C or G
tggnancgcnctntntgtttgatcccatcgattcgaattcggcacgaggatcattgttaattagtgacatagtaacatctgtagcagctggttagtaaacctcatgtgggggtggggtgggggtgtattccttgggggatggtttgggccgaatggggagtggaatatttgcncttcncctgttttaaattctaggatagattttaacatcctttgcggtcccagtccaaggtangctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccangggtatttcannctttgaaaccaaatctgtgtatctaatactaacccaatctgtttggatgtggattttaaaaaaatgtttgctaaacctacccaaagtnagatttacctgnatttaaatggcctttngggtcttgaaaaagctttntnaacctcttggctttaaaatgcgttttattctngataagatacttcnaaatancctnncaaaaggtgttngatncnaattactttaaaataaaacctgtaattgnataatgncataatgntgntccatgcctnantccccttctagnnntanaaacntnantaanaantatatcaatnntcgatnaaatnntannactataaaaactncggccctcttananacttnatncttgaagttctcantataaccnc

SEQ ID NO: 792 - DNA, 788 bp, Homo sapiens
  misc_feature 3, 308, 384, 428, 563, 616, 617, 625, 660, 670, 689, 734,735, 740, 743, 744, 745, 748, 773, 781: n = A,T,C or G
ctnttgttctttttgcaggatccatcgattcgaattcggcacgaggcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcngccctgctgctgtcctccatcccacccctcttactccacctcgtgttgtaaataaagtttcggtggtcatgctganggccggctcccagctctgccggggacggacagggcagaaggcancgggcaacttcaggaacacggtgaaaaaaaaaaaaaaaaaactcgagcctctagaactatagtgagtcgtattacgtagatccagacatgataagatacattgatgagtttggacaaaccacaactagaatgcantgaaaaaaatgctttattttggggaaaatttgggatgctattgcttaatttgnnaaccattntaaacctgcaaattaaaccaagtttaacaaccaancaattggcanttcatttttaatggttttnaaggttcaaggggggaaggtttttgggaaggtttttttaaaattnncgggnccnnnggngcccaatgcatttggggccccgggnccccaaanttttttt

SEQ ID NO: 793 - DNA, 806 bp, Homo sapiens
  misc_feature 27, 28, 47, 107, 134, 217, 248, 345, 368, 373, 377, 422,444, 462, 495, 527, 536, 572, 678, 681, 699, 717, 736, 737,757, 765, 770, 771, 776, 800, 806: n = A,T,C or G
gaatccctttgcttctgtcctttaagnnatcgttggaacaaccatgnctttttgtaggtgaagtgttctctctgcatgcaacagtaaaaattaatataatatttttnccacaaaagaaacacttaacagaggcnagtgccaatttataaaatttatgatctaaagggggaaatcatggattataaagtccttcagccctttgggactctaaattggngggggattaaaaagaatttaaaataattttngaaccgaatttattttcccctcagtttttgagggcattaaaaaggcattaaatcaagacaaatcatgtgcttgagaaaaataaaattaatgaaaacncagcactttatgttggtttaacntgcancctnctttggaggtagaatttatttatttaaaattactgggtgcatcangaacccatagggtgtacaaaangttctattaaaatctgcnttatagagacaaagaggcaggcaaatccatgtnacaaagggtaaagcttacagtttacaaactgngaacgccanggtgtaggatataaaaacgcactcttgagaaaacanatggtcatcagggtgctgaaaacttgcatggtgcttttcaacattagcctttggtccacaaatttcttgtatttgacaggatccatagtgtgccatggggcaaganacnattttgccctctatggtnttctttaaaaattttcantttaaaaatacctcttttnncaggaatcctaattttggcnccgaagcntattnntggtnccacatttaccgttgcccttgccnttggan

SEQ ID NO: 794 - DNA, 815 bp, Homo sapiens
  misc_feature 9, 21, 34, 35, 122, 180, 263, 310, 315, 348, 357, 386, 415,443, 448, 496, 513, 516, 520, 529, 560, 575, 588, 595, 606,608, 620, 625, 631, 634, 640, 650, 657, 661, 665, 680, 684,686, 691, 693, 710, 725, 732, 733, 739, 743, 754, 757: n = A,T,C or G
  misc_feature 759, 761, 776, 777, 781, 790, 792, 796, 801, 804: n = A,T,C or G
tttcaaatnccttggctttanccctttgtttganntccttgttcgaattcggcacgaggccttctctggcctcaccaattaggtcaaatgttccttattttgtgttgtggggcatggctctncctgtgaggacctgtcccagcttggacctccgccttcctgcgactgtattggtgtctntccctctcaagcctatgagctcttgcaagggcagggaccctgtatgattttgcctatcgtatgtcctccagcccccagcacangcgcctggtgtccagtgagagctcagcaaatactttgtgagttaaangacangcgggcttggggtagatggatccgtctgcctanacagggcangttattcccgcttgtgagcaactcttaanagaaacttcattttttttcggcgcctgcncgaactttcaaagatgtttcccggccangaacngtggctcacacctgtaatcccagcactttgggaggcttgaagtgggtngatcaccttgaggtcangantttntagaccagnctggccaacaccggtgaaaccccgtcctctnctaaaaatacaaaanttaactgggtgtngttggtngggcgctttgnantctcactacttnggaangctgangcnatgaanaatttgcttnaaccccngganggcngaagtttcaattgangtcnanacttnancccatttgcgccttcanaccctggggcaacangtatcannaacttnaacnattaaaaaatnaanananctcttatccctttannaacnattattgangntacntattntcntagaaatccct

SEQ ID NO: 795 - DNA, 1050 bp, Homo sapiens
  misc_feature 22, 28, 45, 76, 80, 97, 167, 168, 204, 239, 283, 306, 312,349, 354, 359, 375, 377, 385, 397, 401, 424, 430, 443, 452,466, 468, 469, 470, 472, 473, 475, 478, 479, 480, 482, 485,496, 500, 504, 508, 510, 511, 513, 520, 523, 532, 537: n = A,T,C or G
  misc_feature 544, 547, 550, 551, 552, 553, 554, 557, 560, 564, 566, 567,568, 570, 579, 581, 583, 586, 588, 589, 591, 593, 596, 601,606, 608, 610, 616, 618, 623, 626, 629, 631, 641, 662, 664,665, 668, 671, 677, 678, 683, 684, 687, 689, 696, 699: n = A,T,C or G
  misc_feature 702, 705, 706, 707, 716, 717, 719, 727, 728, 730, 731, 733,735, 738, 739, 744, 747, 748, 749, 750, 751, 752, 761, 763,764, 765, 766, 767, 771, 772, 773, 775, 778, 780, 783, 784,791, 796, 803, 804, 806, 808, 809, 810, 818, 821, 822: n = A,T,C or G
  misc_feature 824, 826, 828, 831, 836, 841, 843, 845, 846, 847, 848, 855,856, 858, 861, 863, 869, 871, 881, 882, 890, 891, 894, 897,900, 901, 905, 906, 908, 909, 910, 912, 916, 918, 919, 920,921, 929, 933, 934, 935, 940, 941, 943, 944, 946, 950: n = A,T,C or G
  misc_feature 951, 956, 957, 958, 960, 961, 963, 964, 965, 968, 969, 974,975, 977, 982, 986, 987, 991, 998, 1000, 1001, 1005, 1006,1007, 1011, 1012, 1014, 1015, 1024, 1027, 1028, 1030, 1032,1033, 1037, 1038, 1044: n = A,T,C or G
tttctaatgcttggctttgagncctctntttaaaatcctttggcnactactctgcacgatgcggcgctgacccggncggncccacacccgctctttnctcttctttgccgcggactccctttcctgcctccaagacctgggtgtctacaactgtgagcccagcttgnnccaaaggcagtccccatgggacctagactcaccttncccttgcctctatgaaaccttctgcttgggcccancccctgttccagctcccgacctgcacttccttgctgggactcangcctccaagctccctgcccagcnagcggncttcagccaccgtcttcccctttctttcgggccctgnttgtnagcanctttgcagaaacccanangggacctngtgccccttgcnaagnctgtcgccttggtgcaagactgncctgtnctgcatcattttncatggttgncgggggtgtggggntnnncnngncgnnncntgntcacaatcaancatntatncctnanntngggtatnacnaatggcctnaagantgctacntcntannnnnganttntcangnnntnttactaacntncnatngnncntnganatagncatgnantnttagtntntgatntanccncnattgcagccncataattatcctacaccacanannaanccntccttnnagaanntgncntctatgnaanagnctnnnaatgtggcnncnaatataanntnntntnctnncatcntannnnnntcctacgtnannnnncatnnncnctntnggnnactatcncatantacatcnntnannncacccatnctnntntnanatntctcntgggnantnnnntctcctnnanatncnctaatnangatctctcanntacatganntanatnacnnatanngnnnanatcnannnngtctctcntatnnnttatnnanngntcannttacnnnannannnaanngtatnntngttcnaaanntatntataaancnncgtnnntttnnannagatgtacnccnntnanntaannatctangctccg

SEQ ID NO: 796 - DNA, 884 bp, Homo sapiens
  misc_feature 3, 4, 5, 9, 23, 27, 31, 32, 41, 92, 101, 172, 264, 287, 292,328, 425, 426, 484, 503, 508, 555, 601, 602, 614, 642, 656,683, 700, 701, 713, 716, 719, 726, 731, 736, 738, 751, 794,798, 799, 809, 861, 873, 882: n = A,T,C or G
ggnnntttngagctcggaaatcncttnggtnnagcctttcnttgaccccattgttcgaattcggcacgagacggcctggtggagcagctgtncgacctttncctggagttcctgcacagccaggcacactgcatcggcttcccggacctggggctgcctgtggtcctgcagntgaagtcgttcctccgggagtgcaaggtggccaactactgccggcaggtgcagcagctgcttgggaaggttcaggagaactcggcatacatntgcaagccgccgccagagggttnccttnggcgtttctgagcagcaggcagtggaagcctggganaagctgacccgggaagaggggacacccttgaccttgtcctacagccacttggcgcaagcttgcgttgaccggggaagatccaacttgggagatcaanngggcaaaagaaccggcttggaaagacctggaactttcccttgagatcaaaaccgaaanggaagaatgggcttgacanggaanggatgaaggacagggaagccaattttaaaagaccctctttgacctgnacaagctcttgaaaaaggacgacacccgaggggattcttcggagannagggatactgangccccctgagcacctcggcatgggggtngggaagaccattgnaaacaaggaccaaggaaggaagggccnaaggaagggacaagcanncaaactcggaanggntgnaatgggnccttngggantnggaggaaccccanaaccccaaaaaggccggggggcttgggcccccttggggggaancttnncaacaaaatntgggccccaagggggccccggaaaggaacgaaaccttggaagggaatcttgncaagcttcttanaaaagggancg

SEQ ID NO: 797 - DNA, 773 bp, Homo sapiens
  misc_feature 19, 30, 32, 101, 121, 140, 150, 260, 383, 491, 662, 683,719, 735, 754: n = A,T,C or G
taatgcttggctctgtctnttgttgacccntngttcgtttgtgcctgagcacccacaatttcaggatttagactgtgtgggcacctcagctttcctctggntgtaaccactccttggtganagagggaactcctaaccantcccatttgncaaaggctaggcaatcttcattctgcttggctttagtcattcttgtcattgggctgcagaagaaaaacaactttgctgggtgatcccactgccttgatttcacctcggancgaggctgggccatgtccaagtcttatgaggtcaccctgactagaaaaaattgaactcacctacaaatagtctgaaagagtggtgtatatcaaatacgtgggtagtgttgcatttcaaatgangctcttctgggttgaaatgatatatttataaaaccagaatatcaaaaatgggtgatgtataatgtctctttagtttttttggtatttggcctcttttaaagcctgtcngatgtatgggagaaaaacaatgaaccgtgctttgatttcctatcaagtcactcttaagaacatacatattggttaaagtaactcggtctttttttatctgattctttgaggcactatgggtagcaaaataaccacttacaaatttaaatgtaatatacacttcttttctgngtgtcaagtccttatttttangtgcctaattggacattttaaaaggttaaattattnggttggcatattaatntcaaaaaatctattaattnattttaatgcctggtaccg

SEQ ID NO: 798 - DNA, 812 bp, Homo sapiens
  misc_feature 7, 10, 465, 516, 536, 583, 611, 627, 644, 685, 694, 697,704, 714, 715, 720, 723, 756, 758, 769, 778, 786: n = A,T,C or G
gtcaatnctnttcatgaccctatcgattcgaattcggcacgaggctggagcacgctggagaggccatccctgccctggcagcccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacactttcccaagctgctggggctcctttttcccctctggcgcgggagcgacatgatcgtgtccgtgacaacatctgtggggcacttgcccgctgttgatggccantcccaccaggaaaccagaccccaagtgctggctgcctactgcatgccctgncactgaaaggaggaacttgnaagaatgggtcaccatttgggcgcctttttaactttctgtaccagancaaccccttgacaaggttataaaatgtnggctccccgaaccttnttgcgtattcttgcagncctcaattcttggcttgaccaaccaaaggattcccacccangaaaacccnaangggcccnaaacttgttnncttgnttnccttggaccgtttccttggggccaaaaacaggnanaacccggacanggttttttnaaaccagntttttggggctttaaattggccttgg

SEQ ID NO: 799 - DNA, 758 bp, Homo sapiens
  misc_feature 18, 593, 613, 643, 654, 662, 680, 684, 687, 696, 699, 711: n = A,T,C or G
ctaatagcttttcattcnaatgcttgtgatccctcgattcgaattccgttgctgtcggacagattgccctagtacccacccacctatcagggttatgcaatggaacatcctcgcccaagctcttggagaaggcaaagacaactttgtacagtgccctgttgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtagaacacaacaatggaccagatggttgtgccttattttttcttcaaaaccgattcaagctagtcaacagtgccaatattaggctgacagccatgacattgaaaaccaaccaggtggccattgcacagaccctggagtgcaaggagtcaggccgacagttctgcatcgctgttacccatctaaaagcacgcactggctgggaagcggtttcgatcagcttaaggcttgtggactcttcagaacctgcaaaacatnacccaaggagcccaagattncccttattgtgtgtggggacttcaatgcanaccaacagaanaaggtctncaaacactttgcttcttncagnctnaaccttganagncggcctacaagntgctgaatgcttgatgggcaatttagaacccccatacacctacctgg

SEQ ID NO: 800 - DNA, 770 bp, Homo sapiens
  misc_feature 3, 7, 9, 12, 353, 425, 531, 608, 637, 647, 652, 687, 698,703, 716, 723, 729, 734, 747, 758, 769: n = A,T,C or G
ttnaaancngcnttggactccttgcaggatcccatcgattcgtttaaactgagctccaaatgacgttcaaacacccctctcgggtagagttttcatggtggaacggttgcgcccaccaaacagaagcttatgtttttggcacagaagcctgggccattttcatggacacctggctggacctcggtggaagtgaactccgtaggttgttgcgttcactgcagcacctcacatgataccgtcccctctcatggaacggagcctcccccatgcagcccccactcaaatggagttttaaaggctgggttcaggttacgggggcgtttctcaccgtctgaatgcggaggacagagacnagctccagggagcgtgggcgggtgacggcgctgagatgcgtgatgtctcggaaacgtcctcgcatccctcancgcgggcgctgactgccgcggcccttgcctgtcttcaggagcgctccagcttcgcccacacaccccgggctgatgtcccctcgctccggcggcctgcagaccccanagtgcctgtctcgggagggctccccattcacacgaccctgagtttgggtccaagttagcttctgtcccaaagtaccngtattcccaaagcgcacccggtaaagganccgggccggnccttntttgcggggccgggggccggggccgggaactcgtngggggttgccnggaanggggttaaccgtnccggttnttccgnccttncgtgcaaggcttnccccgttaagnggcccaaaccnt

SEQ ID NO: 801 - DNA, 573 bp, Homo sapiens
ggagccctagagctccacaacaggactcagagcctctaaccagttccagcactccagactccagccacactccaacacagcaccatgatcccagccacccgctcgcttctctgtgcagcgctgctgctgctggccaccagccgcctggccacaggtaggtctcgccactgccactgggggaggagggacctctggtgagcgcagcctcccacagtcccgctgaccaagagtcttctcccatagggcgcctatcgccaatgagctgcgctgtcagtgcctgcagaccatggctgggattcacctcaagaacatccagagcttgaaggtgttgccctcagggccccactgcacccaaaccgaagtcatgtgagtatcttcccggttagcttctgccacttccagactcgcccaaaccctcccgcgcccccacacttctcctagtgggaatgcctaacatgtgggtctatccttctctctgcagagccacactcaagaatggtcgcgaggcttgccttgaccctgaagctcccttggttcagaaaattgtccaaaagatgctaaagtgagttgtga

SEQ ID NO: 802 - DNA, 1390 bp, Homo sapiens
ttttttttttcacaaggaatatcattttattactgtaatcacaaaatcgtaatttctgtacaggaatgtataagtgaacattattcaaagcattggtaattcacttcataaagagggtaaacatactacagaacatattgtaaagaaaaaatattgtaaaattttctggtcttgcagtgcactatttagtgcaagtatttaagacacaatagtgttcaattcagcaaagtattgcagaatgtcatgccacagtccacttaattcaaagagggtcaggacatgcagcttgtaataaaatgtcagagtgtgtgtgtgtgtgtgtgtgtgtatataaaaccacatgtaattcataaaatatatagtggtttatttagatggttttaaatgatttcactgtggaatccagcataactggaacaacatccaaggtcttcttaacggcaacaatcttattgctaggcaatggcyttggcttcaggtargaatgcytcccagtattttatcagctgttgttgtgtttgaactagtgattctaagtacttgatgataacggttttaaaatccttcactcgttctttctcaaatcttcccacttcttttcgaatcgttttagatatctgttcaaaatctctttccccttgttgcactttcgcctcccactctcttatttcatttttagcttgctgtattttatctggtttgttagcaaccatcatttttgcttcagcttcacgttttttgagcaaagtaatttgagcatcttcccatttctgccagcacttcattcgatggtcaaacacacctttcactgcagcaataagacgaatgtagtcactaagtagttctgaaaacatataaaagtcagmaaaagcttgttcttgatgtaactggtctatcttctcctcaacctctgcaagctgagacaaagctctagataaagcagtatgatcctcagaattacctaacatggcagcacttttagcaaaggcagctgtgttggctgaaagttcttttctatgacagamcaaggcttcaacactgacatgaagtttcctaagttgctgatccagattctcaaattgctgctgcttttcttcaaaccatgcatccgattcattcatcttgattgtcattttgttgacagcgtcggcagccttgttcaccatcctcaatattcctgctccactcagagcctgtgtattaactgctctaggcagctctgaactttccaagaactgccttaaatcaggatcctgtagtaaagttggatgttttactgttctttgaagatacctttcaagagctgctctccgtttttctacaaactcagtggatgatgagtcttctttacccactttgaccttggtcatccctactatactcttttctg

SEQ ID NO: 803 - DNA, 947 bp, Homo sapiens
  misc_feature 121: n = A,T,C or G
ggaacttctgagtaattggtatcatttcctagtgactcggctcttgtactccaatcccacagtaaaacccattgatctgcactactatgcccagtccagcctggacmtkykkcwsgsaggngagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgc

SEQ ID NO: 804 - DNA, 532 bp, Homo sapiens
  misc_feature 49, 86, 140, 195, 212, 214, 235, 243: n = A,T,C or G
cctctgccctcccaggttcaagccattttcctgcctcagcctcccgagntagactgggactgcaggtgcgcatcaccacgcctggntaatttttgtattttgagtagagatggggtttcaccatgttggccaggctggtntcgaactcctggccctcaagtgatccacccacctcagcctcccaaagtacagggnttataggcgtgcgccantntgcccggccgagaacaatttntcacaagnttacttttctagttttgccaatgcatggtgaaagtgaacccaagcctgggaactgcaggcctagacaatgcaggrmmykksttsammcwsrsmsrmrsmsstysmarywmrsssagmcttggaaaggagaagtgtgaggcaggtgtgggtaggacctctttttagtacctagaaaaaggctaagaaagtggcctggagatgtttagaaggttaaaaccaacgaagaaaaaaatcaatgacaacctatcaggaacgtgattgactctcagaatggagaactggcgaatcg

SEQ ID NO: 805 - DNA, 552 bp, Homo sapiens
  misc_feature 9: n = A,T,C or G
aatgcattnttgattttttattgcagatgatgaaaaagttttagatatagacagtgccgatggttacacaatgttgtaaatgtatttaatcccacttacgaatgattaaaatgataaatcttatgtttatttcatcactaccaaaaggctgtgggtgcaggggtgctggtttctggtcctagcctaagagactggcagtttccaccttctatctcttgggacagtagctctgggagccctgagctgtcatgcaggaagtccagctaccctgagaccaccatgctggaaaggccacagggaggagctctgtggacagtcccagctgaaccttgccttccagctgtccctgtcaagatgccaggsatgtgagtaaagccatcatggaccctytagaccagactgcccaccagcagggtaccwtctggcagccacatggagcagaagaaccgcccagctgagccacttccaaactcttgacccactaagtcatgatccacaatgaacccatcatagggatggttggctttgcagtgtggataatgaggatgtcat

SEQ ID NO: 806 - DNA, 1646 bp, Homo sapiens
  misc_feature 1423, 1446, 1477, 1486, 1492: n = A,T,C or G
aactagtatatttacaacatcagaaacttcaatatggagatttgttgttcctatatcatgatctttagcagcaactacaccataggcactgcacaacctgggtcctagatcaggacgtacaaaaaatcctggcaaatgagaggccaaattgaattttccttctggattacaatattctggcaatggcagactttttaaaagatcttcgtatcttgctggcatcatagtcttgaagtcttctcctgaaggccaatctttcaattttaaaacaactgtttctccactcttgtttttctgccgttttgaaacttcttcaaaaccatcccagaattccttaacattggcatttgaaatgatgctatctttgcagttcaggagatcagcttggtggtctccaaaatcaagactaattgattccgccttccataggctaatgttcattttcttatgcacaccagaaaccactgcaggctgtccttgtttccaacattctttgaaaagcttccaattactgctattcttataatccttaagccataaaatatgcttctcacagatccaagaatgtggtatatcactgtataatttattattttcatccactgcagatattatgctttcttcaggctcttctttaagctctggttttacatttatcttggaggttttacttggtggaattttgttttcaacaactgaagcaattatgtcatcaagaatgttaggcatagtccgtccacttttgctacttggggctcccattgaatatactggggcaaaggcaatgccagcatctgtasaccccacacgtagctttccagctgttgtagtcagcaaatcccgtaaggttgagccttgttcattattctgggacacaagaggtgatgttctgccatttggagattcagagttgtcttgttctctttcttctttaatttggttttcaagggtaagttctttgttttcttttttttcctctctggctttttgctctgcaagatctgctaaccagtgcagtggtgactgggattctggaggagttaacttgttatctgtgcctacatcactctctgggctgctgccaccatttttctcagacttcggaggagtattttgctgctgagactcaggcatgcacagagaaattttattactgtgattaagaacattctgtaaaacttgagatacaccattcattgtaggaaaatttccaacttgtaaattctgtttgttagtacaatgacaatgggatttaataccatatttttccctaagagtgtgcatggcatctagaagatctgtcaaaacagaaccaggtataatttgggttggcattaaatgtttgtgatcatgaggctgtccyttcacacacttcatccaagcatattagttctttatccctagramyyctycctttcctttngccttgtaacaatctaagcaganccacaawkccacattttkggcagacccagtnrawkktaancawkgntgcttcacatgcatcacacatctcccggactcctctcactgctcttttccaggcaattttggcatcctttttcacccaggacaaagctgttttttcagatgttactaattgacagaacttatcacctattatatccaagatatatttagaagtc

SEQ ID NO: 807 - DNA, 1029 bp, Homo sapiens
  misc_feature 314, 717, 737, 814: n = A,T,C or G
tggggctgtgactgtatttacttcattcttgaatcccgcgtccccgtggctgggggctgacacatccctgggcaccactgtgacttcctgtgggtcccttcccttctgtccctgactctgtagaccccccacaggaagggtcctaggtagggggaggttcctcctcccttgaaaccctgggccactctgtcaaggcaaagctctgggcccagcaccttgtaaaggctttgatgagaggagctctggcttttgctcagggcctttggaccccaccctccagcccccaggaatgcaggcgctcaaagcctgtggtnaggctgcccgaagcacgtgccgcagttcttctggagtgggagcagggggacagagctttgggtagaggagggtcacctgcaaagctggaatgccaggggagtgggcggtgcctccagctcctgggggccagggtgtctccatacctcatgggcctgagcctgggcaggggtctggagtgcacatagcccccaggcagggagagggcagtgacaggacagagccactcatctgtcccaaagctgcaccaaggggtgtcagcaaccccaacctactgacctactttgggaccacaggcccatctagtgcaaatgaggcccagaaaggagaaatgctttgctcaacagccacagtaggctgacgtaacctatgtaatgtagggtcagggtgggcctgagggatganccaggtggtgggcaggtganacaccaggtcccctcctggcctctgccccacccagccctctcctgcacggctaccagaagatgtccgggaagaacanactagccctgagtagggagtgtggtcaggtgcagaggagggcaggggcccggatcctggcccagaaacactctaaaacagaatccgatcctgagatgatccaaatcaaacagaatacttgacggaaatagtagagtctgaaaatgatgcactctgcgcacacatatacaagacacacacacacacacgaatccacgcacacgaggcacaccccac

SEQ ID NO: 808 - DNA, 836 bp, Homo sapiens
  misc_feature 646: n = A,T,C or G
aaaaccgggtataacactttaatatagatttgtggaactctggcccttgcagccagaatacacatttataagccataaataaagcacgcagaaaccataaattaatcggacccgagacctggatttcaccgtgtcaagattgggaatgctttttttttctttttcttggtcatttacaacagacccttacattattttttttcctgtttttaaacaatagtacaaccctctggttctgttaaaactacatggttttacaccgagtcactcacaaaatttttttttttttttaagtaagacttccctgcaacaacagcaatggaggagaacaacaacaacaaaaaaatcagaatctgcaggtgcttgaagaagcaggagtctacacagtagtggaaaccggaggcttttttttaactttatattctttcccgttttcctccttatatagaacgtggggtatctgtgtggccctctgtttgggacggaacrgctgcagcgggtgaaggaagactgctgtcttgggggtgttggggtgggggtgttatggatttcttctcccttgcgtctctgcaacaccgtctccccaaagtctcgacccccacttgctctctcacttrtcctcgatccggggtgccagagttagccnggcctgaagccgtcgtcttcttaagaggagttcataatgggccgggagtacaccccctggtagtaggaggtatctgcggccaggggcgaggcgtccaggcccgttttgttcgtgaccgggcccatggccaagctgccaggcatgggggaaccgtagccggggtagtgcatcacctgttcgtaggccttga

SEQ ID NO: 809 - DNA, 1844 bp, Homo sapiens
atcaggtgttcctcccatggcaggagggaagaaacccagcaaacggccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgccaggagggcttggtgcaagagcttcagaaaaaacaggtggaattgcaggaagaacggaggggactgatgtcccaactagaggagaaggagaggaggctgcaacatcagaagcagccctgtcaagcagccaagcagaagtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgcttcgggaaacacaggccattaacagcagcctgtccacgctggggctggttatcatggccctgagcaacaaggagtcccacgtgccttaccggaacagcaaactgacctacctgctgcagaactctctgggtggtagtgytaagatgctcatgtttgtgaacatttytccaytggaagagaacgtytccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtcctatgtctatgtatcgggtgaggggtgggagggttgctggagggtgctttattgggtggagggcaccatgtcccagggctatcaaataaagaatagtttggttttttttttaaataaaggttttat

SEQ ID NO: 810 - DNA, 489 bp, Homo sapiens
  misc_feature 186, 214, 391: n = A,T,C or G
gccccgctccatgagcagtgactccccagctcctcctggcaccagtccccagggctctcctgttggtakwwmmwgctwywywtsyysswmmywmmycgkgracctcragatctyyaccctaaaatarttctgttgaatttcaccctggcratgtaaaytgakagcttatcttcacagatgysrganaakrgmcmayycmycwkcaswcctswgncwmaystswrwcwratksmtkycykwkccctatttatgtaaaaatacagggtccctgagccagcctaaggcataagtgacttatccctcctccctgctcacatataaattgtgtatttagtgaaaggctgatcaaagrttcaaagratgttatttgttatctacctgtggacccagnaggtccccaattccagttatttccacctttccaggaccgggaccaatgtatatatgtaactggattggctgttctcgtgtgtttgttaaaatgtgtgg

SEQ ID NO: 811 - DNA, 471 bp, Homo sapiens
  misc_feature 212: n = A,T,C or G
gccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggnctgggsyygagtggtatccctacctggcctccccctggcctctggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggccctcggtggccggctctggttggagatggtacagttttattgtacaggtgc

SEQ ID NO: 812 - DNA, 579 bp, Homo sapiens
  misc_feature 61, 369, 428, 457, 469, 481, 525, 529: n = A,T,C or G
cccaatgaatcaacatactttattagacccactaagtgccaggggaggggcctgtgcctangagccaggttacagggctcacccgtagattcagtctggtctctccccatcatgcctctcacttccagtctgggcttctaataggagggccccgacttcttccctcccagtcattctctcgaatggagaatctttcctcattccagggacaccaaggctcaggaaggggcctatccatcatcagtagagccagacaagctctcccatcggacgtcctgtggctgggcccagaaatgggtgccgctgcctgtgggactgcccttccgggaaggaccagggtgtcttcagtgctcttggcctgcacgtggnaggagagtaggcagatgtctggtgctctttaagctcaaaggcatcatggccctctckgnwgsarcrrrsrsakamragkymsssatcncagscagcscwnkarskstsgcanwsmwcattscasmtgcascmmcmggrrrsmkcsksywcmkmagnsktnmscmtsgsrgycagcgcagcgtagggtggcatcctcattgcagatgcagc

SEQ ID NO: 813 - DNA, 562 bp, Homo sapiens
  misc_feature 362, 393, 397, 400, 419: n = A,T,C or G
tttttttttttccagatgtaactcttgtcttttattccagcatctcccagagctccaatatgtacagactttatttatacacatataatatacaccatatatacttatttatagatattcacacaccagcccacacactcgcacacactcacacgcacacacccttccaggaggggcgtgtggctgccttggagtcccgctagscccaaacaagtgatactgggcttgccaggcagttgtgaggttttgtgttttttgcttttaaaaagaaggccatttcctccagatgtgtcctccctctccccaagccctaaaactcctccccaaaacactctgaaaaaaatttttttaaaacaagrggnttttcctttgctytggsccaagtagtttctngganagntccrggsccatccacaagnyccgtgcaggtcctagagcacgagagccgggcgtggccttggtcaggcctgcagctgtgccctctgaggggagaggggaggcgctatagcatcaagggcacctgccagatgaggagggtgctgtccgtctccccacacggggc

SEQ ID NO: 814 - DNA, 594 bp, Homo sapiens
  misc_feature 166, 194, 197, 453, 477, 540, 547, 563, 571, 579, 592: n = A,T,C or G
agcctcgcctgggccggcctgtggctcccattttcctttcagcgggacaaaggggacttgttaccaggccattttctggatggcctgtgagatctctgcccctccaagaccckccaaryctsmsyckgwcscmswgytsksmsmmwgmmtycwgcmsygssmrccntgssrryktswrkctggcaccaggctgnagnctccccaatcccagcccactttgctgtgtctctggcgggctgtcctccttggtgggagctgtcctgcacactgtaggatgcttaaaggtatccctkgcctccacccacccctagccagcagctcccagtcagacaacagccagawatgtctccagactctgcccagcctccccaggtagccaccctcgagacacgacctcagagtctctgtgtctcctagaagcctgacagagacccccagggcagtgggtgggtngcgggctagagacccttgcctgtntccgggaccctggcgccgctctcccctcctgtggatccctccggactaacagtgttcttagtnggcagangctggggcaccccttnggccctgncaggcatngccattggcgcangc

SEQ ID NO: 815 - DNA, 812 bp, Homo sapiens
  misc_feature 646: n = A,T,C or G
aaaaccgggtataacactttaatatagatttgtggaactctggcccttgcagccagaatacacatttataagccataaataaagcacgcagaaaccataaattaatcggacccgagacctggatttcaccgtgtcaagattgggaatgctttttttttctttttcttggtcatttacaacagacccttacattattttttttcctgtttttaaacaatagtacaaccctctggttctgttaaaactacatggttttacaccgagtcactcacaaaatttttttttttttttaagtaagacttccctgcaacaacagcaatggaggagaacaacaacaacaaaaaaatcagaatctgcaggtgcttgaagaagcaggagtctacacagtagtggaaaccggaggcttttttttaactttatattctttcccgttttcctccttatatagaacgtggggtatctgtgtggccctctgtttgggacggaacrgctgcagcgggtgaaggaagactgctgtcttgggggtgttggggtgggggtgttatggatttcttctcccttgcgtctctgcaacaccgtctccccaaagtctcgacccccacttgctctctcacttrtcctcgatccggggtgccagagttagccnggcctgaagccgtcgtcttcttaagaggagttcataatgggccgggagtacaccccctggtagtaggaggtatctgcggccaggggcgaggcgtccaggcccgttttgttcgtgaccgggcccatggccaagctgccaggcatgggggaaccgtagccggggtagt

SEQ ID NO: 816 - DNA, 999 bp, Homo sapiens
  misc_feature 21, 98, 164, 166, 174, 176, 198, 253, 269: n = A,T,C or G
aagccgccttctgagcctttngcctctgttgttcctcctgctgcctgtgagttttcatgtgtgcatttcggcttttgatcttgaagaagactttgccncactccttgcaggggaagatggtggtggggtctgtctcgccgctggtggtgctgtgagagggtgancnctttaccncnacagtacccactctgggtgccnccaggcttctgcttcccagagsgkrtrrmmmckmgggccttgctttgccccctgnaaaagctgccccctanccatagtatctcccaggcaaagatgccatgctcactgcaaactatggaatgaggtcagaacagaatcaaagtaacgcttgatgggaaaagttggccccaagaccccagtactaagagggtcgcctgcgtctcacacacacacactcacagcaagctttgggataaaaggcaaccgggatggttgacatctgaatgcaatggaacatgaaggtcagcttcagtccctactgggaatgatttcatgagaaggtagcccagatgaaacacctcttaaagatagttgtgccaattatttattcccccaaccccccacaaaaacaaatttttttaaataaaaggaaaagaaataggatttttttttctaaacctgaataaaatgaccacttttaaaacagrtagtttaaaagggttacaaaacaagcaggcagtccaggtttcctgattaatgaagatggaggccgtgggttttcactgtctctaagtgacacacagggctttatagttctgcgtcaccctgaagcaagactgaatcttgatcatccaagagaagatcggtgtccacaacttcagcctcttccatgacacctcccaactgctggacgacgtcgtcgtcgaggatgtccacatccttgtatgggtttgatcagactcagctggtccaggggcagcagcmcgrcagcaccccacgggcccgtagtcctctcaatcgtggctgccatctcagctgcaa

SEQ ID NO: 817 - DNA, 653 bp, Homo sapiens
atttttaywtttaaaacattttatgagggataaaatatagtctttttctatcagtatgttcacacttcctggcctctcattgggaagctgtaagatgtccttcaataagatcctgaacacgcgacagaataatctcattagagctgctgcaattttctggaccatatggtgggtctatagtcaggaccccagccacacagagagtccttggagcgtctccctgttcagtgatggggatgtggttcttctcaagccatttctttaggctgttctttctctcttccagatcctctgggctgtatgctttgcagtctccagacgtgaacaaatgcatcagcttctccctcactctatggtccccttcattcatagtttcaacagtckgcacagcatgtcccataattccggtcacagacatgctgccatcttcaaggaagttcacaaggacaatattggcagagactgggtctgkagttaaamcccatcctttatactcattcttctcactggctgtcactcggacctctttgtaaatgtaatcttgccattctaaggggcctttcttcatccattcactcatgattgccacctggctaaatcagttaaaaaactcctcgcaactctgggtactcagcaaccatgctttgaggaag

SEQ ID NO: 818 - DNA, 1225 bp, Homo sapiens
  misc_feature 911, 1224: n = A,T,C or G
ggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcakgcaagcccaagactttgtaatttttaaagggcccaagatttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagagcaatngtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgaggaactagcctcaggctttaatattctcattggcatttgccaaggtcctgaggccaaataaggtttaagttaaaacaaatccaattgtnt

SEQ ID NO: 819 - DNA, 1024 bp, Homo sapiens
  misc_feature 617, 659, 750, 804, 809, 834, 901, 996: n = A,T,C or G
gacaccccagatgcagccaccaccagcagaagcgatcagctgaccccacaagggcacgtggctgtggccgtgggctcaggtggcagctatggagccgaggatgaggtggaggaggagagtgacarggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgmtggtgctggcccagaggagggacccctccatccactacagcccccagttccacaaggtgaccgtggcaggcatcagcatctactgctatrcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcattccctgtgcctntggctacagtggctctttgggggcgctggccctgggcctgtncaaccaccgggctggtaatcaccctctggcccgtggtccgtgaggacaccaggctggtggccacagtgctgctgtccgtggtcgtgctgcnccacgccctcctggccatgggctgtaagttgtacttcttccagtcgctgcctcnggagnacgtggctcctccaccccaaatcanatctctgccctcaaacatcgcgctgtcccctaccttgccgcagtccctggccccctcctaggaaggnccgggtcccacaggcaacacctaagtggaccaacccctctgcctgtcctgccccccagacgatgactgaaggctcctttgacaccttgagatgantctgctactttccagacttttcttacaa

SEQ ID NO: 820 - DNA, 631 bp, Homo sapiens
atttttaywtttaaaacattttatgagggataaaatatagtctttttctatcagtatgttcacacttcctggcctctcattgggaagctgtaagatgtccttcaataagatcctgaacacgcgacagaataatctcattagagctgctgcaattttctggaccatatggtgggtctatagtcaggaccccagccacacagagagtccttggagcgtctccctgttcagtgatggggatgtggttcttctcaagccatttctttaggctgttctttctctcttccagatcctctgggctgtatgctttgcagtctccagacgtgaacaaatgcatcagcttctccctcactctatggtccccttcattcatagtttcaacagtckgcacagcatgtcccataattccggtcacagacatgctgccatcttcaaggaagttcacaaggacaatattggcagagactgggtctgkagttaaamcccatcctttatactcattcttctcactggctgtcactcggacctctttgtaaatgtaatcttgccattctaaggggcctttcttcatccattcactcatgattgccacctggctaaatcagttaaaaaactcctcgcaactctgggtact

SEQ ID NO: 821 - DNA, 635 bp, Homo sapiens
  misc_feature 609: n = A,T,C or G
aggttgctcacctgaaggagcacaggagggttttccaggccatgtggctcaggttcctcaagcacaagctgcccctcagcctctacaagaaggtgctgctgattgtgcatgacgccatcctgccgcagctggcgcagcccacgctcatgatcgacttcctcacccgcgcctssgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctcgagttggaacgccgacccttacgaaccctgggagaggaggacccagcccagagccgggctttgggagagttccttgttggatttttcagggccttncagcggcattaccaacttgaggtttt

SEQ ID NO: 822 - DNA, 752 bp, Homo sapiens
tgcttttatcttgaatgtagccttcaactttgtgtaattccttaccaaaaaggccacatggcttaaaattcaacacacatttgtccccagtcttgtggtttataatttccacattgccatactgttcgatccacagtttacccacaatgatattatgcacacagcaggtgggatttgtccatgtatatgcctcattgtgttcaaggagctccaaggtgatggttcctttgggttctgcttctacactcttcccccagaatttcagtttgggatagatagagccatgaaagatgaagtcattgtttaatccttcagcatgaaatgcactgattggtgggtgatggctgacctgttcggagatgagtctaaatccaaggtcatctcgcactaattcataagtctctcccagcagtgggttgaaaggttttccagtccgttcccactgagaagcaacagcagatacagcaaacgcagctacacactgcatcctttccacaggatcagagagtgaactggccttgtggaygaggtaagtatgctccatgtattcagttaggcgctgtaggaagctcagaggctcattaaatataactggcatcgtgatcttggatagttccattccaatacattttctgaggatgctccagatactgaagtcatttctggaaaacataggagaaggcaaacttgttctgtgtttcttgatgccattggagagagcatctccgccaccacagtctttttcttcggac

SEQ ID NO: 823 - DNA, 899 bp, Homo sapiens
tttgccacagggtaaacttttattttagaatccaatcttttccccacacatacacaataaattaaacagaatccacagtaaatgtacattttttaacataaaaagtcagttactgttacttcatgatcacatgaggatcgtcacagctccgtgtccattagcacattaccctccttgtccttaactcttatccgaccggatctgtacttcgtttcttgatgaccgtttgcatatacggttttaacagtgccatctgggtattcccgtctcttgaactgggcagtatgtagttctctttggccattattaaactctatgagtttgttgccatcacgttgtactctgacaattgtaccatctgggaaaatgctttcttcttgtccatcaggaaataagtttttaacagtctggtcaggaaacgtgatttcttttcttccatctgggtaatgtttttctrtttaaaaagttgttacagtaaatattttttgaaggaagggaagaatttaatgagagggtggagcaagtttgtacctatttgtccacttgagaaatgtaagacttccagtcctccgggtatgtcgtgtgagtggtctgggcagctgcatagtagtagatctgtaaagacacacagtcagtctgccttttctccagagatggttaaactatggaggagaacacttctggaaacataccactctttggtctggcatgacctgcttcacgtcaccattaaagaaagtgacagtgatggtcttcccatctgcactcacttcctttcgagttccattgggaaacagtataacacggcacccattcttataaaccttttccacctttccatcaggatgactgatttctccctgtatgtcttggtcttcctcctcctctttatattcagg

SEQ ID NO: 824 - DNA, 1980 bp, Homo sapiens
  misc_feature 206, 689, 1098: n = A,T,C or G
acccgtccggggccggccaatttgcatatttggaatgcgccgctataaacccggctggggttttgcagcgatttcttagatgtaaaaatgagatctcaatagcagcgggctgggcacatcctcksmwytcysskwswskmtstgcccrgagctggtttccgtctctcggctcggggctggaactccggcccaacctaggcgcgcanccgcsacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcagatngaaactgaagaaaatgaatcgagaaaaccggatccgggagctcacagccaactttaatttttcctgatgaatctccaggcgacgcggttttttcacttcccgagcgctggtcccctccctctgtcttcaggctctgccaggaactcgcacctgtgctggagccctgttcctccctcccacactcgccatctcctgggccgttacatctgtgcagggctggtttgttctgactttttgtttctttgtgtttgcttggtgctggttwatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagcntggtttcctgcccagcctggggcaaacctagccgaaggccgaggtcccattgttggcgctgaggtgtctggcctgaggtcaatggtgcaaaggagccgccaccggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagtttttttttttgtttgtttttgctttctgaaattcacagaagcctaggaggactggggtaagcggaataaactagagaagggagacattgtttggatttccttcctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaag

SEQ ID NO: 825 - DNA, 333 bp, Homo sapiens
tctagatattgcccaatcgctgcccacagtgcacatacctttccaccagtcacatgtgagagggcagattttccaaatgctcatcaccacttggcactgtgtggactataattttggccagttaggaaatggcatctcattgttttcatcttaatttgcgtcagcctgattactcattgaaacttgtgaggttgagaaacttttcttaagcttattggccattcaagtttcctcctttatgaaatggttgttcatgtcatttkctcatttttatattagattgkwtttmtwttttccagctgacttgtaggaactctacatcttatcaatatt

SEQ ID NO: 826 - DNA, 658 bp, Homo sapiens
  misc_feature 198, 457, 463, 493, 530, 542, 553, 561, 569, 603: n = A,T,C or G
ttttttttttttttttttttttttgaaggcttcatgaataatttattccatttgaagttttgttttttgtttttgtttttttttttttaaaaagtataaaccttttcatttcctcaatcacaatttgtacaactcagtgttatggcattcggcagcaatagtgtttgttccttattctctttttgtcacgttaaaaanaaagcaattggaccatattaaatgtcactgctaaacaacaactttaaaacgccccttcataaagtgaccaagctattttgagagggttgatgctgacatgtccagtaatgacgttacaatttgtagcttaaactcaataactttaaggtccacatatccagtttactttgaaaactaaagatgttttaaaacttcatgaatacatcaacctgaggagtattttaggkcccaaatccagtttttaaatttatactccacnaaaaangaaaatacatacataaaawtttaaaccmcngttytgggcccattwaaacaccmaaaaagaccccccnaaaagttaaganttccagcttanttctggangggtgggncaaaatarrawkktwtawwmawwwymytwwtccnkmattcagacaaactaaaatcttaagaggaaacccagaccaaaatatcactcatg

SEQ ID NO: 827 - DNA, 453 bp, Homo sapiens
  misc_feature 34: n = A,T,C or G
attatagagattaatctcctttgctcgaagtctntttaaatattagtcacatctaaaacatacttttacagcaacatctagactggtgtttgaccaaacaactgggcatcatagctgacacataaaattaaccatcacaaccatgttctaggcactgttcctcactgcctgagaagacaccgttatgtttattagggtttttgagttttatccacagcttttggttatctgcaaccatgtctcccaccattaacatagttcacactgagatgaggattccctatttaacacttggtcccaacttcttcacagtccatctggttttgtagagggaacataactggacattctggtcaggttaggtgaggtcaggccttcaggacgctattttcactgagttgctttataaggcacattatgcaaaattccatcagctcttctgttcactacatt

SEQ ID NO: 828 - DNA, 657 bp, Homo sapiens
aagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtaaaaaaaaaaa

SEQ ID NO: 829 - DNA, 775 bp, Homo sapiens
  misc_feature 27, 42, 60, 97: n = A,T,C or G
ggtttgagaaaatcaattcaaatctgncccttctgattgcanctctaaccaggttctgancggtgtcagagacttcccaatacatttcccttctagnatgcctcataaatccactcaaaagtaagacaccaaacacacacctcatttcctgaactgtgacttccaagctgacatttttctgagaagcataattattggtttcattgacaattaagttgaatgtttcatcatcaaaaaataattcaaaaagctctactgggttcaacttttcgctcttgagattcaaaagtccagaatccagtgctgaccagcttggaaaattgggtttaatgtctcttttggtccaactcttttctgggaaacatgatacctttaacttcttttgagcaggctggatctcaggctcattatctttttccacatctgagtcaccagagaatgagaggccttggagcagttcactcactcgagctttgtctttttttctcccttttcgggtaatgtctcctgcagcatattccagggatgagatgtgcatgcgggcccacaaatcacctgggtgacggtccttcagagtgttcaaatgtgcaactgtcctttcagtagcaataggagtactacaaggaatctggggtgcacactctctgttgggctttcctgaggcttctccactttgttccatttcttcagaagtttcttgctttgctttaaacaatctatctttagttacaatttcttcagctgggtgtagccccagctttttagaaggctgagg

SEQ ID NO: 830 - DNA, 413 bp, Homo sapiens
  misc_feature 211, 403: n = A,T,C or G
agagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcakagcsmcasgkgcagtgtggcntgctgccccccaggaggcctgaggctgggtctcactgctctgaaaagacacaaccagaatggcctggggctcaggcccttggctgagtgggaatgcgttgggactgcccagctgagctatcaggtgcccatcttttctggtmccagcagtggtgaggagagcacaggcaggcctcgcccctcccttgctcanccagtttccc

SEQ ID NO: 831 - DNA, 876 bp, Homo sapiens
  misc_feature 185, 784, 804, 816, 861: n = A,T,C or G
gctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgnykacatgcakaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccagggaagaacatccaagggtgttcctgcaagggctggtgtgggaaccangccagtgtggggttccaggnaagccaaaagtncagactggtggtgttgactgtttgctgtgacccccacaaagtttncggaaccgcccacca

SEQ ID NO: 832 - DNA, 768 bp, Homo sapiens
  misc_feature 63, 69, 98, 104, 156, 214, 221: n = A,T,C or G
tagacatagaaaacatacagtaagaatatggtattataatcttacggsammamygysrmmtrnsckkknwrwmktkgwaaagykgyrmyrsgrcsyanramtanmmmtasctrgytrrkymrywtwwmmatycctksccmgggagtttgaaatttnatactatagaaataactttaggttttaggtagagttaaagaggtaaagcacatgttgnccacaancccaggaaagtatttttaagaaagattggattttcctacctttagagatctaaaaaaaatttaatataaaaaatcattttgtgttggtgtttattactagttcagatgagtggctgctgaaggggcccccttgtcattttcattataacccaatttccacttatttgaactcttaagtcataaatgtataatgacttatgaattagcacagttaagttgacactagaaactgcccatttctgtattacactatcaaataggaaacattggaaagatggggaaaaaaatcttattttaaaatggcttagaaagttttcagattactttgaaaattctaaacttctttctgtttccaaaacttgaaaatatgtagatggactcatgcattaagactgttttcaaagctttcctcacatttttaaagtgtgattttccttttaatatacatatttattttcyttaaagcagctatatcccaacccatgactttgggrgatatacccataaaaccmatataacagcaggggtattggagcagctttctcaa

SEQ ID NO: 833 - DNA, 1604 bp, Homo sapiens
  misc_feature 1387, 1409, 1423, 1446, 1477, 1486, 1492: n = A,T,C or G
aactagtatatttacaacatcagaaacttcaatatggagatttgttgttcctatatcatgatctttagcagcaactacaccataggcactgcacaacctgggtcctagatcaggacgtacaaaaaatcctggcaaatgagaggccaaattgaattttccttctggattacaatattctggcaatggcagactttttaaaagatcttcgtatcttgctggcatcatagtcttgaagtcttctcctgaaggccaatctttcaattttaaaacaactgtttctccactcttgtttttctgccgttttgaaacttcttcaaaaccatcccagaattccttaacattggcatttgaaatgatgctatctttgcagttcaggagatcagcttggtggtctccaaaatcaagactaattgattccgccttccataggctaatgttcattttcttatgcacaccagaaaccactgcaggctgtccttgtttccaacattctttgaaaagcttccaattactgctattcttataatccttaagccataaaatatgcttctcacagatccaagaatgtggtatatcactgtataatttattattttcatccactgcagatattatgctttcttcaggctcttctttaagctctggttttacatttatcttggaggttttacttggtggaattttgttttcaacaactgaagcaattatgtcatcaagaatgttaggcatagtccgtccacttttgctacttggggctcccattgaatatactggggcaaaggcaatgccagcatctgtasaccccacacgtagctttccagctgttgtagtcagcaaatcccgtaaggttgagccttgttcattattctgggacacaagaggtgatgttctgccatttggagattcagagttgtcttgttctctttcttctttaatttggttttcaagggtaagttctttgttttcttttttttcctctctggctttttgctctgcaagatctgctaaccagtgcagtggtgactgggattctggaggagttaacttgttatctgtgcctacatcactctctgggctgctgccaccatttttctcagacttcggaggagtattttgctgctgagactcaggcatgcacagagaaattttattactgtgattaagaacattctgtaaaacttgagatacaccattcattgtaggaaaatttccaacttgtaaattctgtttgttagtacaatgacaatgggatttaataccatatttttccctaagagtgtgcatggcatctagaagatctgtcaaaacagaaccaggtataatttgggttggcattaaatgtttgtgatcatgaggctgtccyttcacacacttcatccaagcatantagttctttatcyctagaactnctycctttcctttngccttgtaacaatctaagcaganccacaawkccacattttkggcagacccagtnrawkktaancawkgntgcttcacatgcatcacacatctcccggactcctctcactgctcttttccaggcaattttggcatcctttttcacccaggacaaagctgttttttcagatgttactaattga

SEQ ID NO: 834 - DNA, 617 bp, Homo sapiens
  misc_feature 204: n = A,T,C or G
gtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctcyassangrtgrmsrcrsgkkacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagctttctaaaaaacagargaaaaagaaacagaaaccagcacaggatgtacctggcaaagattcatatctgcctgcagctc

SEQ ID NO: 835 - DNA, 542 bp, Homo sapiens
  misc_feature 310, 339, 340, 345, 369, 370, 438, 463, 467: n = A,T,C or G
ttttttttttagaccaacattctttaatcacaaaggcacttgaggacccctacaaacccaaagtctctgccaagagtggccctgcagacgccccacctgccaccctccatccacccatccatccacacactcagagttcatcgtgacctgcagagggctccacactaggcttgatgaagatgccttccatggccttccacgtattgtgcgtgttggcactgggcatgccgtggacctcatgctgcccacggatggggcttccatactgctcacccgtgactgacaggaacacagaggtgcccacatgctngrarsgcacagcagcctcacgctcccagnngctgntccagagcagcgcactgtccatanngktccaggtcgtcgccctcgccgtcttccccaaaggcactcacctcctggttgttggacagcggcgangggaagtggtgcgtgtgcaggttcnttgnccgtaagcacatgcgtgagcctcaccgcctgcccgcagcgcaccgcaagggcccaggcggagccgacgctcgcgc

SEQ ID NO: 836 - DNA, 542 bp, Homo sapiens; identical to SEQ ID NO: 835
  misc_feature 310, 339, 340, 345, 369, 370, 438, 463, 467: n = A,T,C or G

SEQ ID NO: 837 - DNA, 719 bp, Homo sapiens
  misc_feature 133, 143, 154, 166, 195, 284, 301: n = A,T,C or G
aaaaggtcccccttctgggaaagaccgagtgaagaaaggtggatcctacatgtgccataggtcttattgttacaggtatcgctgtgctgctcggagccagaacacacctgatagctctgcttcgaatctggrnttccgctgtncagccgaccgnctgcccactatngactgacaaccaaggaaagtcttccccantccaaggagcagtcgtgtctgacctacattgggcttttctcagaactttgaacgatcccatgcaaagaattcccaccctgaggtgtttnacatacctgcccaatgncaaaggaaccgccttgtgagaccaaattgctgacctgggtcagtgcatgtgctttatggtgtggtgcatctttggagatcatcgccatattttacttttgagagtctttaaagaggaaggggagtggagggaaccctgagctaggcttcaggaggcccgcgtcctacgcaggctctgcacaggggttagaccccaggtccgacgcttgaccttcctgggcctcaagtgccctcccctatcaaatgacagggatggacagcatgacctctgggtgtctctccaactcaccagttctaaaaagggtatcagattctattgtgacttcataagtgagaatttatgatagattattttttagctattttttccatgtgtgaaccttgagtgatactaatcatgtaaagtaagagttccctta

SEQ ID NO: 838 - DNA, 579 bp, Homo sapiens
  misc_feature 166: n = A,T,C or G
aagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctganctggagcagctctccaattctctaccaaataaagaattgatgacctcaatctgtgactgtctgttggctacgctagctaactctgagagcagttacaactgtttactgacatgtgtcagaacaatgatgtttcttgcagagatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattgggatgctgtgggagatgataatgggtctcatgggaagtaggaggggagctcatacatcacggacgatgagtattaatgctgcagagttaaaccagcttcttccaaggcaa

SEQ ID NO: 839 - DNA, 1172 bp, Homo sapiens
  misc_feature 63, 121: n = A,T,C or G
aaccaaacctcccaacttagtgaaaacaaggcattcaatgacagaccagcagcagaaactgcntattacctcctaatcattttatgaagaaatacctatataaaaacaaacactaaagagnacaaatagatttaactaaagtgacaagcataattataaataaataccagattatcagattttaaacaataatctataacagttttactatctaaggattttcactccaagaagaaaaaatacatagtaacgccaagcttgcaggacgatgacttaacagatacattttctcttaatggaaacttatctagcttcagtaatatttctggatgtagcatcaagttgctgttgcacatttttaaaagactggtccagcagtgtttcctcttcatttaaagtattggcaatagcatcattacatggattgtccagaatgtcttcgtttaatccatttgactcctccttttgatcctcatcagtattaacctcttcaaccgtgtgtgccctgggtgtattcattaacatatcatttccyagggtctgactattactcagcagcttkgcctgccttctttccarggccagttggttwatttcycycaattctttgttgttgctcttctgttaggcttctacttaactcagaagcaaacatctcactttcagataagtttgtcagaaagggatctaattcagtagaagtgacatcatgttcattattctccgcaacttcatcattattgctaacaaaatcttcatgtaaaatagggagatcaagtcgaattcgttttaaacaggtctgaacttcctttttacttcccaggtattcaactctgtcaataaaatcctcaaactgcagtttagggaatagcctatgtgcccagtgctccatgtgtctgattagcatcttcaagtcttcagcctcatgacctttacctttgaattttgccttatcaaatacatgccttaaggctggaagtcctctctctgaaattaatctctgagcatccagcttgggtatatttcttttaactgttctctttggaggtacaggaacaggtgctccatttcctgactcttcatcaggctcagttccttcaccatcttgtctctctggagaggctggaggtgggaaaggaggaaaagtttcatcttctacatgctcataatct

SEQ ID NO: 840 - DNA, 1145 bp, Homo sapiens
  misc_feature 133, 172, 189, 200: n = A,T,C or G
cctcctactcccaaacaaatctttggggaaaaaaaaactaccaactgtcagccatgggcctgacggcgctaagctctggggctccgtgcactgacgtggggccagccacagggaggcggggatsmrgymgcgngassscmggakywkgrscwscwscsrsgymrgkwgcagnrgcrgyggcrhcrsgancmrmagcagcntgmwgcagctcawgcacctggagtccttttaygaaaaamcyyctcctgggcttatcaaggaagatgagactaagccagaagattgcataccagatgtaccaggcaatgaacacgccagggaatttctggctcatgcaccaactaaaggactttggatgccactggggaaagaagtcaaagttatgcagtgttggcgttgcaaacgctatggtcaccgaacgggtgacaaagaatgccctttctttatcaaaggcaaccaaaagttagagcagttcagagtggcacatgaagatcccatgtatgacatcatacgagacaataaacgacatgaaaaggacgtaaggatacagcagttaaaacagttactggaggattctacctcagatgaagataggagcagctccmgttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagcagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattcctttgaagtgtctcccacagggtggcaggactgggagaatctctgaggcgtgtcttccaggccctcccacagcttgtgccctccacagtgtggactcaggtcccatagacatcaggctggagtcttctctgttgtt

SEQ ID NO: 841 - DNA, 642 bp, Homo sapiens
  misc_feature 452: n = A,T,C or G
ttttttataaaaataaatatttattgccatttgaagctttatgtacacctttaaaagcacatgtacaaatgtgggaaattacaaaaatcaacctaaaaccctttttctcaaagtatacataaatgtacatccaagatcagtggtgctaccatcattagaataaaaaataagtctgtctggacataaacaagcaatcattttaagtgtcattcagatattctcctttatatttaaaactccaaaaaatactaagaggcccaatatatccagaaaattgtgttttcactttaccctaacttatgaatagtggtatacaaatatatttccatctttttgtccagccagcaaatgagagtctgtacccgaccatttcacaaaagaccaatgttggtcagagacagskskgagrrksgymktasrstkamysasaakkarstsmmamayrgsrmttnykcmasrastcamkmtykytgsyrcasrgwkrwctywsrmswmwmmwkmsargmmccatttcagaataggctttgtgacagactgaagcttggtaagaatcatcaatgtgcatctttttcaggagttgaccagtttttaaattccaaataacaatgttgttcataatagtagtaccaagcagagcttctt

SEQ ID NO: 842 - DNA, 452 bp, Homo sapiens
  misc_feature 314: n = A,T,C or G
acggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctrcagccgccgccagagggtttccttcggcgtctctgagcagcaggcagtggaagcctgggagaagctgacccgggaagaggggacacccytgaccttgtactacagccactggcgcaantgcgtgaccgggagatccagctggagatcagtggcaaagagcggctggaagacctgwacttccctgagatcaaacgaaggaagatggctgacaggaaggatgaggacaggwagcaatttaaagacctcttttgacctg

SEQ ID NO: 843 - DNA, 805 bp, Homo sapiens
  misc_feature 219, 229, 240, 252, 281, 370, 387: n = A,T,C or G
ggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctggrnttccgctgtncagccgaccgnctgcccactatngactgacaaccaaggaaagtcttccccantccaaggagcagtcgtgtctgacctacattgggcttttctcagaactttgaacgatcccatgcaaagaattcccaccctgaggtgtttnacatacctgcccaatgncaaaggaaccgccttgtgagaccaaattgctgacctgggtcagtgcatgtgctttatggtgtggtgcatctttggagatcatcgccatattttacttttgagagtctttaaagaggaaggggagtggagggaaccctgagctaggcttcaggaggcccgcgtcctacgcaggctctgcacaggggttagaccccaggtccgacgcttgaccttcctgggcctcaagtgccctcccctatcaaatgacagggatggacagcatgacctctgggtgtctctccaactcaccagttctaaaaagggtatcagattctattgtgacttcataagtgagaatttatgatagattattttttagctattttttccatgtgtgaaccttgagtgatactaatcatgtaaagtaagagttccctta

SEQ ID NO: 844 - DNA, 702 bp, Homo sapiens
  misc_feature 499, 515, 522: n = A,T,C or G
tttttttttttttttttgcaggtgcatttgtttctttatttaaaaaaatcatctgggggcatggtctgaggaggacacccctcccatggctttggggaggacgcaggttccaggagtcacagggcagaaacacgcggggtgggtgggggcgtggccggagtggggaggggctgtsccaggcacctgggggtggctcccacggcaccaggtgggctagggcaacagtatgtacaggcgagcagtgctcctggacccggtcggggccggctggggcccatttctgcggcaggggagctctggggcacagggtctgagtcccatcttgggctkcagggaccgcgaggscgtccagggaggctggacagcgggggcctttatctgggcccatcaggtggatgagaacggacactgcaaaccgctcaccacctgggccagggctaggctatccggcagggcctccccmmctgaatcctgcgtgcgcagaactcaagccggcatncaggcagtkggaacgncccgcangctgggcttggktgsyckcrsgcacgtgacaggtggggcccgtgtcctgataaacggacaggaacaaaaggaacgcaaggtctgggacccacggctctgggagcagcgccacccaggctggctcctagcagagaaatgggaatcgcaaatgcattgcaatgtgcagtgaagagacgcgag

SEQ ID NO: 845 - DNA, 273 bp, Homo sapiens
  misc_feature 43, 44, 45, 46, 47, 48, 49, 53, 58, 63, 65, 67, 74, 76, 81,82, 83, 85, 95, 97, 98, 99, 102, 103, 106, 110, 118, 123,130, 132, 133, 135, 138, 142, 144, 145, 149, 150, 152, 153,154, 157, 164, 167, 168, 173, 175, 180, 181, 188, 189: n = A,T,C or G
  misc_feature 190, 192, 193, 194, 195, 196, 200, 203, 205, 206, 208, 209,214, 219, 220, 222, 223, 224, 227, 228, 231, 235, 236, 240,242, 244, 246, 250, 251, 253, 254, 258, 260, 262, 263, 264,270: n = A,T,C or G
gtggtttcttagcatgatggtgtatgtatggggtaatggaaannnnnnnaaanttacnggagngnancaaacangngcacnnngngaataactanannnaannccnaaangatgcacnacaanacccatntnntnatngccntnncatnnannntanattttcncannttctnanaatcnnaccttcnnncnnnnntccnctntnntnntcacnccttnncnnnttnncantatnnactnanancntctnnanncaanantnnntctatntac

SEQ ID NO: 846 - DNA, 300 bp, Homo sapiens
gtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaa

SEQ ID NO: 847 - DNA, 294 bp, Homo sapiens
  misc_feature 199, 200, 201, 202, 203, 204, 205, 206, 207, 210, 214, 215,217, 219, 225, 228, 229, 231, 232, 234, 235, 239, 244, 248,250, 255, 260, 262, 263, 264, 271, 272, 273, 282, 288: n = A,T,C or G
ggggattcataattccagacaggtagagaacggttttatttatgtagagacagagtctcgctctgtcgccaggctgaggcgggagaatcacttgaacctgggaggtggaggttgcgctgagctgagatcattacactgcactccagcctgggcaacagagtgagactatgtctcaaaaaaaaaaaaaaaaaaaaaaaannnnnnnnnttnaaanntntngggggnctnntnncnnaaanccaancttnanaaaanccttngnnnatttggnnnaacccccanttaaanggcggg

SEQ ID NO: 848 - DNA, 300 bp, Homo sapiens
  misc_feature 11, 15, 19, 24, 28, 33, 35, 40, 50, 54, 62, 68, 76, 80, 83,87, 90, 95, 97, 100, 108, 110, 111, 118, 122, 124, 125,127, 130, 134, 137, 150, 154, 156, 157, 160, 161, 168, 174,179, 185, 187, 195, 199, 205, 206, 209, 210, 213, 215: n = A,T,C or G
  misc_feature 218: n = A,T,C or G
cggcaaaactngganggangcgancgtngggcnanacccntgtttttgangccngggccctnttgtanggggcggntttntgntgcngtnctttnanacnttttgagntnnaaaaggntaangnntnaanttcngtnccttttgaacccngatntnntcnnaaaattncccttncctancaggangnttttgggnttgnatttgnntannccngntcntctttctggttttgcctgaacaccaagtagcttcataatcaaagggtcattttctggtttgtatcagaccgtatttataaag

SEQ ID NO: 849 - DNA, 285 bp, Homo sapiens
  misc_feature 8, 12, 13, 14, 18, 22, 26, 27, 33, 36, 39, 40, 41: n = A,T,C or G
caattagnttannntcgncccntgcnnttccanctnggnnnaccccatatggaacatgttaaaaaaaaaagccaggccgagcgtgttggctcacgcttgtaatcccagcactttgggaggccgaggcgggtggatcacgaggtcaggagatcgagttccatcctggctaacacagtgaaacgtgtttttactaaaagtacaaaaaactagctgggcgtggtggcaggagcctgtagtcccagctactcgggaggctgaggcaggagaattgcttgaaccggggag

SEQ ID NO: 850 - DNA, 131 bp, Homo sapiens
gctactcgggaggctgaggcaggagaatcgcttgaacctaggaggcataggttgcagtgagctgagattgcaccactgcaccccagcctgggcaataagagtgaaactccatctcaaaaaaaaaaaaaaaa

SEQ ID NO: 851 - DNA, 287 bp, Homo sapiens
  misc_feature 8, 14, 15, 19, 21, 23, 24, 25, 31, 33, 40, 42, 44, 47, 49,58, 61, 70, 72, 82, 84, 89, 90, 92, 95, 97, 99, 108, 112,113, 119, 122, 124, 130, 132, 134, 135, 138, 139, 141, 143,148, 158, 163, 168, 170, 174, 179, 183, 184, 185, 187: n = A,T,C or G
  misc_feature 188, 189, 190: n = A,T,C or G
atataggnttttannaatnanannntggtgngntaaagantnantangnttttgctgntgnattttaggncnaaaaaatttnanatttnntnggnantnaaggaaaangggnnttttgntangntgcctnancnnacnngnangttcnaaaaaccccngtttnaaacngngccncaggntttnnnannnnacagatattctggttccagatgtcttgtaagttaacctgcctccatttccctttctgtaaagcaaaataatgtttacacctaatctgtctctcaggg

SEQ ID NO: 852 - DNA, 300 bp, Homo sapiens
  misc_feature 168, 169, 170, 171, 172, 173, 174, 175, 176, 188, 201, 202,211, 229, 233, 237, 238, 244, 260, 266, 267, 268, 269, 278,281, 282, 294: n = A,T,C or G
gaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggnnnnnnnnnatgaatcctacntgagctatgttcnngcccggaanataacgaacttgattggngctncttnncccacngctcttggagattccngacttnnnntatatgacnctnnagcactggcatnaacttg

SEQ ID NO: 853 - DNA, 300 bp, Homo sapiens
gtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggccta

SEQ ID NO: 854 - DNA, 296 bp, Homo sapiens
  misc_feature 131, 132, 133, 134, 135, 136, 137, 138, 139, 140, 141, 143,151, 157, 158, 164, 165, 166, 167, 176, 180, 182, 187, 188,189, 192, 193, 196, 202, 204, 205, 213, 225, 232, 241, 242,243, 252, 270, 274, 285, 290: n = A,T,C or G
gccatgtgaggacatagggagaaagcagccaccattggcaagccaagagagagccctcaccaggaacgattggaccagcaccttgatcttggattttctagcctccagaacttacagtacgggtggctgtnnnnnnnnnnngnttctgacnaggtgnnacactnnnncttccgtgntctntnactgnnntcnntcngctgcngnntctggacntccagaggttcnatgcgcnatcaggacnnnttgctatancccttgctcacgatgagnactntgactttgtgngatgnccgact

SEQ ID NO: 855 - DNA, 300 bp, Homo sapiens
  misc_feature 195, 196, 197, 198, 199, 200, 201, 202, 203, 204, 205, 206,207, 216, 218, 220, 225, 229, 230, 232, 244, 251, 254, 259,265, 267, 270, 276, 283, 285, 287, 291: n = A,T,C or G
gagaaaccccgcctctactaaaaatacagaaaattagccaggcatggaggcacatgcctataatcccagctactcgggaggctgaggtaggagaatcgcttgaatccgggagctggaggttgcagtgagccaagatcgcaccattgcactccagcctgggcaacaagagcgaaactccatctcaaaaaaaaaaannnnnnnnnnnnngggatgatnancntgganctgnntntttttaaacgtngtttttngangcttnaaactntnaangctttnatataangntntcanctgtatgtt

SEQ ID NO: 856 - DNA, 300 bp, Homo sapiens
aaggagtcacccctgggtcacccaagctgagacatcagttggtggttggtcagaacttgtgcccaaatatgctgagtcagcggctctgcccgggcccaaatgctgagtcagcacctctgcccgggcagtctgcaggctggccctacctttgctttctgcctgtggttcctatcagggcacgcacttcagttctgttgggcagggagacgtgcatcagactctctccagggcatatgtgctgtcttgcgcttgcgcgtggcctcccaaacccctagggatacctggggccagctgggcagt

SEQ ID NO: 857 - DNA, 300 bp, Homo sapiens
gagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccag

SEQ ID NO: 858 - DNA, 300 bp, Homo sapiens
cccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaa

SEQ ID NO: 859 - DNA, 126 bp, Homo sapiens
  misc_feature 8, 9, 11, 12, 14, 18, 23, 31, 32, 38, 42, 43, 44, 50, 52,67, 80, 84, 99, 117, 119, 125: n = A,T,C or G
gggaaaanngnnanaccngtgcnttggaaanntttggngaannntccctnanatgaggtagcaaaanccgcagactgganaaangtgtcaaaacttttntaaacctctctgggtctnanacattnt

SEQ ID NO: 860 - DNA, 300 bp, Homo sapiens
agaagttctagcacatcttaatttccttaatagtttaattgatgaagagcattgatgaagagttaggaggtctccctttgtacctacattttccgcttttttagaatgagaagatgagaacgacctccagttcacatgtacgggtgctgtgaggatccagtaggggagatacagtgctcagcaccaagcaggtgcaagtgagcacaatccaattttacatcaggttacccctccaggacagttgctttgacgtggaaggtagagagggagttgaaaggagggtttgcatggttggcagag

SEQ ID NO: 861 - DNA, 281 bp, Homo sapiens
  misc_feature 17, 21, 28, 29, 30, 31, 32, 33, 34, 37, 39, 42, 47, 49, 54,72, 76, 78, 91, 97, 102, 104, 126, 128, 134, 138, 140, 154,166, 168, 175, 177, 190, 193, 197, 199, 202, 210, 219, 228,232, 245, 246, 248, 251, 253, 255, 256, 258, 262, 263: n = A,T,C or G
  misc_feature 264, 281: n = A,T,C or G
agggatacgtgttgttntaanaagtgannnnnnngcntncanggtgncngtcantcctataagatatggcanctgntnagccctttaaggncccttnagccncnggctacccgtttacctcagatnangtttantaangngtaagttttaatcnggaaggggggangnggtgttngnagctccagtaatnttnttantnaanaatacccntcctcttgnaggctcccnagtntcccagccccatnnanaangntnngnaagnnncagaccatgtacagccn

SEQ ID NO: 862 - DNA, 300 bp, Homo sapiens
ggtaaatggcagccccatccttgaactgagaaaacaggtttaaagagtccggtgactaacccccagaaagcagagagttgaagatgaaatcagaacctgagtctggttttcctgacatccggcaggttcaaccctcagaccacagcttattagctatgagcgcagatggttctagcgtttatcctccctgctcctgtgtaaatcagggctgatggggcgacaggtgggaaaactcacctgggagaacagggctctacttccttaggcaagtccttggataagcaagcctggtcctgtcct

SEQ ID NO: 863 - DNA, 300 bp, Homo sapiens
atacaaatactacgttggacgcaaggctatgtttgacagcgattttaagcaagatgctggttatgttgacataggaaatggagattaggacaacatttagttcagcgactgacttcatgacctacacatcccgcatggagatgacttagaagcaggggatatgcccttggacctggtgtcaaagctctcgtttaaacagcctcgtgcagtgtgtcgctaccacagagctcctgtttaaacagcctcgcacggcgtgtcgctgccacacctgacactattgtattagtttacgttgctgag

SEQ ID NO: 864 - DNA, 300 bp, Homo sapiens
tggaggtgctgacgccaggtaggtcagcagtagacccagccccaacccacaagtttcgctctccagactgcgcaagcgcaaaggatacgaaaacgcccccggcgttctgggggctgggaccgaggaaagcgctgagtatagctcttgcgcgtccagtcacaaatgacgtcccttctgtaccccgccctgtaggcgggagcatccaatcaacttcgagagcgtaggccccacctatcgtgggtcgagttgcttggcggtcgtggttccggaggttcctcgggatgtcggtggccttcgtac

SEQ ID NO: 865 - DNA, 300 bp, Homo sapiens; identical to SEQ ID NO: 5

SEQ ID NO: 866 - DNA, 300 bp, Homo sapiens
ctgcacctcaagaacgctagaccactcgccaccagccttctcattccctcttcctccattctaatcatttctagctggctggcctcctcagagcataggaaacctgaggtcaggaattcgagaccagcctggccaacatggtaaaaccccatctctactaaaaatataaaaattagccaggcatggtggcgcacacctgtaatcccagctaatcaagaggctgaggcaggagaattgcttaaatctgggaggcggaagttgcagtgagccaagatcgcgccactgaactccagcctaggc

SEQ ID NO: 867 - DNA, 300 bp, Homo sapiens
aagttcaagcaatgattaatctagcttccctcctggtggatgactgaggcctttgcctgaggacaactttaaagagatattgaatgaagctatgatacctgtagcagttactgccattttggacccataaactgacaatccttaaacattaccaggagggcagagcggaaagaacattgatgtcatcactgagttgctggattaccttactctagaaatagccaactctgcatgtttggttatttttttaaaaagtcttctttattatttacatcattttgaatgggctctaactctagc

SEQ ID NO: 868 - DNA, 300 bp, Homo sapiens
  misc_feature 266, 267, 268, 269, 270, 271, 272, 273, 274, 275, 276, 277,278, 279, 280, 281, 291, 292: n = A,T,C or G
agtcaatccaaatgatttcagagacctgactttgctgtttgaccactctcagctttttggtatcagactcccttcactggctcccaaaaactccagggccatgtttctggaacagtggaaagcagggaaatagaaatggggcctcaggaattagaaataaggctttggcattcaaatgtcgcacctagcatgctgtgactagcgataagtgtgcaaggagtgttgaagcagtaggaagacttgtggtgaggcggggcaggggaatnnnnnnnnnnnnnnnncagagaccannggcctttc

SEQ ID NO: 869 - DNA, 281 bp, Homo sapiens
  misc_feature 85, 86, 87, 88, 89, 90, 91, 92, 93, 94, 95, 96, 100, 104,120, 122, 131, 143, 146, 153, 160, 166, 169, 170, 172, 173,174, 180, 183, 188, 189, 190, 191, 194, 204, 205, 210, 214,221, 227, 231, 232, 238, 242, 245, 266, 267: n = A,T,C or G
tgttcctgtgccagaaagaaagttaaaatacttgcttaagaaagggaggggggtgggaggggtgtagggagagggaagggagggnnnnnnnnnnnnggcntacnttttcctacatttcantntcccttttncctatctaagcngtnctatctngtcaatncacttntcnntnnnttaacnccnttccnnnncanctttcccttnntcctncctntatactnttgctntganntgctgnccanatntgtttcccttcctccatcctnncataccccttactt

SEQ ID NO: 870 - DNA, 300 bp, Homo sapiens
cgaggcagttagctagttgtctgtgaaataaaatactaatgattgaactttctaggaagtacctattctgctaatagtgtaaatatacacttatccagggtcagaaatactcaagtttacccacttaaaagatctagaaaatacatgaacttgggcttacttgccagttaaaattgtttatctcagaattgtaccatcaccttaattaaagtagatatgctaggattatcctgataactaattaacatagcctttccccttagtgttcttcacctgaatgtagtagtggactcttcaagt

SEQ ID NO: 871 - DNA, 277 bp, Homo sapiens; identical to SEQ ID NO: 7
  misc_feature 135, 136, 137, 138, 139, 140, 141, 142, 143, 144, 145, 146,147, 148, 149, 150, 151, 152, 153, 163, 171, 175, 190, 192,197, 200, 201, 234, 241, 244, 249, 255, 256, 271, 272: n = A,T,C or G

SEQ ID NO: 872 - DNA, 293 bp, Homo sapiens
  misc_feature 9, 11, 28, 38, 39, 41, 49, 54, 55, 59, 76, 79, 87, 100, 102,119, 149, 161, 163, 173, 175, 179, 188, 192, 228, 244, 246,250, 253, 257, 258, 259, 261, 262, 263, 264, 286, 287, 288,289: n = A,T,C or G
tggcatcancnagccgtgcagtccgctnttcactgttnnanggcctccnagtgnntcanagcattggacccatctntancaaaagtngaggccaaaaagntnagtgacttgacaagtgncagagtaaccgtgtagacagagcagtgtanacagaaatcaancntcagtcccangngtanacctgatcntggngatcactgccctgagtggcttgccagcacagccagngccatcagtaatttgnangacntancacnnncnnnnttaagttaaaaaacccccattnnnnaagg

SEQ ID NO: 873 - DNA, 300 bp, Homo sapiens
ggctaacttgccttgttttactattgatgtttgtgtcctgtgtccttaacactttaagcagcgtgttctcacctaaaggctaatagttttaagtaagtttctttttctttttttaatttaaaaattaaaaaatttttaattaactttttttaaattaaaaaaaattattaattatttttaatagacaggatcttgctatgctgtccaggctggtcttgaactcctgggctcaagtgatcctcctgccttggcctcccaaagtgctggtattacaggtgtgagtcactgcacctggccaag

SEQ ID NO: 874 - DNA, 281 bp, Homo sapiens
  misc_feature 17, 18, 19, 21, 23, 24, 26, 30, 41, 46, 49, 50, 52, 63, 66,67, 69, 71, 73, 74, 79, 85, 86, 93, 95, 99, 101, 103, 106,110, 114, 118, 127, 132, 133, 137, 140, 146, 147, 150, 151,157, 162, 164, 171, 173, 176, 179, 180, 181: n = A,T,C or G
ttaaaggatttaaggannnananntncttntggtttgcccnttccnacnntnctgggggaaanganncncnannaggtnattctnnttccctnangccnananggnaacntggnttgnccttaaacntttgnnttanatngggtanntgnntttttnaaaantnggtgccntnaangannntttgagctttgcagtagattatgctgcatcctcgtggcaaaattctgtattcttagtgattgttacaaacccctttattgctgtctgagaaaggaaagat

SEQ ID NO: 875 - DNA, 300 bp, Homo sapiens
gtcaagggctgcatgaagtgcgagggccgaagagtctgtgtggactcagtgggacatgggcgtggaagagcagggaggtctgaatgggaagtaaagacacagatgcgggtatgcacacagttctttgaagatgctcggccgaggagacaagagtaatcaggtcaggggcaaaaaggggtactcgcctgaggaagtaaacattggatgtccacagctcagagttagttcaaggtcacattcaaattagataccccgatttcccccggcctgctgtctaaatgccaaatcaagtcatggctt

SEQ ID NO: 876 - DNA, 300 bp, Homo sapiens
gagcagaaacgcaagatatttccctttgctggctaaacagaagcctgggcacccagaatgtgatatcctgaccaatgtttttgcaattctctcagcgaagaatctttctgatgccacagccagtattgtaatggacatagttgatgaccttcttaaccttccagatttcgagcctacagaaacagttttgaacttgctggtaactggatgtgtataccctggcatagcagaaaacatcggtgagtctatcacaataggaggaagattaattctacctcatgtacctgcaattcttcagta

SEQ ID NO: 877 - DNA, 286 bp, Homo sapiens; identical to SEQ ID NO: 97
  misc_feature 13, 24, 65, 67, 68, 69, 70, 71, 72, 73, 74, 75, 76, 77, 78,79, 80, 81, 82, 83, 84, 85, 86, 87: n = A,T,C or G

SEQ ID NO: 878 - DNA, 300 bp, Homo sapiens
  misc_feature 244, 245, 246, 247, 248, 249, 250, 251, 252, 253, 254, 255,256, 257, 258, 259, 264, 278, 279, 281, 288, 290: n = A,T,C or G
gtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaannnnnnnnnnnnnnnntttgntcctgcgctgtacnnanaccttanantgggtaatct

SEQ ID NO: 879 - DNA, 300 bp, Homo sapiens
  misc_feature 231, 232, 233, 234, 235, 236, 237, 238, 239, 240, 241, 242,243, 244, 245, 246, 247, 260, 262, 273: n = A,T,C or G
attgaggaagatctaggtaaaacctttaagttaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtatatcgggataattccaaatttgaggagtggtgtattgaaatggctgagatgcnnnnnnnnnnnnnnnnnaaaggaaaagctnancacgaagaggntaaggagctgtaccaaaggttacctgc

SEQ ID NO: 880 - DNA, 294 bp, Homo sapiens
  misc_feature 158, 159, 160, 161, 162, 163, 164, 165, 166, 167, 175, 183,194, 201, 213, 220, 221, 235, 245, 247, 254, 269, 271, 272,280: n = A,T,C or G
gcttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggannnnnnnnnncccctggncaagcacnacacacatgtngccccancccacggcttantcctcanntcacgcgctgtacnggaacctctncnctgcctnctgcaccctgcaggntnnaaactacngcacccactgataa

SEQ ID NO: 881 - DNA, 300 bp, Homo sapiens
gtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtatgaaaccaagggctgctatatgaccggagctggatggttgtgaatcacaatggtgtttgcctgagtcagaagcaggaaccccggctctgcctgatccagcccttcatcgacttgcggcaaaggatc

SEQ ID NO: 882 - DNA, 300 bp, Homo sapiens
tcttgttcaacattatatccttagggattagtacataggcttgcaaatagcaggtatgaataaaaaattattgaatgagtaaatgaatttaaaatataagttacttaggcggtatcttcaggcatatctgtgtttatgtggtattcaatggcccacaaatgtctacatcctaattcctaagatctgtaaacattaatttgcatgacaaaagagactttacagatgtgattaaatgaaaggattttgacatgcagataatatcctgtattcttcatgtggaaccaatgtatttacaagggt

SEQ ID NO: 883 - DNA, 300 bp, Homo sapiens
cttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggt

SEQ ID NO: 884 - DNA, 285 bp, Homo sapiens
  misc_feature 7, 13, 14, 17, 20, 23, 24, 28, 34, 36, 42, 47, 52, 57, 59,60, 63, 65, 69, 78, 80, 82, 84, 90: n = A,T,C or G
aatttcnctttcnnagnttncgnncggncttaangntttttngggcnaaagnccccntnnggngnctantttgtgatncngngngaaaanatttttctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaagaataa

SEQ ID NO: 885 - DNA, 300 bp, Homo sapiens
gtttcatttaagaagaatgagctagataaatgtgctcttctggttaccccaccctgacagagtgcatttttacacggctagcaggggttgagactgcagcctggcctgccagccattggaggtgtttaaggaagggcagataatgtgactctttgcggggtgccatctgcttacccattagcgagcagagggggtttctgcgggtgacccccagcatatttctaggttacttatgggcagatttgtaagtgacaaaactccagctgatgctgggaatggggagagggcccttgagggact

SEQ ID NO: 886 - DNA, 300 bp, Homo sapiens
  misc_feature 140, 141, 142, 143, 144, 145, 146, 147, 148, 149, 150, 151,152, 162, 179, 190, 197, 202, 207, 228, 234, 238, 240, 253,257, 280, 283, 290, 294: n = A,T,C or G
cgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaannnnnnnnnnnnnatcctttggncgggttctcccaaattnttttgaggggnccatggncaacngcttnagctttgttttggcaaccccntgcccnaagncncatataggctgtncttnaccttgtttccaaggctgaggancanaaagtancctntgtttt

SEQ ID NO: 887 - DNA, 300 bp, Homo sapiens
ccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatctataaaaatccatgctttacacctggacagtacacagggacttcagagattgcacgttggaatacattctcccaagactgaggttgttcggttttaattcctgtagtccaatcacacaatttcttatggaaaacct

SEQ ID NO: 888 - DNA, 300 bp, Homo sapiens
caaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgctctcctgccctgcaactcaattgggcctttttcggtgacctcatccaaggcca

SEQ ID NO: 889 - DNA, 300 bp, Homo sapiens
cttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcact

SEQ ID NO: 890 - DNA, 300 bp, Homo sapiens
ggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgtttttatccagtcaaggatttgcttttccttgaacat

SEQ ID NO: 891 - DNA, 300 bp, Homo sapiens; identical to SEQ ID NO: 15

SEQ ID NO: 892 - DNA, 300 bp, Homo sapiens
gatgtcactagacaactggcagtttaatgctcacacccctgaactagaagaggttccacaggatccctggccaatgccagggatctttaggtcagcagtcatgtcaagatgctctgattctccacaaacccagcttctttcccaaactgcagggaggtcggtctgcagtgacttacctagtattttgttgtatccctggctcacagtgtctccccggtctaggatcttcgaatcgaaatcccatgaagcacatattgcagtgctctctgactctcacccctgaaatagagctggtgggat

SEQ ID NO: 893 - DNA, 297 bp, Homo sapiens
  misc_feature 8, 9, 51: n = A,T,C or G
ctgtttcnntcctaatggatagttagctgatttctgttgtttttctctganaaccaatgttgcaatgtgtctttagtctggatagctattgttaaactgcctacaaagtgagcagatctattaatatcagtttacacttgggcctttggggtttgagaggacctttttctctgcaaccatctgtgggctgatttttgcattttacttgtgataacaagggagggtaactgccccctttccatcatcccccaaaagggaaaaaatgagcactagcataaaagttctttggagaaatat

SEQ ID NO: 894 - DNA, 300 bp, Homo sapiens
ttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggtggagtagttgtgggctggacaaatcaatcgtgggaaattgttaggagttttat

SEQ ID NO: 895 - DNA, 288 bp, Homo sapiens
  misc_feature 7, 18, 19, 20, 29, 34, 38, 40, 42, 44, 45, 51, 61, 63, 73,79, 92, 94, 96, 115, 145, 153: n = A,T,C or G
agttctnttaacaggatnnnatcgattcnaattnggcntnangnntggccnccctggggtncncaccagaagntcgganaaaggcccaaggngnangccacgcccagcagtggtnattgccccccactccttttttgagtctatnagcattgnttggttttagctgtcatcagaagctgtgagggacccacagattttggaaacgacctggacacactattgggaaggagatgtggacggcctgtctcctcctgcagggcccaccctaagaatgtatttttaaacaca

SEQ ID NO: 896 - DNA, 300 bp, Homo sapiens
agaaaggataatggagtttctgtacaagatttaccagaaagagagtggtgtgtagacatgcctggagcagacaccttggagccgctgacagaaggtgaagcagtccaagaaaatgtggaaacttttccgctgctctacacagtccacaaacctgtccattttatttcgttgaagctttgtctgagagataaccaaatagacagtcaaagtaagttatctcagccacatatggggagtggatgctgctgaattgtgattaattgggggagccatataggtacatttggcatgatctgggcc

SEQ ID NO: 897 - DNA, 298 bp, Homo sapiens
  misc_feature 239, 240, 241, 242, 243, 244, 245, 246, 247, 248, 249, 250,251, 252, 253, 254, 255, 256, 257, 258, 263, 271: n = A,T,C or G
gctactcttacgcactcacgttcattaactgcgttctgatggcagaaggtagacagcaactggacaagggtgaatttacggagaagtacgtggtcccgcggacaaggctggcatccaagttcatcacactctaccgggcgatacgggagcatggcttctacgtcactgactgtccccagcagcaggcacaaccccctgagggcggcggtttgtgctgagagctatgtaagcgcagcctnnnnnnnnnnnnnnnnnnnngttgntacctttnatcataactatggatatctaaatgcat

SEQ ID NO: 898 - DNA, 268 bp, Homo sapiens
  misc_feature 94, 126, 142, 145, 146, 147, 149, 151, 160, 166, 169, 172,184, 191, 197, 202, 209, 214, 217, 218, 220, 222, 224, 226,227, 231, 233, 234, 235, 238, 241, 243, 244, 245, 248, 251,254, 262, 264, 266, 267: n = A,T,C or G
agtccctgagaggtggtgggaatggctgcttcattcctcgaggatgcccgggccccacctgggcttgtctttctgtttagagggaagtgtaacntatctgccatgaggaacataaattcatgtaangccattttctcttatncannncntntctttctangtacantcnttntctaggatttgngaagctncttgcncttgnaacaggnctcangtnngngnancnntttngnnnttnccncnnntcntgntgnttttttcntntnnt

SEQ ID NO: 899 - DNA, 278 bp, Homo sapiens
  misc_feature 203, 206, 210, 211, 215, 216, 219, 221, 223, 224, 225, 226,229, 230, 233, 237, 241, 242, 247, 249, 251, 254, 259, 260,261, 267, 268: n = A,T,C or G
aatgtgaaatccacattgtttccacaggcaccatcagtaatgtcgaacaaatggagaaagttgcaggtggggctaggaaagctgtattcctgtggattactctagctggtcatttgccccgattgtgaactgcttgaaagaaaaacgaaacttctaagatgtttgtcctttcatgtcctttctgttgggatttcttatttggngcncttnnctgnntancntnnnnctnnttnattngggnntcctntnanctnttgtnnncatcgnntaagttagtt

SEQ ID NO: 900 - DNA, 254 bp, Homo sapiens
  misc_feature 152, 153, 154, 155, 156, 157, 158, 159, 160, 161, 162, 163,164, 166, 170, 172, 178, 181, 182, 183, 185, 188, 191, 192,195, 196, 197, 201, 206, 208, 210, 212, 213, 216, 219, 221,223, 225, 226, 227, 228, 231, 233, 236, 242, 248, 249: n = A,T,C or G
ggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagnnnnnnnnnnnnntntacncncaggcnttnnntnttnatnnccnnngtcnccttncnantnnatnttnantncnnnnttngnagntatctngtcgtnntcctt

SEQ ID NO: 901 - DNA, 300 bp, Homo sapiens
  misc_feature 171, 172, 173, 174, 175, 176, 177, 180, 183, 184, 187, 188,193, 198, 212, 215, 220, 227, 230, 251, 256, 257, 258, 267,269, 271, 273, 286, 289, 290, 292: n = A,T,C or G
gagacatcatgtcaacagaaatggagatgtgcactggggaaactgccggccgggccgctggcccgtggacgcctgggaggtggccaaggccttcatgccccgaggactagcagacaaacaaggacctgaggaatgtgatgcagttgctcttttaagtctcatcaacttctnnnnnnnctntgnngcnnatgtntacantgccaccaacgtgnttntgtgnactcgcncantcatggactatctctatgatnatgannnttctaggancntngnggataatactacnttnnantccttctg

SEQ ID NO: 902 - DNA, 300 bp, Homo sapiens
acaaggtgctggcagtgaagtgggggcagactgagcctgtgtagtgaagtgtcttgaggaacgtcagctgtatcttttaggaaaccaaaactgcatagacattgaacccaggcagaaggtcatgaagtcagagctaagaaatgctagtggggatagggggtgagatagagttgggaaatgtttcagagctacaggtgacagttgttggtgtccagttggatatgtaccatgaagggaagaagcagtcagagtgggcaccaagctttctagcctggaggactgaatggttctgtgcacatt

SEQ ID NO: 903 - DNA, 300 bp, Homo sapiens
ctctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagt

SEQ ID NO: 904 - DNA, 300 bp, Homo sapiens
aacgtgctgtacaccagcctgcccgtgctcctcatggggctgctcgaccaggtaggagcctcgcacaagcagggacacttctggacagatgagaatgcgttagagaagtcccaagcaaacgtttcaatgcattcttctggtgtttacttctttctgatcaaaccctattataattctgttgtcaggcatcaagggtcatggctgtgcttcttgttttgtaataaggaaagaggatttctctgtagtcccagctactcgggaggctgatgcaggagtatgacttgagcccaggtgttcaag

SEQ ID NO: 905 - DNA, 300 bp, Homo sapiens
ctgttcctaaccctttcaactggggggtctcaagtgggtgaggactccatggccacggcagcagaactgtctcttctgaaaaccagactccggggcccctgggtcagcacctctaggtcattccacagacttacacagtttaaagaaagagccagcgaacatggggtgatcctggggtgccactgggatcccaagccaggcccggaggtctgcctgtttcgtccccagaaacttgagctggcatcctccgttggtttgcactgggcacggggactggagagccaccaggccactgagcgc

SEQ ID NO: 906 - DNA, 300 bp, Homo sapiens
cctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagc

SEQ ID NO: 907 - DNA, 300 bp, Homo sapiens
  misc_feature 272, 278: n = A,T,C or G
ccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgcctgagcagnacggangtctttacgtgaacccacttga

SEQ ID NO: 908 - DNA, 300 bp, Homo sapiens
gagttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcaccgtgagaagcagaaagagctggtaaataaagccttgggcaagcgacttcttagatcagaa

SEQ ID NO: 909 - DNA, 299 bp, Homo sapiens
  misc_feature 163, 164, 165, 166, 167, 168, 169, 170, 171, 180, 186, 188,193, 209, 210, 211, 213, 216, 221, 229, 236, 242, 250, 252,258, 261, 279, 284: n = A,T,C or G
cacctgaccttggcctgcacccccggcagctcccccacacttttgcgctggttccacgactgcctgggcttttgccacttgccgctgagcccaggtgaagatcccgagctgggccttgaaatgacagcagggtttgggcttgggggaatgagaggttacagcnnnnnnnnnggccatgangggcananattgnatcccacatatttgannngngcngagancccttttnggggggngtaaangtacaacnangaagcnctnttaggactaaggtttaanaaagntgctttttacccatt

SEQ ID NO: 910 - DNA, 300 bp, Homo sapiens
atttgtaccaactgtaccatctgcttgccactgctccaaacttttacccacttgcttttggtaaagaggtcacctgcgtatttaaaatatccttttgtaatgtattgggaaggtgcgagaacatatgaaaatggttgtcaatggagatggaaggggctttattctcacttaagagagccctgggaggaataaggttttatctggatcaggtatccaattgcattggataaacgtggcctgaggcaggataaaatttaaaaacacaataataagcctcctggtgacatctctgttcctttt

SEQ ID NO: 911 - DNA, 297 bp, Homo sapiens
  misc_feature 111, 112, 113, 114, 115, 116, 117, 118, 129, 144, 152, 167,168, 170, 171, 179, 182, 199, 232: n = A,T,C or G
tgtatcgggtcctgttccagccggcatcgccgggtggcttccaggcctcagagctgtgtggcagggccccctgctggggctggacatcactgcagtccagtgcaaagccgnnnnnnnnacccaggtgtnccccccaactaaacnaaactggnggcttggaagccccnncnnatgggaangtncaaaaaaaggtcttggntttctcttctaatgcctttcttaactcctgaantcgtttgctcctaaatcttggtaattctttttctctggattttggtttcttttggctttcccttg

SEQ ID NO: 912 - DNA, 300 bp, Homo sapiens
ccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaacccactt

SEQ ID NO: 913 - DNA, 300 bp, Homo sapiens
ccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcacaagttcacaagatgttccttgaccatactggctctcacctgctgattgccctgagcagcacggaggtcctctacgtgaacccactt

SEQ ID NO: 914 - DNA, 300 bp, Homo sapiens; identical to SEQ ID NO: 30
  misc_feature 201, 202, 203, 204, 205, 206, 207, 208, 209, 210, 211, 212,232: n = A,T,C or G

SEQ ID NO: 915 - DNA, 300 bp, Homo sapiens
tcaggccgctgggtgacggtgtgctggccagatagttcctggggctgcaggtggcttctttcgccccatccctcccatcccctttcattcttcctgtcaacacatctcagaccctggacaccgaatgagccgtcggtacccacaccccagggcaattcagtggaggggtaggtggctcgttcccccacgttgccccaggaagaggaccctgtccccggcatcctgacccacctcccttagagaccgagagcctctaaggataaacccattcacccgtgtttcagaggcttttttttcctc

SEQ ID NO: 916 - DNA, 300 bp, Homo sapiens
gttcagggttggtgggtctgtggaccttgagctagtttttaatcaacatggaaactccagtgatctatttaaaaacttgcattgggtcatgccaggtttattggaggttataccctccaatgtatttccaactcagggttaaagccaaggtccttatggtggaagatggggcatataaactggcattctggcgctcacacactccaatatctactactctcccctcttgctcgctcagctgtggcttgcttattcagctttttgctcttcctggaatacatcaaacatatgtaggcccag

SEQ ID NO: 917 - DNA, 300 bp, Homo sapiens
ctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagagga

SEQ ID NO: 918 - DNA, 300 bp, Homo sapiens
  misc_feature 265, 276, 285: n = A,T,C or G
gggattaacaatgctgaaggactcttagtagtagtgactgtcatctgtgcccctctaactttcctgagcctcacacacaacctgtgggcaggatggagtagatcatgttgctgactgctgccgtaggcaagtaaatggagccagaaagtcccactgttgacagggtgccacagctgaccagggactgtcattctctccacccacaggctgtggagggtgaccacagcatgtgcccacctccaccaatccgcaacgagcagccggnactggtgctgnggcagaggntgccgtcattgccca

SEQ ID NO: 919 - DNA, 300 bp, Homo sapiens
tgggggctctgaagtttcaccaggtggacgctggggagcgggctcccgagcacttgtctacctcccgccagtcctgacaacttttctggccaacctacccagcttcgcttggctggcgagcgcatctgctgctggggttcgcggtgcagatggagacgcagtggtggccagagggtgatggagaagacgggaaaagcgacagccacgctcctggctgaagccgcaggacgcaaataacttactttgtacctgacagtttctcacgttgttgtggaggccctgtttcctggaaataaactc

SEQ ID NO: 920 - DNA, 300 bp, Homo sapiens
gcagggcagggctaaagttggaaatggaaatgaaggagcaggtagccatgcagccttgtgctttccagcaacagggtggacacttggtcccaagaggacgcagctgaaagaccctctggcagggagaacgtgtgaggactctgtggtggattctgagttgtgcctctctggcttaatctcatctgattctagcagtaactccaagaggtaagcacatttgtgagtcctgttttccaatggaaaagctacatgaggcccaccaggtcccagaactcaacaatggtggggctggggttcaaa

SEQ ID NO: 921 - DNA, 296 bp, Homo sapiens
  misc_feature 248, 263, 266, 267, 270, 271, 275, 279, 281, 284, 287, 289: n = A,T,C or G
aaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagntctccagtgcccgcntanntgnntacnttgntngtngtngntgatttt

SEQ ID NO: 922 - DNA, 300 bp, Homo sapiens
tgaaaaaaatcacagctcctgcagcaagtctatgcctgggtaacaaccaacccacaaaatccaagaggaggtccccctctcccgcctctgtgaggcttgaggagcagtatgtatctgggccagcctggtcctcagagtgtggaattaacacctttcctctagcaactgtttgtgctgctgagaacagcacagactctctggcagcctggttctctccagagggaagcctgtgaagcagaagaaacatatggcatctgcactcagggcgcccagttccatccggccttgctataaaatgac

SEQ ID NO: 923 - DNA, 300 bp, Homo sapiens
  misc_feature 160: n = A,T,C or G
caaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagancccttccttagcttcggagactccagacaatcgccttttgcctcctcgtcggagcacgccccatattagtggtccgggcccgggcaggcccagctcaaaagagggcagacgcagcgacacttgttcttacacacccccat

SEQ ID NO: 924 - DNA, 300 bp, Homo sapiens
ctcccagcctcctcctccaacgcccttttgatccaagattgagtaagagacattggcagatgctgagaaggacaacccaattgttttaacttgcagaccgagggggagatgggttccagtctgcacatgactcgtgcacagtccccccaccccaccctgacttagaaaattccaaaccgactacaagaccagaaacaaaccacatgccagtcgcccccttgtctgtacacacatgtggagttcagagccacccttggagagaggctgctcaggctcagctccctgtgctgggctttctag

SEQ ID NO: 925 - DNA, 300 bp, Homo sapiens
acatagcccccacccctgagggatgagacagctccctgcaggcaggctgtgcccagtcatctcaagcctacagctgggctgctggctgcagggtctggagggcggtggggagggtggcagacagagtagcaagacccccacttccctggccttcttcacagacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtg

SEQ ID NO: 926 - DNA, 300 bp, Homo sapiens
ggaagaggatgactgggtatgctgtgccacccttgagggccatgaatccactgtgtggagcttgggctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtt

SEQ ID NO: 927 - DNA, 300 bp, Homo sapiens
  misc_feature 117, 118, 119, 120, 121, 122, 123, 124, 125, 126, 127, 128,129, 130, 131, 132, 146, 149, 166, 180: n = A,T,C or G
cagagctgtatcttcagtggtgtgatgaagctacagtaggggagatcactcatgctaggtatggatctccttacccttggcctctgaatcatattttggcctatcaaaaacagtggnnnnnnnnnnnnnnnngtaaaaaaattttnggnggggggagaaaaaatcnggacccggtgttanaggatgtagaccagtgctgtcaagctctctctcaaagactgggaacacaaccgtatttcttcaataagcagcctactgaacttgacgcactggtatttggccatctatacaccattctta

SEQ ID NO: 928 - DNA, 300 bp, Homo sapiens
gtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaagg

SEQ ID NO: 929 - DNA, 300 bp, Homo sapiens
  misc_feature 24: n = A,T,C or G
tggtgcccatattgatgtggatanacagaaagataagaatggcgagagaatgatcacaataaggggtggcccagaatcaccaagatatgcagttcaactaatcaatgcactcattcaagatcctgctaaggaactggaagacttgattcctaaaaatcatatcagaacacctgccagcaccaaatcaattcatgctaacttctcatctggagtaggtaccccagcagcttccagtaaaaatgcatttcctttgggtgctccaactcttgtaacttcacaggcaacaacgttatttacgtc

SEQ ID NO: 930 - DNA, 300 bp, Homo sapiens
  misc_feature 15, 24, 43, 45, 47, 63, 64, 73, 77, 78, 86, 89, 90, 94, 96,98, 100, 101, 103, 109, 119, 124, 126, 129, 135, 136, 139,146, 149, 152, 153, 164, 167, 168, 170, 175, 183, 184, 194,203, 209, 223, 232, 239, 241, 257, 286: n = A,T,C or G
gaattccattaccanatgctactngctctttgttgctttatcncnangccatcgattcgaatnnaggacgagncgannggtatcgncanngatngntntnntncgctcntgacccatangcttngnatngggatnnagngacagtntcntgnnaaacatctatnacnntnatganggctatcnntttaatgatnttgagaatnatgacnggcttgatgactanaacaatgcngaagatnancgccactgatggtggnacatacttccctcttttactactcgcctnacaatcacaatctg

SEQ ID NO: 931 - DNA, 300 bp, Homo sapiens
gtgcgctgtccaggaatgacgtgctgaagcaggaggtgccagagggctttccctttgcccatgtcctttgggcaggatgtggatgcagctgtcggggcagctctggtcatgctccggagacacctcaaccagaaggaatcttagacagcaaactctttcgccaaacgactgctgtgaattttacctgattaacattcctgacaccatctgtgggtcatcctttccctggaccgttcagtggacagctttcaagcagtgcttgttgtgaggtcccatcttggccaagaacttaccttcaga

SEQ ID NO: 932 - DNA, 300 bp, Homo sapiens
ccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcct

SEQ ID NO: 933 - DNA, 300 bp, Homo sapiens
agaaatcggaacaaaagtagaagttgtggaaaggaaagaacatttgcatactgacattttaaaacgtggctctgaaatggacaacaactgctcaccaaccaggaaagacttcactgaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgc

SEQ ID NO: 934 - DNA, 300 bp, Homo sapiens
ttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttga

SEQ ID NO: 935 - DNA, 267 bp, Homo sapiens
  misc_feature 221, 222, 223, 224, 225, 229, 230, 236, 238, 240, 242, 246,250, 251, 252, 253, 255, 257, 260, 261, 262, 263, 264, 266: n = A,T,C or G
ataggaaagggaagcccatttcccaggtcaaagcctttgcttactcgtttatgtttattttatttttgagacagagtctagctttgttgcccaggctggagttgcaggtgcaatctcggctcattgcaacctccgccttttggattcgtgcagttctcctgcctcagcctccaagtggtggggatcgcaggcacacgccaccatgcctggctaatttttgnnnnnttannggctgncncngngaancctnnnntntnctnnnnntnc

SEQ ID NO: 936 - DNA, 300 bp, Homo sapiens
aaaaattgtgatgtaagtggtacagtggggagaatttagggctctcagaatgcagaaaactagccacctccagttctgtgcctgaccaccatctgactttggataaatcccttctgctctcccacctagctttatcatttgtaaaatgagtctctaggtacagccctttctgggttgagacagagtttctgaggagtaaaagccatgtcattgtggaaacaggcagctattctcacagctggcatgagcccactactcccctataatcagtgctgataaactgctctcatttgttggact

SEQ ID NO: 937 - DNA, 277 bp, Homo sapiens
  misc_feature 94, 95, 96, 97, 98, 99, 100, 142, 167, 192, 193, 201, 202,210, 234, 241, 242, 247, 251, 255, 260, 266, 268, 271, 274,275, 276: n = A,T,C or G
agtgtatccagatctaagtaatctcagtgaactatacattgcctaaaaagtggttttgtaatgatttgtagtcacatttctattgggatatgtnnnnnnnaaggcgaaatgcttaaagttccttttattttttaaaagcagntagatagacacagacttgccacctnatacatctgctccttggcaacatcnnggggaacnnactagccnacatgcctatggctaaaaactttnctttgcnnactancgcnctgnttggngcttcngnttntannnt

SEQ ID NO: 938 - DNA, 300 bp, Homo sapiens
  misc_feature 12, 203: n = A,T,C or G
attcggcacgancccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaagctggtggacagatctgctctgtggaggggcgggcaccagntccacttatgtgcctgtgctccgagggccaatgggctgcagggcctgcttggaggaaggatttgtgtgtaggaggcctctccgagggcaattctgtt

SEQ ID NO: 939 - DNA, 300 bp, Homo sapiens
aaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctgg

SEQ ID NO: 940 - DNA, 283 bp, Homo sapiens
  misc_feature 39, 40, 41, 42, 43, 44, 45, 46, 47, 48, 49, 54, 56, 57, 59,63, 76, 77, 78, 81, 84, 87, 92, 93, 94, 96, 99, 101, 106,107, 109, 114, 118, 119, 123, 126, 131, 132, 140, 142, 146,151, 153, 155, 160, 164, 166, 172, 174, 175, 186, 188: n = A,T,C or G
  misc_feature 199, 200, 205, 208, 210, 211, 213, 217, 227, 230, 231, 233,237, 245, 250, 252, 256, 257, 258, 261, 263, 268, 271, 273: n = A,T,C or G
gtaacctgacacccagggagggagggagggaggggctgnnnnnnnnnnncctgnanngngggnctcacctgttctnnnttnttnttnttttnnntntangntcacnntngttancatnntttntancttgnntttatttntntttnttttntnanctttntttntnttgttntnnttctttttttncntttatttttgnnttctnccntnntntttntggtttttanttnntntttntttttttnttttntntttnnnttngnttctnttntntgtcttcttt

SEQ ID NO: 941 - DNA, 277 bp, Homo sapiens
  misc_feature 237, 238, 239, 240, 241, 242, 243, 244, 246, 247, 276: n = A,T,C or G
gtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgnnnnnnnngnncgggacatttgccctcagtggtgtggttnc

SEQ ID NO: 942 - DNA, 300 bp, Homo sapiens
aagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggagtccccttaggctcgaatgcccgagaagaga

SEQ ID NO: 943 - DNA, 300 bp, Homo sapiens
gctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaa

SEQ ID NO: 944 - DNA, 300 bp, Homo sapiens
aagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttctgtataaaatgcaa

SEQ ID NO: 945 - DNA, 300 bp, Homo sapiens
atgttgcccaggctggtctcaaactcttgacctcaagcaatactcctgccttggcctcccaaagtgctgggataataggcatgagccatcatgcctggccgaacttatttttaaattctttgggaatctaaaaggactatgtgctttcttttttactggattatgtgagaagataatagtttgcagagaaattcagtgaagcagctgataaaatgctttaaaaatatatttcagagaattgagcaataacagtgatgtcaaaatagtagccccaccttctccagcccacctaaaccaaca

SEQ ID NO: 946 - DNA, 300 bp, Homo sapiens
gatgcaagggctgaagctgaaacttcagagagcatcggcatttaaggaagaaccttggctgggcgtggtggctcacgcctgtaatcccagcactttgggaggctgaggcgggcggattgcttgagcccaggagtttgagaccagctggccaacgtggtgaaaccccgtctctactaaaaatacataaattagctgggcggtagtggcatgtgcctgtaatcccagctactcgggaggctgagagaggagaatcacttgattctcctgggaggcagaggttgtggtagctgagatcgtgcc

SEQ ID NO: 947 - DNA, 300 bp, Homo sapiens
attttagtggttttacagtcatttttcatttaatatttacagaagtcctatgaaataatgactgtgattagatactgttattattaaggaaactgagccttagagaggttaggtaacttgtctaaggtagagctatgatacaaacccgggtctcattggttgggcatttgtgtcagtcactgagtataaggtaactgggacaaggagctcaagcagctcgtcgtttagtatcagagacagagagctcaggccatggccccactatgaacaaagtggtcttaggacacagaaaaagagtga

SEQ ID NO: 948 - DNA, 300 bp, Homo sapiens
gcctgtagtcccagctgctcgggaggctgaggcaggagaattgcttgggcccgggaggcggtggttgcagtgagccgaggttgcgccactgcactccagcctgagcaacagagcgagactctgtctcaaacaaaaaccaaaagacatcaggaaacatgcctcttatggaatttgagggggaaaagtcagggtcttggcagtgaccttggacaagccattagcctcttgatacctcttttctcatctgtaaaatgaaggtggtagttacctacttcacagggttattaggggattcaatgt

SEQ ID NO: 949 - DNA, 300 bp, Homo sapiens
cagaggctttgctagtatccttcaaccaatttctagtaaaaatatcctatataaccataattatcaaaaccagaaaaacaacattggtaggatactataaagtactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctat

SEQ ID NO: 950 - DNA, 287 bp, Homo sapiens
  misc_feature 155, 156, 157, 158, 159, 160, 161, 162, 163, 164, 165, 166,167, 168, 169, 179, 183, 192, 193, 195, 207, 210, 212, 214,218, 221, 223, 233, 235, 238, 240, 241, 245, 246, 248, 251,255, 260, 270, 273, 275, 276: n = A,T,C or G
acctgagctagggttgcagcagaaattgagttgcagcttgcccttgtccagacctattttctgcttgcgtttttgaaacaggaggtgcacgtaccacccaattatctatggcagcatgcatgtataggccgaactattatcagctctgatgtttnnnnnnnnnnnnnnnataatgcganagangccatcacnntnctattgtgtctnaantntngccntgngntattccatgncntcntnntatnnanctntacnaatangttttacgtnatncnnttcgatttttg

SEQ ID NO: 951 - DNA, 300 bp, Homo sapiens
ccctggatgaaaacctaggcagtaccattcaggacataggcatgggcaaatacttcatgactaaaacaccaaaagcaatgtcaacaaaagccaaaattgacaaatgggatctaactaaactaaagaacttgtgtgcagttttatttgggagtgtgtgtggggtacctctgagtttcaaaaatgaagaaagtaagtagtcatgctttcctgactctttggtagacatagcctttaagacagtcattctgagctgttatggtcttagggttccctatactactaaaacttattgatgacatg

SEQ ID NO: 952 - DNA, 285 bp, Homo sapiens
  misc_feature 7, 21, 28, 58, 60: n = A,T,C or G
atgcccntagtacgcaacaantccttcntgctccaagagtaggaaaattactgttctntntgccagtgagattcctcttctggtattacctttgcttcaaagtccctgaattgcccattccccacttcatagcacttattgctatctggaattacactaaatgtcaccttcatgatggtaggcaatttattgccttagtcacagttatgtctagagaacaagcagctggctcatagtaggcactcaacaaatatttgttcaatgaatgaatttataaatgaatgc

SEQ ID NO: 953 - DNA, 300 bp, Homo sapiens
aattgtaacttattccaggataaatgtcatatgcatatgattttcatatgactttgatgagtatcttcagggaaaattcctaaaaatgaaattgctggattaaggggtaaatgcatgtatagttttgttagacagggccacatacccttccttagaggtagtacccttttgtattcctgccagtaatatatgagagtccacagagtatgtggttaagctttagaatgcttgtccatctgatagggaagaaatcgtgttgccttaatttgcccttcttttattatgaatcagattttaatc

SEQ ID NO: 954 - DNA, 300 bp, Homo sapiens
cagccaatagccatgtaactgagcttggaagaggatcttgctgtcctggccaacatctcactgcaattctatcagttgaattccctggatagtccaagctttgtggatccctccaccagaacaactggatcccagtacctgaatcctgaatcttagactcttatacttcaaacactgatcacgggaacagccggctcagcagctcctgagttcctaatgctcagaacatggatgagatgataaatgtttgttgtgttaagctgccaacctttggcgggggggtattcgtcacaggcaaca

SEQ ID NO: 955 - DNA, 300 bp, Homo sapiens
aagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaa

SEQ ID NO: 956 - DNA, 300 bp, Homo sapiens
ggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgagtgattaatgcattctaaacatcctaccccactttataaacggacgtggggaacgcttggtcatttaagccaacaataaatttatgggaatgtccctaagtgtttactgtctttatccagtcaaggatttgcttttccttgaacat

SEQ ID NO: 957 - DNA, 300 bp, Homo sapiens
gacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccac

SEQ ID NO: 958 - DNA, 291 bp, Homo sapiens
  misc_feature 7, 8, 15, 16, 17, 22, 24, 25, 26, 27, 35, 40, 41, 43, 50,52, 54, 56, 62, 63, 71, 72, 73, 80, 81, 82, 83, 84, 89,90, 91, 106, 107, 108, 112, 115, 116, 119, 120, 123, 126,136, 139, 146, 153, 198: n = A,T,C or G
ggggggnnaaaaaannnatttnannnntttttttncaaannanagggggntntngntttttnnattaaaannnccggggnnnnnccatnnngttttttttaaaaannntggnaannctnnggngtnggggcccctnaantgttttnaaagacncccccttccaaattttgaaaacattgtaattggagaagaaggtanctctgcaaggttaatctgtcattctcaatttgccttattgtcttgtttattaagatgttggaaaagcaggaggtagctgtgcctcaattattg

SEQ ID NO: 959 - DNA, 300 bp, Homo sapiens
aaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcgggaaaaaaggca

SEQ ID NO: 960 - DNA, 300 bp, Homo sapiens
aacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcggtgaaataaaggc

SEQ ID NO: 961 - DNA, 298 bp, Homo sapiens
  misc_feature 270, 272, 273, 274, 275, 276, 277, 278, 279, 280, 281, 286,289: n = A,T,C or G
caaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattggtngnnnnnnnnnnggtanatncatgtgaac

SEQ ID NO: 962 - DNA, 300 bp, Homo sapiens
cccgctgagtggcagtggcaggaagtcggtggaagcagatccctgtgcagaagttgaattaccagggcggccacacacgggctgcacaacctttgcagtcgtgcacggcaagtgggatgtggcctccgcccatgattgggcacctggtcaggctgggagatccaaatagcacccagtgggcagctgtccgacccctggaggggcaagccaggaaagaaacttagggcccgctgtgaccagatgtccctcccagttgggaagactaaactggtttggccaatatctcccaggattcccctg

SEQ ID NO: 963 - DNA, 300 bp, Homo sapiens
  misc_feature 237: n = A,T,C or G
gaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagacnaaagaaccttaattttttctcttggactgcaataaagtatagctgcctaaaatacgtttcctg

SEQ ID NO: 964 - DNA, 300 bp, Homo sapiens
atttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaa

SEQ ID NO: 965 - DNA, 300 bp, Homo sapiens
ggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgt

SEQ ID NO: 966 - DNA, 300 bp, Homo sapiens
  misc_feature 200, 201, 202, 203, 204, 205, 206, 207: n = A,T,C or G
ctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgnnnnnnnntgattgtagcacactttggccaccaactcctgggctcaagtgatcctcctgctttggcctcctctgagaagctgggattactggggcacacca

SEQ ID NO: 967 - DNA, 300 bp, Homo sapiens
cacctttcctccagtttccaataacacattcctcttttccacctgagacctcaccagaatcacctttaatgtctatattcctaccaatagtctttttaaggcaatataggctttctctaacatgcacttcaaacttcaagatggaggggatgccatacaacaggactatgtgatggtttttggctgtgtccataggaagtcacaacaggcaagggaaagaaaccagaacccagtcatggagttaagaagtgagtcagagagtagatgggtagggacagtgaggtaaggcctctttctaag

SEQ ID NO: 968 - DNA, 300 bp, Homo sapiens
ggaactatgcccctcccactcccatcattgccaattaagtctttttcccttaaaaatcagctaaacatctttccccttgatcccttagttatgtactctcattcttcgtgtactccatgtgattcaatagcacagatacttcagtagcacttaccataattgccatgaaataattgtgtagtttgcttaatatttgtttctcatattagaatgtaagctccatgagagctaggatcatgtctgatttctttgccattgtattgcagtgcctaaaacaatattttacaaatttaagtaatt

SEQ ID NO: 969 - DNA, 276 bp, Homo sapiens
  misc_feature 130, 131, 132, 133, 134, 135, 136, 137, 138, 150, 152, 163,187, 197, 198, 199, 200, 202, 204, 217, 219, 221, 228, 231,237, 242, 243, 246, 248, 251, 253, 254, 257, 258, 259, 261,267, 269, 270: n = A,T,C or G
accatttctgtacaacacaagctggccttggcagtttcggtgcatagaaaatcaggtcctacagctcgagagggcagagccacagtccctggacggcgtggactgaggccggatccttcctggaggcctnnnnnnnnnggggaccccagnanctcatcatcancattgctggagccaaggagtctgntacccacgtnnnntngnggatgcccgatgncngntttggtnttnttgacntgttnntgntnaantnnttnnngnttctantnntctgat

SEQ ID NO: 970 - DNA, 300 bp, Homo sapiens
cctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcag

SEQ ID NO: 971 - DNA, 300 bp, Homo sapiens
cataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatt

SEQ ID NO: 972 - DNA, 300 bp, Homo sapiens
aggtgcatagagttttgcctataatcccaacactttgggaggctgagatggggagatcgcttaaggccaggagttcgaggccagcctaggcaacatagcaagacccccatctctattaaaacaaacaaacaaacaaaatgttaaataaaggaagcagatgagtatgtgctaactaggctggcatgtgtctttgttggtgacatggagcctctgtcatcccctcacagactgcatacgaggattggttcatcaccctctacaacgtgctgtacaccagcctgcccgtgctcctcatggggc

SEQ ID NO: 973 - DNA, 300 bp, Homo sapiens
gacccaggtagaccagctcaagagttcatgttctttgtcatcctcctgtgagctctctgtaagtctctttcttgcccatcaccacatccctagtactgggtatcagtctggccacttggctttctggtttgccccaatgtggtctattcttgatgcagctaccaaagtaatgttttaaaaccattataccaagttactatccttgtcaaaacccccagtaactgccaatctcacttagaataaaatccggactcctgtgaagcacagcataaactggccactgcctatgcagcaacctca

SEQ ID NO: 974 - DNA, 300 bp, Homo sapiens
  misc_feature 189, 190, 191, 192, 193, 194, 195, 196, 207, 227, 241, 244,269: n = A,T,C or G
gtcgaatgaatcctttgtcgcctttagcttttagtcctttgaagagaggtgagagtggaaatcaagagatttttttccacggggaagttctttttacaaagcgttgatttctcggcaccccgcggggcgggcaactgacacggcctccggtgcaccttctgcgctgtggagcctctggggctcagctgnnnnnnnntcgggtcgtgnggcggtagggcgggagcggnggaagggaaaagcnaangctggaaaagaagcagggcagttgngaaccagacatccagacctcctgaagggctc

SEQ ID NO: 975 - DNA, 300 bp, Homo sapiens; identical to SEQ ID NO: 165

SEQ ID NO: 976 - DNA, 300 bp, Homo sapiens
aaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaagaattgcctgggctcaccttgatcgtaagttgacagtgctggactggcagcaaagtgaccgttggagtttaatgagaggaatatactcatcatcagtctatttagaagagatttcc

SEQ ID NO: 977 - DNA, 294 bp, Homo sapiens
  misc_feature 9, 10, 12, 14, 16, 17, 22, 24, 28, 31, 35, 40, 41, 43, 45,46, 47, 49, 50, 52, 55, 58, 59, 60, 61, 64, 73, 79, 80,81, 83, 84, 85, 86, 87, 89, 92, 94, 96, 97, 98, 100, 101,105, 112, 117, 118, 121, 124, 128, 131, 133, 134, 135, 136: n = A,T,C or G
tagggtaanncngnannaaaangngcantangttnagacnngncnnncnntnacnatnnnngantagaacatntctatnnngnnnnnanatntnannngnnaaanagggttntatgnnagnacnctcntcncnnnnatccattctcatcagcactgtcccaggatcctggagagggagaacccctggccccaggggaaagagggcggggtctcccgtttcctgtgcctgcaccagccctgcccccattgcgtctgcacacccctgcgtgtaactgcattccataccaactaata

SEQ ID NO: 978 - DNA, 300 bp, Homo sapiens
ccaatggatgcaggaaaactgagatgggatttccccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctcaccgcaacctccgcctcccgggttcaagtgattctcctgcctcagcctcccaggtagctg

SEQ ID NO: 979 - DNA, 300 bp, Homo sapiens
agactcttcattctatcaccctgtctcacaaaagacttgcccaaggctacgaagcaaggcagtgactagagtccagacatcagaactagttccatgttttttttttcactaccagtccctaggccccaaaccgcagatcctgctgtgtgaccattaagcccctgactgttctaggctcaacttccaaccctttctgcaggtcctattacctctgcctcatcctcccaacatgataaccagagtcttccttcacattgtactgcctacccccttatgttcccaggctctcccttggtttta

SEQ ID NO: 980 - DNA, 300 bp, Homo sapiens
gtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacact

SEQ ID NO: 981 - DNA, 300 bp, Homo sapiens
gctgcatctgcaatgaggatgccaccctacgctgcgctggctgcgatggggacctcttctgtgcccgctgcttccggtgggtgcaggtggaatgttctgtgcgagagctcaagggctgcctggatccctgacttgtatccctttgttccacagagagggccatgatgcctttgagcttaaagagcaccagacatctgcctactctcctccacgtgcaggccaagagcactgaagacaccctggtcctcccggaagggcagtcccacaggcagcggcacccatttctgggccccgccacag

SEQ ID NO: 982 - DNA, 300 bp, Homo sapiens
gcagggcagagttctaccttctcaaaccccccagccggcacatcacacaccggaggccaggacccaagcccagcagacacaggatctgctaacgcagctggcagctgaggtggctatcgatgaaagctggaaaggaggaggcccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattct

SEQ ID NO: 983 - DNA, 300 bp, Homo sapiens
aaaagatgagtgattttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaaccta

SEQ ID NO: 984 - DNA, 300 bp, Homo sapiens
ctgctccgagtcaggcgcggtaaaaggcattttacatatgttacaaccgtgctctgaggtgggtgttgtcttcttttgcccgaaaaggaaacagagaggttaagaactcccccagagccacatggacagagctgggatcgaaccgaggctccaagtcccagtgttctttccagtacctcatgcatagaccagccttttcctcatcaggcagatcctgcagaactggcacctgggttgcactcagtggcctctctgacgccccgcctgtgtggacctctccaccccctgccttggcagcag

SEQ ID NO: 985 - DNA, 300 bp, Homo sapiens
gccacattctgaggaacatgtcatgttctgggagggctaaggcatcaagtaaggcctgtggggctggaggatcccaggcaaggtggggcaatccagagccatgggggcttcccatgggaattgggaggtcccaaggcagagtcagaggttccacaggaggagtcagagagtcaccaagggctctcctggcccagggagcagtcaacaccatggactgaacacttgctgggctccaacccttgggccaggctgcccatgtggggccaggaggcagctcagagtgggaggcagagagagaag

SEQ ID NO: 986 - DNA, 300 bp, Homo sapiens
ggagtgtgttcctcttgaccctggggctgcatctcctcgttggtgacttcctggggttcagaccctgccacctcctccattttggggagcaagatctcatctgtctctgggacaggaggacctgggttctgcactggtgaggctgagtgtggggagcaggctctgagcccccagctccccgtgtcccctgctccccaggtgtacagtgccaccaacgtggagctggtgacacgcacacgcacggagcacctctctgatcaggacaagtcgaggagcaaagcggggaagactccattccag

SEQ ID NO: 987 - DNA, 300 bp, Homo sapiens
caagcgcccatggagctgcccctggagcaggtgcccccaccgagagtgatggaaaagcccgtcctcgccacctccaggcatggccagcagcgagcggctggctctgcaggagaagtgctgggtctgagctccgtcacggccgctcccgagagcccgaggtccaagcccaacacgacttggaataaatgatcaagttatgaattaaacacaagagaaatgtaattaccacaggagccagctgagaataaaatggattacgcacatcacagtcattaaacggtgatcacatgcgcctttcta

SEQ ID NO: 988 - DNA, 298 bp, Homo sapiens
  misc_feature 277, 278, 279, 280, 281, 282, 283, 291: n = A,T,C or G
gccctgcccaacctgctccagggaccagtggtcttgggaagcttgggctgactgggattgcagactccgggtctggtgtatagggcccttggcaaatccctattcctttctgggcctccttgaagagacagtgggctgagcttctaggctccctttgattcttctgtgtgtggcccagaatgggacagacagactgagctgggcacagaaataccatagtgacagaaccattcgaagaccctgccctgatggaggccccgggccaggggaggaggcnnnnnnnggctgtcnatctgaa

SEQ ID NO: 989 - DNA, 300 bp, Homo sapiens
gcgacacttccgcctgcacgagttcttccggggcggaggtcaccatggcagctgccttggctcggcttggtctgcggcctgtcaaacaggttcgggttcagttctgtcccttcgagaaaaacgtggaatcgacgaggtacgaaggggaagtgggtagaagcgggaagtggtgcgccttccttcagccggggctttaagccctcagcttggcgctcctctgtttttccaccgtaggaccttcctgcagacggtgagcagtgagaaggtccgctccactaatctcaactgctcagtgattgc

SEQ ID NO: 990 - DNA, 300 bp, Homo sapiens
aattgatgagccttattaactatcttttcattatgagacaaaggttctgattatgcctactggttgaaatttttgaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacattt

SEQ ID NO: 991 - DNA, 300 bp, Homo sapiens
tgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctggtgctattgtgtttgctatattagcagcaatgtcaat

SEQ ID NO: 992 - DNA, 300 bp, Homo sapiens
attttgccatgtggcagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaattgatggcaaagtccactcaaaacaaccagttaagtgctcacgagagagtagtcaagcacctccagaaagaaaccgggtttttgttcacatagcaggaagtgactccctgggtggtaatttat

SEQ ID NO: 993 - DNA, 300 bp, Homo sapiens
ttcaccaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaagaaaa

SEQ ID NO: 994 - DNA, 300 bp, Homo sapiens
  misc_feature 108, 109, 110, 111, 112, 113, 114, 115, 116, 117, 118, 119,120, 130, 147, 158, 165, 170, 175, 196, 202, 206, 225, 251,258, 262, 276, 290, 292: n = A,T,C or G
gcaggagaatcacttgaaccctggaggtggcggttgcagtgagcacagatcatgccactgcactccagcctgggcaacaaaacgagacttcgtctcaaaaaaaaaaannnnnnnnnnnnnatcctttggncgggttctcccaaattnttttgaggggnccatggncaacngcttnagctttgttttggcaaccccntgcccnaagncgcatataggctgttcttnaccttgtttccaaggctgaggaacanaaagtancctntgttttgaggaggnggaagttaagtatncnttaatttt

SEQ ID NO: 995 - DNA, 300 bp, Homo sapiens
agaaattaaggcctctgggttcaatttttggccccagtgttgacctctgtgtaagcctggcaggatgtctcatttctgggtcaccttttccttgccaacatagtgaggtatgtagaccaaatcattgctaagagccttctaactcctaagacactaggtttagtcagccaaaagcatgtgattttcccagatttcccaaactccttgtaacctaattgaaagtacacaatgaacttgcaagaatttaagcatccttagatgccagtcttcactttgggtattttccagcctcctcagtga

SEQ ID NO: 996 - DNA, 300 bp, Homo sapiens
gcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgac

SEQ ID NO: 997 - DNA, 293 bp, Homo sapiens
  misc_feature 116, 117, 118, 119, 120, 121, 122, 149, 151, 152, 155, 163,172, 174, 175, 186, 215, 222, 239, 249, 255, 257, 258, 264,271, 279, 280, 282: n = A,T,C or G
gagcttcggaagctgccagtgccacagggacccaaccccgtggtggtggtgctgcagcaggtcttccagcttatccagaaggtgctgagcaaatggttgaatgatgcccaggttgnnnnnnnggtgtgctctatctttgataagtttgntnntanactgctgnatgactttnanntcatggtgcanaaatgtgaaagatgctttgccaaatatgntaaatantgcttggggccttgttntgaattttcntcaatntnnccatanatgatgnatctttanngntcaccctattc

SEQ ID NO: 998 - DNA, 270 bp, Homo sapiens
  misc_feature 145, 146, 147, 148, 149, 150, 151, 152, 153, 154, 155, 156,157, 160, 162, 164, 167, 170, 173, 174, 177, 178, 179, 184,195, 196, 198, 204, 206, 208, 215, 224, 226, 227, 232, 241,246, 249, 254, 261: n = A,T,C or G
tatcagacaatattttattattttttcatagatgttctgccacacaaagaacttggggtgtaaggataaggcaaaagctccaatcccattattcagttctcctaggatgcacccctcagggagcctggccagagttccgaggccnnnnnnnnnnnnntgncncntgntcnacnntgnnnggctncggcgcaggcnngnctgagnantnccatgangctgatagnannctgantctgccggngaacngtnagganagagacnttactcgga

SEQ ID NO: 999 - DNA, 300 bp, Homo sapiens
ctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccct

SEQ ID NO: 1000 - DNA, 300 bp, Homo sapiens
  misc_feature 13: n = A,T,C or G
ttgattaaaaacngcctccttaacctctgaagactgattttgctttatcatgtttcaataataacatttcagaggttactctgtagccccagttgtaagcttataaaaacaaactggaaggctgaggaggttatgggctggcagccaggctatgtttacagctgctggagatggcagtagccttatactttgagcaggtagtacatcccaggctgtgctagaggtagatttgttttttcacgtttgatctgtggctggtggccacctttgttgatttgggcttacgagtttcatagtagc

SEQ ID NO: 1001 - DNA, 300 bp, Homo sapiens
gttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgta

SEQ ID NO: 1002 - DNA, 295 bp, Homo sapiens
  misc_feature 179, 180, 181, 182, 183, 184, 185, 193, 194, 195, 196, 197,198, 211, 214, 217, 224, 227, 228, 233, 234, 244, 247, 250,251, 254, 256, 260, 265, 270, 271, 272, 278, 281, 283: n = A,T,C or G
ggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccccagagcccggtcccttgnnnnnnntaagctgnnnnnncactgggagactntgntantgaaatnctnntcctnngctaatttantcntanncgngnggtntcttncctgnnnccaagncancncatgcatgtttt

SEQ ID NO: 1003 - DNA, 300 bp, Homo sapiens
aagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccaggga

SEQ ID NO: 1004 - DNA, 300 bp, Homo sapiens
tgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggcc

SEQ ID NO: 1005 - DNA, 300 bp, Homo sapiens
cccagctggacctggtggccctttcctagtgcctctgctgggggaggagagcctgtgtgcacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagccccatgcacgtggaggaggagctggctttcagccccagaccccacgctagcactttccacgctgcttgcccgctgatgat

SEQ ID NO: 1006 - DNA, 300 bp, Homo sapiens
gtccttgtccagcctccaagacccacaagtcccttcctctgggaagcccccctggcctggaggtgcaccaggaagaagtggtctggggctggcactaagccatggcccagggaagactgggggacccactaggccaggatgagacctgcacgcagtggctcacagcagcacgatttgtgacagcccgaggcggagaacaccgaacacccagtgaaggtgaggggatcagcacggcgcggccacccacgcacccacgcgctggaatgagactcagccacaaggaggtgcgaagctctgacc

SEQ ID NO: 1007 - DNA, 300 bp, Homo sapiens
ctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcc

SEQ ID NO: 1008 - DNA, 300 bp, Homo sapiens
aggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaaagccaaggccaggttctgggtgtagggcccagagaagcagaacagc

SEQ ID NO: 1009 - DNA, 300 bp, Homo sapiens; identical to SEQ ID NO: 68

SEQ ID NO: 1010 - DNA, 286 bp, Homo sapiens
  misc_feature 188, 189, 190, 191, 192, 193, 194, 195, 196, 197, 198, 199,228, 252, 255, 269, 272: n = A,T,C or G
cttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgnnnnnnnnnnnnaagaggaatacgccaaagaggctcagcanatgcctgcgggctgcaggactggncantgacctggatgctntantctggactgatcct

SEQ ID NO: 1011 - DNA, 300 bp, Homo sapiens
ggattctttcactgagcacaaagagttgttggggctttagcatctgactgatttttttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaa

SEQ ID NO: 1012 - DNA, 300 bp, Homo sapiens
caaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttg

SEQ ID NO: 1013 - DNA, 300 bp, Homo sapiens
gcaagccaggagtgctggcacaggcctgtggtcgcagctactcgggaggctgaggccggaggatcgcttgagcccaggaggtcaaggctacagtgagccgtgatcatgccactgcactccagcctgggtgacagagcgagaccctgtctcttaacaacaaaacccatgagcggcagccccccagtcctggatggtggtaaagaatcctcaagatcaaacccacgcagtgctgagagcttggcctgattctagggctggggctggagaaactgctagagatgatgccgatagccagtgtga

SEQ ID NO: 1014 - DNA, 300 bp, Homo sapiens; identical to SEQ ID NO: 75

SEQ ID NO: 1015 - DNA, 300 bp, Homo sapiens
  misc_feature 26, 31, 39, 54, 68, 73, 85, 99, 116, 122, 129, 136, 141,143, 149, 151, 154, 155, 159, 175, 190, 192, 198, 207, 210,219, 225, 231, 234: n = A,T,C or G
tttgcagccccccctaggtggacccnttaangatttggnttttcccctgggcanccaacctgccccanaggcnccagacctgggntttcagctttgggnccaggctgcccaaaggnactccnttatacncccggcnccttncncgaaananggnncttnccaagcaagcccctangatttgtccctatananggaaangtgtggcangcncatgagttnaaattnttttangcnattcttataatcaaaatctgaagggaaaaaaatgttttagttctttccccactcgttgggttcaac

SEQ ID NO: 1016 - DNA, 300 bp, Homo sapiens
cctagtcccagagtcctggagcggcatactgggggtggctgtgcagtcccagcatccccaacccagcatgtatagagagcatccatccttacatccagctgacccatgcccatgctcctccctgtggctggaggttcaacaataacataagtctcttctttgccctccagatatttctccctcgagtggctgggaaacttggcaagagaccagaggacccaaatgcagacccttcaagtgaggccaaggcaatggctgtgccctatcttctgagaagaaagttcagtaattccctgaaaa

SEQ ID NO: 1017 - DNA, 300 bp, Homo sapiens
cgtgctaatggaaaaattgttagtaaaaataggttcatgcagtcttattgatcatgcttgtaattctgaagattccacttgtactttttgtaaccatatttctcttctcttccattctctagttgtgagaaaacccagttgtccaataattgtcaagctttcctcggccttagggaatgagcactcaagacctttctgggccaagtgtggtcgccgactcctgtaatcctagcactttgggaggccgaggagggagagctgcttgagcctaggagttcaagactagcctgagcaacagca

SEQ ID NO: 1018 - DNA, 300 bp, Homo sapiens
ggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaatt

SEQ ID NO: 1019 - DNA, 300 bp, Homo sapiens
ctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctcc

SEQ ID NO: 1020 - DNA, 300 bp, Homo sapiens
  misc_feature 57, 58: n = A,T,C or G
cgaaagcccatttcaagctttgtgctgcctcttgatctacctctttgtccaggtggnngcgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaa

SEQ ID NO: 1021 - DNA, 300 bp, Homo sapiens
accctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtct

SEQ ID NO: 1022 - DNA, 298 bp, Homo sapiens
  misc_feature 270, 271, 276, 281, 282: n = A,T,C or G
actgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaggaagttgtacgaaggtcaaagaaattgtctgttccagcctcagtggtgtcggaggataatgggaagaggaggatgcnncatcnctgcnntacaggatgttactgg

SEQ ID NO: 1023 - DNA, 300 bp, Homo sapiens
gcaaggttgtgacattgtcacttttttgttctagactcttttaaattttctgcatttgcctgaaaagcacccctgtaagaatagatttctcatggctctaaaaattattcccaagaataccttacttggttcaaaagcagactgtttctcttcatttcatctcaaatcagacttctgggcaagatgttctttagagtaagcaaacctacaacctaaaaatctcttcaagaggcatctctggtcttgtgacaagacctcttcaaaaacccacagtaaaactcccctccctccagttggcca

SEQ ID NO: 1024 - DNA, 300 bp, Homo sapiens
attacttagaagcttataacgaaagctaaaaagcaattttaataggttcagtaaagccaactaccacatagattttacttaatatgtataagaatacaagataaaagatctttagacactttacaaaactgccaaacttgctaaagaagatgaacctgataaacagccacaggtacacagcctgtacactgaaatgtacgtgggaaagcacagtgcaagaatttcttgagctgtcctgagggttatgttaaccagagcttctcaacctcactacatattcaaatggcccgggagcttttc

SEQ ID NO: 1025 - DNA, 300 bp, Homo sapiens
cttctaaatgtcctcctccccacttgttttattattactgtttttttctctctttaatgtttttttttatagagacatggtctcactatgttgcctgggctgatctcagactcctgggctcaagtgatcctcctgcctcagcctcccaaagtgctgggattataggcgtgagccattgcgcctggctctgttactggttttctaacctgagttacttaggatcatattttcattcttttttaaaaagatgggagttttctgaacttttccttaactaaaaagttggaatgcatcttaata

SEQ ID NO: 1026 - DNA, 300 bp, Homo sapiens
  misc_feature 186, 187, 188, 189, 190, 191, 192, 193, 194: n = A,T,C or G
gtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggannnnnnnnngctgactgaagaggagctgaccaccacactaaaggtactgtgcatgcctgctgaggagttcagagagcttaaagaccaggatggagggggagatgataaaagggaa

SEQ ID NO: 1027 - DNA, 298 bp, Homo sapiens
  misc_feature 227, 228, 229, 230, 231, 232, 233, 234, 235, 236, 238, 240,258, 265, 266, 272, 281, 282, 283, 287, 290, 291, 292: n = A,T,C or G
gtctaattttttccatttttctctcctctttctcaagtcttctttttgattttacttttgcttttcctgcagttccttctttatcatgtatgtgctttttggaactctttctgtcagtggtaaagtctgtagagtttccagactgaagactcagctctaagcaaggtttcacttgcgcttcaagattttcctgatacaaagacttttccatgtaactttcatcactnnnnnnnnnngntntgtaaatccttttgattnttgattnntcccancatataaannntctntannncctcct

SEQ ID NO: 1028 - DNA, 300 bp, Homo sapiens
gaacagacaagttctgtcccagcctctgctacctctaaccccatggcattctatccttttctacactgggcttccatttcttaccccaacaatgatctgttcttccaggtgctgtcatttaatttcccagacacttgacctccttctgatttgtgtactccctccaaggctgagttgcagtgagtgacaataatctgtgctaattacttatcttgccagaagactcaaagggtttatggcttttactaactgaactctatgctagatgttagggataaatggttaacaggacacagttct

SEQ ID NO: 1029 - DNA, 300 bp, Homo sapiens
aaggccttaggctttttttttgtagggtgagagtgggggagagatctcttgctctgttgcccaggctggtctccagctcctggcctccggcagtcctcccacctcagcctcccagagtactaggattatgggcatgagccaccacacctagccaggctttttatattgagttggttatatatgcttcatagccacactttataatattggagtatagtattaaattacagcttgttgtcaagtcagtgtttctgtaagacagtatatccaatattggttagagtaacacctatttggtga

SEQ ID NO: 1030 - DNA, 300 bp, Homo sapiens
aaaactttaagaaaaccaatgtttggggccaagcaatggggagcttggccgacctcatttttttagtgattttgaactcaatctttaaaatcctggaagagaaggaaaaaaagggtgtatattcgtgtaatgacatccagatctcactgttctcttggctcctagtgatgggggaaaaaaggtgcgcccagggttgacccttcagtaacacctgcagccatgcatcatgacctccaggtgttcagaggccctgcccatgtgacacgtgcctggtacttcccatacatgtgcctctttaat

SEQ ID NO: 1031 - DNA, 275 bp, Homo sapiens
  misc_feature 3, 4, 7, 8, 9, 14, 18, 19, 20, 24, 25, 26, 30, 31, 35, 37,38, 39, 40, 41, 42, 43, 46, 47, 51, 52, 56, 60, 63, 65,68, 69, 73, 76, 77, 78, 79, 80, 81, 82, 87, 90, 92, 95,96, 97, 100, 103, 110, 111, 114, 118: n = A,T,C or G
aannatnnnatatnttannnaacnnnaacnnaccnannnnnnntanngaanntaanaatnaangnacnntaangannnnnnntgaanacntncannnaantcnctaaaannggngtanatgacttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaa

SEQ ID NO: 1032 - DNA, 300 bp, Homo sapiens
cctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacc

SEQ ID NO: 1033 - DNA, 300 bp, Homo sapiens
gaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgag

SEQ ID NO: 1034 - DNA, 300 bp, Homo sapiens
cgaaagcccatttcaagctttgtgctgcctcttgatctacctctttgtccaggtggatacgctttgcctggaggatttgcatgcgtttattgcgcaggccttgtgcctccaaggaaaatccacctcgcagcttgtaaatctacagcctgattacatcaaccccagagccgtgcagctgggctcccttctcgtccgcggcctcaccactctggttttagtcaacagcgcatgtggcttcccctggaagacgagtgatttcatgccctggaatgtatttgacgggaagctttttcatcagaa

SEQ ID NO: 1035 - DNA, 300 bp, Homo sapiens
gaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggt

SEQ ID NO: 1036 - DNA, 300 bp, Homo sapiens
gatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggttta

SEQ ID NO: 1037 - DNA, 300 bp, Homo sapiens
ggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctca

SEQ ID NO: 1038 - DNA, 300 bp, Homo sapiens
gaagaatactgtgaattctatgactttatcaaaatccagccacatccaggagcttgcagttgttgaccaaatgaatgatgacatagagtagttcagatctatcatgtgctcttctatctaatcagtcaatatttccttggccctcaagccaacattcattttttatgtataaccttcttcatgattttgaaattttgatagggtaactgctaatgagttcacaaatgtagcactttaaaaggaaaataaatggagagtgaaaacaacttggctacgtataattgtgggttttaatttttc

SEQ ID NO: 1039 - DNA, 300 bp, Homo sapiens
gttgagcaatatgaatataatgccaagtactgataaaatacggaattcatttagaatcaacataggtagacagactgtttttagtaaggttttgttttttggtgaataccatgtttgggctgtcagacttacttttcccctgagatccatattttgtacatgacataccagatatatgcaatatgaaacggaaacagtttttcaatctaatatccaggagtttgtgttaatatcttgtgaacttgtggctcttggtatctggcattgataaggctgtctactaatcctagagaaagggaa

SEQ ID NO: 1040 - DNA, 300 bp, Homo sapiens
ttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtga

SEQ ID NO: 1041 - DNA, 264 bp, Homo sapiens
  misc_feature 180, 182, 183, 187, 188, 191, 193, 199, 201, 202, 205, 206,209, 212, 213, 214, 217, 218, 220, 222, 228, 229, 230, 231,232, 234, 238, 239, 241, 243, 244, 246, 248, 249, 250, 254,256, 260, 261: n = A,T,C or G
ctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggccnanncgannggntncatgantnnttnntgntgnnngcnntncngatgannnnntnggannangnngntnnnactngntggnnctg

SEQ ID NO: 1042 - DNA, 300 bp, Homo sapiens
cactcatttggaagagtgagttttgtgagcacaaagtattaagggccaagactggggctgcacatgagcaattatggggtggagttgagaaaaaaaagtgtagcctgatggaggtctctggaatagaacaagccttgcccatgcaggcttccgagcagccctgggtggggttgtggggaggcccccagcggcttgtggcagccttcagctctgcaggagcccgtggggtctagagtcaccgccctctgtgaactggaagctgctctaatgctgtgcacgttttgatgtcacaactatttt

SEQ ID NO: 1043 - DNA, 300 bp, Homo sapiens
cctagaatttgtggagctgggttgtatcataggaaatgcaagctgtgctggtgttcacagctagagaggagaatggttggatgtgcacctggctctgcaggaagcccatctcaggttattgctgaggataagaagctggcactggaatggttggaaaggctgtaagagctccacatgccacctggccctttttgggtatgtggtgcccagacctgagctgctatttagtctgacaaagatagagggattttttttcttccccctttgggcaacctgcccatgtattgtacagaggaaggc

SEQ ID NO: 1044 - DNA, 300 bp, Homo sapiens
gagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcat

SEQ ID NO: 1045 - DNA, 300 bp, Homo sapiens
gcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgc

SEQ ID NO: 1046 - DNA, 300 bp, Homo sapiens
aaatatgctacttagaaattaaggcctctgggttcaatttttggccccagtgttgacctctgtgtaagcctggcaggatgtctcatttctgggtcaccttttccttgccaacatagtgaggtatgtagaccaaatcattgctaagagccttctaactttaagactctaggtttagtcagccaaaagcatgtgattttcccagatttcccaaactccttgtacctaattgaaagtacacaatgaacttgcaagaatttaagcatccttagatgccagtcttcactttgggtattttcctgc

SEQ ID NO: 1047 - DNA, 300 bp, Homo sapiens
aattagtggagtgatctctgaagacctagggctatgatctggagctgctgtggctgaaatttggggcctctgaagtggcatggagattgaggtccagagagcctgagatcttgagggctgacatttggagagatggggtcgagggttgtctttgggccttgactgctttgggcctttctcactctcattcccgggatgctttgccagaatctctgctggattggccgtaaccctgtccccgagcgggctcacagggtctgaaggccacgcatgaggcaaaggtaaagttctgagccaccc

SEQ ID NO: 1048 - DNA, 300 bp, Homo sapiens
cccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaa

SEQ ID NO: 1049 - DNA, 300 bp, Homo sapiens
cacaagcaactttgctttagaatctagaattcctttgcaggcagagaagtctctacctcccagtgtttcctagctaagaacgtaaatgtgaggagggaaatgtacttgcagaggtttcataattatttacttataaaaatagtcttcatagccgggcgcggtggctcacgcctgtaatcccagcactttgggaggccgaggtgggtggatcacaaggtcaggagttcgagaccatcctggctaacacagtgaaaccccgtctctactaaaaatacaaaaaattagccgggcgtggtggca

SEQ ID NO: 1050 - DNA, 300 bp, Homo sapiens
ggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagtt

SEQ ID NO: 1051 - DNA, 300 bp, Homo sapiens
gaaatcagtagccccagagatacctggcaatagctttttgagaatctggaatacagttagcactcaaacatttgtagaatgaagggcagtagaattatcatttctcctcctgtctaataactgtgacaagggagtggccggtgactttttttggtagagctttttcaagaaaaagtttagtcctacggacagttcggtagttattctacttcagacactgggcatgtttcatgttcttcaaaaagcccagttatactttggttttttgttgtttgagacggagttttgctcttattgcct

SEQ ID NO: 1052 - DNA, 300 bp, Homo sapiens
ctgctataaaagtatgattgtcgtcattacagtgattgctgattgagggcttgctcagcacctttctgggggctcaacgaatgttctgtgatgttgagttcaccaccctataccctgggagagagatagtgtgtttccatttcacaggtcagcagactcgagcacagagaggtgaggtaacacagcctggcaggagtggagttgggattcaaggcctggtctgaatggtggtgctctcacattgcagttgcactccaagggacccttgcaaggtgctaacagatgtgaatgccttttgga

SEQ ID NO: 1053 - DNA, 300 bp, Homo sapiens
catttgtaaagctgcagggaaagaggttccacttcccagcaaccccatcctaatggcttatggcagtatctcaccttcagcttatgtattagagatttttaaagggatcaagtcgagtgagctggaagaatctctacttgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaa

SEQ ID NO: 1054 - DNA, 300 bp, Homo sapiens
ttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataa

SEQ ID NO: 1055 - DNA, 300 bp, Homo sapiens
gttacatcaagagataaatagagtgaagcagaactagtggtgcggaccagctcgccagcaacagaagggtttgtagtcggcctggcagtggacagggaggttggctagaactattaccttaggtccgtgataatatccctgaatccaacttttcagaaagaaataggtaacatatttttcaccaggaagcttcacccagacactgaacagaatggtctcagtgcactaatggaggctcagttaaagggttgtggtagcacaaggaagagacattctgacttggaaatttggagaaggctt

SEQ ID NO: 1056 - DNA, 262 bp, Homo sapiens
  misc_feature 199, 200, 201, 202, 203, 204, 205, 206, 207, 213, 217, 219,221, 224, 227, 228, 229, 230, 231, 233, 234, 236, 238, 239,241, 243, 245, 247, 248, 249, 251, 253, 254, 255, 257, 258,259: n = A,T,C or G
gtccaatagctgtgaagctggcagcccttccaagcctgggcagatcctaaaaagacagcaggcagagggcgcagggcttatggcctggccggagttgggaggtgaagcagagggcacagggcttatggcctggccggaggtgggaggtgaagcagagggcgcggggcttatggcctgtctggaggtgggaggtgaagcnnnnnnnnngaggangttncntntgnatnnnnntnntnannananantnnntntnnnannnctt

SEQ ID NO: 1057 - DNA, 300 bp, Homo sapiens
agcactggatgaaaacaaggatggcaaggtcaacatcgacgacctcgtcaaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaat

SEQ ID NO: 1058 - DNA, 300 bp, Homo sapiens
cttttctggagggagacacccatctcctgcccttggacatcaggactccaggttcttcggcctttggactcaggcttgccacagaggcctcccagggctctcggccagtcagcctcagaatgagagttacaccactggcttccttggttcaaccaccttcttacctggactgagcctcacttacagcttctctaggtctccagcttgcagacagcctatgggaggacttctcagcctccataagtgtgtgggccagttcgcctaataaatcccctctcctggccgggcgcggtagctctc

SEQ ID NO: 1059 - DNA, 300 bp, Homo sapiens
cctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagatcatggaaccggactccaagatgacgatctaaagacccgggagccagaagccaaggccaggttctgggtgtagggcccagagaagcagaacagcccagagccccaggtgcctggcctggc

SEQ ID NO: 1060 - DNA, 272 bp, Homo sapiens
cttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaa

SEQ ID NO: 1061 - DNA, 300 bp, Homo sapiens
gaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttata

SEQ ID NO: 1062 - DNA, 300 bp, Homo sapiens
cccaggcgtaaatagagctccctactccagaccacctgccacccacctcccaagttgagaacacaagctccagctgggctggagagtcaggcttggtgcagggtgactttggcgaagttttgtcagatccataaagcaaactggaatttgagctttcacttaccctagtatacgttcttaaaaaaaaaaaaagtctatggggtataatcgagatggatacctgggtctttaaattacgtagggaattttgtatgtttaaataattgtactgggttccataaagcttatcttaaaaacttt

SEQ ID NO: 1063 - DNA, 297 bp, Homo sapiens
ggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacggctgagatttattaatccattgaaaaa

SEQ ID NO: 1064 - DNA, 300 bp, Homo sapiens
gtggggtaggcatgggggtggacaggggtgacgggctccacagagacaggatggtggagggagttgtgtgcagttgaacttgatcctgtagttggttttgacctggtgtggtccctccatgctgtggaagtgaaatgtgagggaacaggcctgggggcagtgagggagacaggacaagcctttcatctaaaaggtggcacagagcttaaggccagggaggaaggtatgaagaaaaggtgattgagaactaattaccaagggaaactggcaagacaactggatgcgtgtaatccgaatggt

SEQ ID NO: 1065 - DNA, 300 bp, Homo sapiens
taaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatt

SEQ ID NO: 1066 - DNA, 300 bp, Homo sapiens
gagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggc

SEQ ID NO: 1067 - DNA, 271 bp, Homo sapiens
  misc_feature 192, 193, 194, 195, 196, 197, 198, 199, 200, 201, 234, 248,255, 257, 258, 261, 266, 270: n = A,T,C or G
attggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttatgagcctaggtaaaagctgctaatattcttttaaaagcnnnnnnnnnnacttgcctgatagaaaactccttccgggggggnggattttataatantacgtgngnnctnaacanagtna

SEQ ID NO: 1068 - DNA, 300 bp, Homo sapiens
aagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaa

SEQ ID NO: 1069 - DNA, 300 bp, Homo sapiens
gctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtaccca

SEQ ID NO: 1070 - DNA, 300 bp, Homo sapiens
gtggtttcctgcacatctttggagtagttatgacttctcagtttttccccccttaaactgcattgcctattcttttttcctgacatgctatcaggtatcagtgtgttgaatacatactgcttgtgtatcagacttacgttactgtcatcaccattaaaagaattgcagctttgtgccccatgaccttcagctcagttgttgactgtcattcatgaatgcctaaagcatactgacaccaggtataagtacttgaagatcaagaactagtcaataaaacatgagcaacataatggtaactat

SEQ ID NO: 1071 - DNA, 300 bp, Homo sapiens
acagggtcaaaattttcattctgcataaggtaggtttagtctttttcaaaacattctagtaggcaagtctgtagctgaatcttggaagaaaggcaaccatagtaatatttttgagttcctactgtttattttttcaataaaaactcaggttctcaggttagcagatcatggtcttaggaaggtagctgtagaaccaaaatataaattcctaagcttctaccaattgggtcttactgaaatggcaattgagagagaagtaaatctcttggttttcaccatagttactttatgtttcctttc

SEQ ID NO: 1072 - DNA, 300 bp, Homo sapiens
  misc_feature 24, 32, 41: n = A,T,C or G
gacttgtgttcaggcaggttttcnggacatgnacataaaanaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaa

SEQ ID NO: 1073 - DNA, 300 bp, Homo sapiens
ggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccggcctgagacggag

SEQ ID NO: 1074 - DNA, 300 bp, Homo sapiens
aatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaac

SEQ ID NO: 1075 - DNA, 300 bp, Homo sapiens; identical to SEQ ID NO: 109

SEQ ID NO: 1076 - DNA, 300 bp, Homo sapiens
gttaaactgtcagtattggatcttagaagtaaatgattattaggactgtaatagtaattattaggactgtaaaagtaaaggattattatctgcattagatatcattatatctaatgatatagagactgcagacataactacagggctctttttcttaaatcagaaaatccagattcaatagaaatagggtaaagtgataggaggacaaatagccttccatccagtggttatcaactgacgactacaagtcggcctcacttgctttaattattctattctatcctttgatgctgcttgaag

SEQ ID NO: 1077 - DNA, 273 bp, Homo sapiens
  misc_feature 230, 231, 232, 233, 234, 235, 247, 252, 260, 261, 268, 271,272: n = A,T,C or G
ggcagctagagtcaggaaaatgaccctcatatgcttttaatctttgtttcagttgtctgtcagggttgaattaagaagctactggtttattcccaattgttgatgcctttaggtatgttggaatctttttttttgcctaggaggggccagttgaaaatctgtgactcaagaggcagtgaacagaatactgttttctggggaaaaattggttggctacttgatgttaattnnnnnncagtaacagganaaggntgtgtctnngctattntgnng

SEQ ID NO: 1078 - DNA, 300 bp, Homo sapiens
ccacctctcagacgtgagtaaggaattgccctccttgtctcagtgggacaaggcttgaagctaattggaggaggtggagagaaatttagagggggtcctggttagggtacccataaaaatagagatgcttgggatgttctgagcaaaggagccagaatgcagagaacaggaccacagccctagtagctagggggggagtttgagatgcagcctgggggtgccctgcctaatttcagagacttaagggccagtgtcagtgacagggtcagcaggggtgggtgagaatctgcttaaggctag

SEQ ID NO: 1079 - DNA, 300 bp, Homo sapiens
ccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtga

SEQ ID NO: 1080 - DNA, 300 bp, Homo sapiens
cagtgagattcctcttctggtattacctttgcttcattgctgaatcttctccaatatcatcttctaaaaagagccttttaaaatcaccttttctattatgccctactcatttccagtccctgaattgcccattccccacttcatagcacttattgctatctgaaattacactaaatgtcaccttcatgatggtaggcaatttattgcctttgtcactgttatgtctagagaacaagcagctggctcatagtaggcactcaacaaatatttgttcaatgaagaatttataaatgaatgcct

SEQ ID NO: 1081 - DNA, 274 bp, Homo sapiens
  misc_feature 114, 115, 116, 117, 118, 119, 120, 141, 147, 160, 163, 164,165, 172, 173, 175, 177, 178, 180, 182, 184, 187, 188, 189,191, 192, 194, 196, 198, 199, 200, 201, 210, 212, 215, 216,218, 223, 226, 227, 231, 235, 236, 238, 242, 244, 246: n = A,T,C or G
  misc_feature 248, 249, 250, 251, 253, 256, 257, 258, 259, 260, 263, 264,267, 268, 269, 271, 272, 273: n = A,T,C or G
ctgggctgcatctggccctggctggaggccttgctttgaggggctgagaccctcttcccccaggccctccccagccgacgacagccaccggagaggagatcggaacacgattgnnnnnnntgcagggcgctgggcggaacnaatccncaaggactctganatnnncccttgnnantnncnangngannnannananannnntatacatananccnnanacccnaannacanacanngngcanancnannnnancannnnnaannagnnnannna

SEQ ID NO: 1082 - DNA, 300 bp, Homo sapiens
tgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggcccaggtgctatggttccactggggagagaccatttaattctccagatgctttactccctgattgtcttttagccattattcttttcgttttaagagacatggtctcactctgtcacccaggctggaa

SEQ ID NO: 1083 - DNA, 300 bp, Homo sapiens
caggattgttcattttgtcttttgtttgttttggggaacagggtcaaaattttcattctgcataaggtaggtttagtctttttcaaaacattctagtaggcaagtctgtagctgaatcttggaagaaaggcaaccatagtaatatttttgagttcctactgtttattttttcaataaaaactcaggttctcaggttagcagatcatggtcttaggaaggtagctgtagaaccaaaatataaattcctaagcttctaccaattgggtcttactgaaatggcaattgagagagaagtaaatc

SEQ ID NO: 1084 - DNA, 300 bp, Homo sapiens
gcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaagga

SEQ ID NO: 1085 - DNA, 300 bp, Homo sapiens
gggatgaatatttaaggtgaagcaaagtagctgtggctacttggggccaaaagcttcccagatgctcctgctctaagcacatgatgttttttggggaaagtggtagcaggtagagggtggcagaaagtgtgagaagcacttgttgtaggtgacccagacatgcctcttgaattgaattcggtgatctgcttcttcagctgctttcttgtccctgcccagcaggatgccaggaaacacatagccctgtagaaaatcactggagaagaggatgattggagttcttcatttcttaaaaaacag

SEQ ID NO: 1086 - DNA, 300 bp, Homo sapiens
aaatgaagtccttgagccagaaaaggataccagccccactgttaagtgatgattgtgtgctaaagcagcctaagagttctatcctaacacaagagcctagaaagtaacttcttaggcagtgtccaaagaatgccagtagtccttggggacttttcagaggtgcttggcttgaatcaatttctagatcccaaagcagagtcttcatgcacattttgcggctgtagtgtacagcaaatggctcttggctaggtttagaatgctgcttttaccattctctgtacctgacccagtttgagtctc

SEQ ID NO: 1087 - DNA, 300 bp, Homo sapiens; identical to SEQ ID NO: 118

SEQ ID NO: 1088 - DNA, 300 bp, Homo sapiens
ctccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaaccatactcaatagccgtaaacgctgacaaattccc

SEQ ID NO: 1089 - DNA, 300 bp, Homo sapiens
gctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagat

SEQ ID NO: 1090 - DNA, 300 bp, Homo sapiens
tggctgctcaccactccattggcctgcctgcgcgccaattcccttcggtgggccccggttggctgcaggctgaggtctattccactgaccacccctctcggtgccgcccacagtgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccaccccc

SEQ ID NO: 1091 - DNA, 300 bp, Homo sapiens
agaaaaacaacagagagaaaaagaatacctgagatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatct

SEQ ID NO: 1092 - DNA, 300 bp, Homo sapiens
ccaccttggcctctcaaagtgctgggattacaagcgtgagccactgtgcccggccagaaggagtgttttgagaatggctaagagaagataggttgaatagctatgcctacatgtcactaattaacatctcagagatctctgctacaggttgtcgtcctcattttgtctaatatttttccaatggcatgagtataggaagataaacggggaatgttttgaagtaataaaaaaattccatccataaagaagaacaacatgtattaagctttgtgcaccaaacaacacaacaggaagacacat

SEQ ID NO: 1093 - DNA, 300 bp, Homo sapiens
tgttactggtgcccatatagatgtggataaacaaaaagataagaatggcgagagaatgatcacaataaggggtggcacagaatcagcaagatatgcagttcaactaatcaatgcactcattcaagatcctgctaaggaactggaagacttgattcctaaaaatcatataagaacacctgccagcaccaaatcaattcatgctaacttctcatctggagtaggtaccacagcagcttccagtaaaaatgcatttcctttgggtgctccaactcttgtaacttcacaggcaacaacgttatc

SEQ ID NO: 1094 - DNA, 300 bp, Homo sapiens
ggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaa

SEQ ID NO: 1095 - DNA, 300 bp, Homo sapiens; identical to SEQ ID NO: 126

SEQ ID NO: 1096 - DNA, 300 bp, Homo sapiens
gaacaaagaaggaatgtcttcctcatgtttgggtctatagaagacgttaaagaaaacttccagaaagtgggtttgaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataat

SEQ ID NO: 1097 - DNA, 300 bp, Homo sapiens
gaacaaagaaggaatgtcttcctcatgtttgggtctatagaagacgttaaagaaaacttcaagaaagtgggtttgaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataat

SEQ ID NO: 1098 - DNA, 300 bp, Homo sapiens
gttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctag

SEQ ID NO: 1099 - DNA, 300 bp, Homo sapiens
gggctcttgtcattttctcgctctgtggcactgttcagaggatatcacgggccccttgatttgtatccagaattttaccgaattgctacagacccaaccatccacactgtcccagaaggcagacctgtgaatgtctgagtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatcta

SEQ ID NO: 1100 - DNA, 300 bp, Homo sapiens
gctttggaaattattagatatatcctattcccttcctcccatttttttcctgctagtgcaaaaggtagatgagtaggaagattaggactcctgagttgcccatgatttcatctaatttttggattcagaatgtattttatgaataatatgcagagatgcatattaggaatgtgaagccagaatgggtcagttgtagctgctgcaaagttctgtagctgatggtcatttaattgcatgggggttattttatctttcatgattgtggtgcacctgatgctggcggggatttgtgtgtttttg

SEQ ID NO: 1101 - DNA, 300 bp, Homo sapiens
gccaggtgtattaggatcttttagatgtagtttaatgaagagtttatggcttaaagtgagacagtattacttcagagctcagcttctctccttggattttctctcagcaaatgggagaagtaacgtctgcccttcggagttgttacaaggagacaagataaacacagggtccaagtgcttggtaaatggtaagtgctgttattagagtcaggtgttctagtcacaggtcctcaacagatacagctttggcagtaggaggtgcagctgacctgagctgtttttaaattaaaattaaagcca

SEQ ID NO: 1102 - DNA, 300 bp, Homo sapiens
atttgatgctacaaagagctttgttgaatcttcagaaaacaaaatctgaagggcagagcgaaggaatgctggcattttggaaacccttttgaggcttatgttgtcatgttcataattcagccgatagagaaaaaaccgagaaactgtagaataggctatccaacttccacatggggagatacagctacagataatgttctcaggaccctttgtctttaggtgcagtaaatgatctgcatttttagagagtggaagagtatccccattcttgcctgttgcaactgtggatcccagtcgcca

SEQ ID NO: 1103 - DNA, 291 bp, Homo sapiens
ctacacagttcccattcattaccttaacattgtactgagagagacccaggtctgacctgtatagcagtttgagtcgaggggctgtcaaaggggttgccaaagtcatctaaaggacttggcaacagaagtagcattatgacttggatccacttctttatagaccaatattggcagccatgaaggctggcttgtcctgggtgcggaattcagttttagtggctgaatgcacagacagcaggaagagagaataggggacaatgaacaacagagagagaagaaatgcagtgtgta

SEQ ID NO: 1104 - DNA, 300 bp, Homo sapiens
tgtacttattcttgattgccacgtctcatttggattccccagactctgattagaggcactgccaccaggagagattttatctaaccaatagtacttccaggaagatcctcacccttgtactttcaagaagcacttgtaattaatgttcagcttcctgaacactgagtggtacttgaaaatctctgtggtttatagccttacaaaagctactctggaggctgaggcaggagaatcgcttgaacctgggaggcagaggttgcagtgagccgagatcacgccgttgcactccagcctgggcga

SEQ ID NO: 1105 - DNA, 300 bp, Homo sapiens; identical to SEQ ID NO: 130

SEQ ID NO: 1106 - DNA, 300 bp, Homo sapiens
gcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctc

SEQ ID NO: 1107 - DNA, 300 bp, Homo sapiens
atttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtaga

SEQ ID NO: 1108 - DNA, 300 bp, Homo sapiens
gctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctcccccacttgatgtttgtgttttgtttggggggatatttttcataatt

SEQ ID NO: 1109 - DNA, 300 bp, Homo sapiens; identical to SEQ ID NO: 136

SEQ ID NO: 1110 - DNA, 300 bp, Homo sapiens
gtcacctccactagagggggataaaaaggataataggaaatcagaatattttgatttgtagttcaactgttgatcaattatctttgagacttttaacattcatgactaaggaggattaataattaacatgagctgtagaattaaggtttgtatggcatgataagtataaaccagttttgggaccgctataattctaaaaaagcaggtagactagatgattagttgtacacttattactgctaattcttgattgtagaacaaattttcctatgaaaaccatgttgtgtattttatatctct

SEQ ID NO: 1111 - DNA, 300 bp, Homo sapiens; identical to SEQ ID NO: 131

SEQ ID NO: 1112 - DNA, 276 bp, Homo sapiens
gaggccactctgctggccacctccagtgggtgctgaccacaggatgggctttgggtacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaa

SEQ ID NO: 1113 - DNA, 300 bp, Homo sapiens
gctgccaccacccccgggcccagcctgtctgaaagttcagggtttaggccgagaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctc

SEQ ID NO: 1114 - DNA, 300 bp, Homo sapiens
  misc_feature 8: n = A,T,C or G
gactcatntgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttg

SEQ ID NO: 1115 - DNA, 300 bp, Homo sapiens
agtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatg

SEQ ID NO: 1116 - DNA, 300 bp, Homo sapiens
ggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaa

SEQ ID NO: 1117 - DNA, 300 bp, Homo sapiens
ctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggcc

SEQ ID NO: 1118 - DNA, 300 bp, Homo sapiens
ccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctct

SEQ ID NO: 1119 - DNA, 300 bp, Homo sapiens
  misc_feature 74: n = A,T,C or G
ccacgactcatttgtttcattcacattcctcacgtgcaacaacataattatattttaagaaaatgtggctttgngcatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctcta

SEQ ID NO: 1120 - DNA, 263 bp, Homo sapiens
  misc_feature 214, 215, 216, 217, 218, 219, 220, 222, 228, 241, 243, 245,247, 248, 249, 250, 251, 253, 255, 257, 258, 259, 260: n = A,T,C or G
gtggcaacttgatgaaacagccaaatgcaccagggcaggtcactttcccattacactgattccacaattaaaaaaaaaaaaagaaaaaaaactcattgaaatagctacagttctataggttaatttaaagcctcctttttctactcatttttgaaaccaaaattacattttactattttacataaccagtgaaaagacgttgaaagcctacagnnnnnnntntttggngctctgaaaatgntnangnnnnntntntnnnnttt

SEQ ID NO: 1121 - DNA, 300 bp, Homo sapiens
tcactacacttaaaaatacaagggacatgttaggcaatcagatgctttgtagaaactgagctatttgtcggcctggcgcggtggcccacacctgtaatcccagcactttgggaggccgaggcagtggctcacgaagtcaagagttcaagagcaacctggccaagatggtgaaaccctgtctctactaaaaatacaaaaattagctgagcatggtggtgggtgcctgaggctgaagcagagaattgcttgaatttcaggaggcggaggttaccgtgagccaagatcgcgtcacagccctcc

SEQ ID NO: 1122 - DNA, 296 bp, Homo sapiens
  misc_feature 183, 184, 185, 186, 187, 188, 189, 190, 191, 192, 196, 199,201, 203, 204, 205, 207, 213, 214, 215, 225, 232, 235, 236,237, 238, 243, 247, 249, 253, 261, 264, 271, 289: n = A,T,C or G
cctgtctctactaaaaataaaaaaatgacctgggcatggtggtgggcgcctgtagtcccagctactcggggcgctgaggcaggagaatcgctcgaacccaggaggtggaggttgcagtgagccgaggttgcacaattgcactccagcctggcgacagagcgagactcgtctcaaaaaaaaaannnnnnnnnngggnaancntnnnantggggnnnccacttgccntttgccnggnnnncccangttntncctngttttccnggnattttancccctttccatttttganaaaagac

SEQ ID NO: 1123 - DNA, 300 bp, Homo sapiens
ctggctcagatgtgggatgtgtatggaagaatataaatgatggtgtggatgtcagggtgagggaggagacaaaaccacgatgacccctagctttgtggcctgaactgtgggtggctgaggggatcgttaattgaatggggcagactgaggcttgtgaggaagatcagagtctggttcttgacatgagatgcccttcagacatctcttcactcaggtccaactagggatacagaaacactgaatatttcaacagcagaaattgaatggggggattgatagcgctggcgagggaagcagctg

SEQ ID NO: 1124 - DNA, 300 bp, Homo sapiens
gaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagctt

SEQ ID NO: 1125 - DNA, 300 bp, Homo sapiens
atctttaggctccgtgtgtgaaatgcagcaagcctgcccccagcagcctgtgggctaatcctgagctgttccttcgtttaggtacacaggtgaccctgaagttcccactcggccctctgttttctgagtcctgtctcctctgtagcacagtggggattgttctgaaccgtggcacgccttcttggcgaggcaggctctcttatggaaccatagtctgttacctcatttcttccaactgctctgtcccctaaatgtgtgttcccaggtgcagtgcagcaagggtgctcgctgttggccttt

SEQ ID NO: 1126 - DNA, 261 bp, Homo sapiens
cctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggagaggtgtgggagg

SEQ ID NO: 1127 - DNA, 300 bp, Homo sapiens; identical to SEQ ID NO: 142

SEQ ID NO: 1128 - DNA, 300 bp, Homo sapiens
gaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaa

SEQ ID NO: 1129 - DNA, 300 bp, Homo sapiens
atgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgatt

SEQ ID NO: 1130 - DNA, 300 bp, Homo sapiens
ctaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccat

SEQ ID NO: 1131 - DNA, 300 bp, Homo sapiens
aagtaatacgtcctttcatcttttctttcaagatatttctgcattaaatcatcctcagtatatttttttgaaagccaagttttcccaaagctcctcatttcctcatctccctctgtgccactggtttttcagttgctgggggctacagaccctctctctagaaagatggacatgtgaacataagcactgcattttgcacacaatttccgtggttcagaaaccacctgaacttttccttctagaggaccctgcttaaacacttccattctagggtgtccagcccattaagatggccaagaa

SEQ ID NO: 1132 - DNA, 300 bp, Homo sapiens
actttataaataaattatatgtctgatactagccttccattgcctggatcacatctgattgtcctggtaatttgagaaaagggtagccccttggtatggatagtagcttgatgacatggaattcagggaaaagactatgatggtgtcacttgtaactgcttttgtgctgtaaaattgtcatggattaagaagagagttggctgggtgcggtggctcacacctgtaatcctagcactttgggaggccaaagtaaggactgcttgagcccaggagttccagaccaacctggccaacacagcc

SEQ ID NO: 1133 - DNA, 300 bp, Homo sapiens
ttactgactgcaacaacttcagattatacctcttctactccaagtgctttcaaagaaagtcctctgccaagacaaattcattacgttttttccctctacctgtttgcctttattctcttttgtatttcatcttctcatctagattgaataatctttgagagcacagatgtttatttatatttttcctttccatttctactcagcatgaggtgtccattgaacaaacttgatgaatttttattgcttaatatcttgctagaggtggggagagaggttgggggcggttaaggaactatcagc

SEQ ID NO: 1134 - DNA, 300 bp, Homo sapiens
ccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctg

SEQ ID NO: 1135 - DNA, 300 bp, Homo sapiens
  misc_feature 247, 248, 249, 250, 251, 252, 253, 254, 255, 256, 257, 258,259, 260, 261, 262, 265: n = A,T,C or G
aataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgcctttttnnnnnnnnnnnnnnnnttnttaagtgctgtattaataatactttctgaaagaaa

SEQ ID NO: 1136 - DNA, 300 bp, Homo sapiens
cgccagagcagcagtggggaacatcttcttgtctgctggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaac

SEQ ID NO: 1137 - DNA, 289 bp, Homo sapiens
  misc_feature 271, 272, 273, 274, 275, 276, 277, 281: n = A,T,C or G
ctgcgctatcagcgcaaagaacctcccgacagtgccactgaccccacctccccccagccccacagctgggtctggctgggcactgaccaggaggaactgagccgccagctggaccggcagtcccctggcccgcccaagggggaggggagctgcccctgtgagagtgggggaggaggggagggccctaccctggcccctggccctcctgggggcaccaccagctcctcaagcaccctggcccgaaaggaggctggggggcggcggaagcgannnnnnnttgngacatttg

SEQ ID NO: 1138 - DNA, 300 bp, Homo sapiens
cagagctgtgatctgcccccaggtattctgacccccaaactggctctcaaccatgtttacatgatgaaaagaagaggtgactgttgtatcagctctaaaggcctcacttttggtgaaatgggacctaaatttgattgcatacttgattacttgctgtcaatactgaaattggcacttcataattttaatactattgaactttcaccataaccctgtcctataaagttgacttgcaaatgaagaaactctatctcttcaatattataaaatatatccaagagtcacaactagtgagaaaag

SEQ ID NO: 1139 - DNA, 300 bp, Homo sapiens
ctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcctcaaattccatgccttttatttttaatttaatcccgttcaaatacttaattgttatacat

SEQ ID NO: 1140 - DNA, 300 bp, Homo sapiens
gttttgttctcttctttgactattaaaaagctcagtgccaaatatttctaacatatggcaagtgtttctgtgtaccttacaagtctatatataaatttttcttctcttgacagggttttatctatatttagcaagtcacccctaattcttttagaataaggcagaaaataaatcaacgtaaaggttgagaccaagccagagacagctggccaaagtagctggttcagggatataacctgcaagttgccaacccagcgcattcttctcacccttcttccaccctacgaaaggccatatctt

SEQ ID NO: 1141 - DNA, 300 bp, Homo sapiens; identical to SEQ ID NO: 158

SEQ ID NO: 1142 - DNA, 300 bp, Homo sapiens
tttctccatgttggtcaggctggtctcgaactaccgacctcaggtgatccacccacctcggcctcccacagtgctgggattacaagcatgagccaccgcgcccggcctccctgttccagttttctataatctgttcatattatattctgggtatatgtgggtggtgtgattatccatgtggtcttattttcacattctttgcattaactataatgtacttaatgttttaagataagtttcattctacaaagatgtatgtacaatacctggtatcaggtaacaatcttaaaaaaaactaat

SEQ ID NO: 1143 - DNA, 300 bp, Homo sapiens
cttcagcattcagccacttcgtttcagtggcatctgtaatatactctttaatatgaagatgttgaattaaaagtcaaaatactgatgtgagttgacctagtctcaaagggtaaaagattatttttccagggagcaaatgagaaggttgggtgcacgagccttttgctgaacagttggagccgtgtccaggtggaggtgccaatacagaatcaggattggtgggcacacggagaaacaggctatggcccttgagggctgaaccccccagggtgagggtgcagatgctgcccctgcttcggt

SEQ ID NO: 1144 - DNA, 300 bp, Homo sapiens
gctttttgggacagtagaaattttcacattaatactgtaaattctgtaccatattttgacacctgctacatctgattcaaatgcgggaaaaaataccatgtgtgcataatgaaaaatcattcatttttccctttcttaccccagcaggaatagaaagcaattccaagccactctgcaaatgtatccaaggttagagattcgggagctggccaacatcttacaccccaaatgactgaagcatttcagtaggctgactggctcgaaataacaatttaagaaaggggggaaaaaacctacagg

SEQ ID NO: 1145 - DNA, 300 bp, Homo sapiens
gaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctc

SEQ ID NO: 1146 - DNA, 300 bp, Homo sapiens; identical to SEQ ID NO: 159

SEQ ID NO: 1147 - DNA, 300 bp, Homo sapiens
accagtatcagatttgtgattaatcgcattactgtcaagtcctcatgcaggccagtcagacttctgtgtgtgttccctcaccttccatttaagtttcagcctttatctatgtccttttgggtgtctgccatgctgatgatagagctcatcagtctttgataaatactgttaggtccttaagtgattttctgtgaaatcttacgcataggatttctgtggtcagggtttgacgtctgatcttgttcgtcagatccccttgctcaagaatgcaagtgcattacctcttaaattttaaaagct

SEQ ID NO: 1148 - DNA, 300 bp, Homo sapiens
attggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttcctaattaaaaagtagcca

SEQ ID NO: 1149 - DNA, 300 bp, Homo sapiens
gtggaactggctcaggctggattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaa

SEQ ID NO: 1150 - DNA, 300 bp, Homo sapiens
  misc_feature 234, 235, 236, 237, 238, 239, 240, 241, 242, 243, 244, 245,246, 280, 281, 290: n = A,T,C or G
cacttgggtgagatccaatttatctcaccttctgatagttttaaaagagaagtaattttaatttacattaactttaaaatatttgtatgccaaacactagttattttgaggggatcgaaacaaatcatagcagagataaggaactttcatactttgggaggattttttttaaataactgtatgtttactctaagtagatatgtgtatgcatgcattcacttatgatatgcacannnnnnnnnnnnnacacacacacacacacacacacagaaatttatgnngcctttaanaatcttggga

SEQ ID NO: 1151 - DNA, 300 bp, Homo sapiens
agagggtggggtctggccacataggtacctctgtggctctggtctggggttagacactgttagggactagcatttattggacttgtaaagacagcacctcagaattagtaactacttgcattttagggtctgttttatgaagccaacaagtgaatgtaaaataggctctgcatcttttctgagagccctgtcactgggcagtgagcatttccaaaattgcagctctgtcagaatgaaccatgaatacttaagaaagggaaagtaggaacagggagcagagcaaagcataacttgctgtgt

SEQ ID NO: 1152 - DNA, 300 bp, Homo sapiens; identical to SEQ ID NO: 166

SEQ ID NO: 1153 - DNA, 300 bp, Homo sapiens
ggctcagaggggttatgattcggagggttctgccgcacggcatgggccggggcctcttgacccggaggccaaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaagggggttagcttacctaccagagcttgtaggggctgtgcaggtgtatggctcccaaggcggcccttttcaggtggcaggt

SEQ ID NO: 1154 - DNA, 300 bp, Homo sapiens
gggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgcca

SEQ ID NO: 1155 - DNA, 300 bp, Homo sapiens
acaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagcatggatgtcttcatttgttgcttctgtttttcatcttttttgtttt

SEQ ID NO: 1156 - DNA, 300 bp, Homo sapiens
aaagaatccaattttagagctgctaaaaaactctttggaagcacctttgcatttcatggctcacagattgaaaactggcactccatcctgaggaatggtctggttgttgcttctaatacaccgattgcagctccatggtgcaatgtatggaagtggaatctatcttagtccaatgtcaagcatatcatttggttactcagggatgaacaagaaacagaaggtgtcagccaaggaccgaagccagcttcaagcagtaaaagcagcaatacatcacagtcacagaaaaaaggacagcaatcc

SEQ ID NO: 1157 - DNA, 300 bp, Homo sapiens; identical to SEQ ID NO: 170

SEQ ID NO: 1158 - DNA, 300 bp, Homo sapiens; identical to SEQ ID NO: 172

SEQ ID NO: 1159 - DNA, 300 bp, Homo sapiens
aagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaccacttacccttgcccaatttctcaatgaagatctaagttaggaaagacgatggaggtggaatcctttaaga

SEQ ID NO: 1160 - DNA, 300 bp, Homo sapiens
gacctatcttgatctggatagtaaagtgaggactttaaaaaaggttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttat

SEQ ID NO: 1161 - DNA, 300 bp, Homo sapiens
gattgtgacatggtgtaataaaggtatacatggtgtaataaaggtatacatggtgtaataaaggatgtgggagcacaaatccataggaatttgagagtttaggaattgtatttattattcaggcccttcactctcagactaccctgctctatttgaataatgaggcttgtggtggtctgtggaaaagtggacagagtagaatttgggcagctgctgaaggtttggtctctggaatgagtccacgttaccctaaggacagtaatcccaaattgagacaaaaactttaagaaaaccaatgtt

SEQ ID NO: 1162 - DNA, 298 bp, Homo sapiens
  misc_feature 127, 128, 129, 130, 131, 132, 133, 134, 135, 140, 167, 173,175, 190, 214, 240, 247, 248, 274, 276, 285: n = A,T,C or G
ggggtcttggatggcttttccaccgtccctgagactggggttgaggggactgacgggggccaccaccgccccgccctccagcgcctcctcccagggtggctgggcctcctgttctcagggatcacannnnnnnnnggggnccaaccccttccggaaccaaggtgcangcttangnctgcggctttctggntgtgtgctggcttctgggcttcancctcctgccccagccgtccctgccanggcacannggaccatgggggctgggagtcccatnanagcagtgangtggccccggcct

SEQ ID NO: 1163 - DNA, 277 bp, Homo sapiens
  misc_feature 142, 149, 154, 164, 197, 200, 202, 203, 211, 213, 215, 221,229, 231, 233, 239, 244, 249, 253, 255, 258, 271, 275: n = A,T,C or G
agagggtggggtctggccacataggtacctctgtggctctggtctggggttagacactgttagggactagcatttattggacttgtaaagacagcacctcagaattagtaactacttgcattttagggtctgttttatgaanccaacangtgantgtaaaatangctctgcatcttttctgagagccctgtcactgncantnnagcattcncnanattcgnatctctgncntnatgtantatgnctacntttnanttnttttgtttccccntttnct

SEQ ID NO: 1164 - DNA, 300 bp, Homo sapiens
aacgttcccccgctacatagtctttcttttgtgttatttagtttaccatttcttttttccatcttgttataacctccacgagttgtgtctcttttgttttctacattatacccaacggctagcacataacaggcacccaatatatactgaacgaactaaggaatgaatgaaggaatgaatgaataggtggcttataggaaacccctggggccagggactctgcaacatcaccatgtaactttttctttgtgctgagaagcagagagaaacaatagaagatatctcttaatctctcaagga

SEQ ID NO: 1165 - DNA, 300 bp, Homo sapiens
gaggcaccagcaggtagtggcccctgtaagcagggccagagtcgggacaaagagcaggagtgaagcagccaagagacagaggaccaggctggagccagtgggcacgcaggagcctgcctgggaaaagccggggggcaaggctggcatgggaatgaacacctgctggtgacacctctctgagcttcagttcccttaactagaaaaatagaacaggcccggtgcggtggctcatacctgtaatcccagcactttgggaggctgaggcgggtggatcatgaggtcaggagatcaagaccaccc

SEQ ID NO: 1166 - DNA, 300 bp, Homo sapiens
gaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcaggggccagcatttgaaacatagaaatgttctgatgaagaatctgaactgaagaagctgttttatagggttatagaagattgtaattgtagagaaatatttctctt

SEQ ID NO: 1167 - DNA, 300 bp, Homo sapiens; identical to SEQ ID NO: 180

SEQ ID NO: 1168 - DNA, 300 bp, Homo sapiens
gactggagaagtcagaagtagaaaagcagattgctaggagagacaggatgacagattttggtcagaaaatgggatattggagtttaaagtatcaaatacagaatagttccagatgttcagagatccagcatgggattaggtactgaaatggattagaactaaaagtcactagaatttagaaattgagaaccatgagagtggatgcaatgacttgttgcttgattgaaaaataaattaataataataaaggaccatgagactagcctgttataggggttatctccatgaacattgaatttt

SEQ ID NO: 1169 - DNA, 292 bp, Homo sapiens
ttcgagtgcaagctccccatctttctaaagtttccatggcaatacagctaactgaagaactaaaagccagtgatgtacttgccagggttctcagccaagaaagtggggttgcccagactctcaagaaaggagaagtttttttgtatgaaattggaggaaatattggggaaccctgccttgatgatgacacttacatgaaggatttatatcagcttaacccaaatgctgagtgggttataaagtctaagccattgtacaagacttaacaagctgcagataaccatgtggactt

SEQ ID NO: 1170 - DNA, 300 bp, Homo sapiens
gtgtgtgtgtgtgtgtgtgtgtgtgtgtgtatacagacattttttttttaacttgttgattcagatgtcttggtccctgaatagtcctagattacttattttgagaattcattgttaaaaattacagggaattaaaataattgcctttttttttagagggtaagagatgggtagaagagtatgcctctgaaaattttattagtttattcttgtggagaataccaagaaaatgtgtatttgcccattgctaaatatgatatatgccattttgtatttatttgtcccaagtgtctttttgta

SEQ ID NO: 1171 - DNA, 300 bp, Homo sapiens
gcagggagttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctggttcttaatttttgtcttctcattcctgcttccctctcaccct

SEQ ID NO: 1172 - DNA, 300 bp, Homo sapiens
ctctggagtagctgggattacaggcatgcaccaccatgcctggctaattttgtatttctagtagagacagggtttcgccatgttggccaggctggtctcaaactcttgacctcaggtgattcacccacctcagcttcccaaagtgttgggattataggcgcgagccaccatggctcagcctcatgttcgtttttaaaacttaggatggtggctcttttacattgattggtaggaactcttcatattacgaggcagttagctagttgtctgtgaaataaaatactaatgattgaactttct

SEQ ID NO: 1173 - DNA, 300 bp, Homo sapiens
ggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttccct

SEQ ID NO: 1174 - DNA, 300 bp, Homo sapiens
ggtgttttgttctgtagcagaagcataggcatactgacaatacaaaccgaaatccttctaacgtagtggaccttttcaggccagcattttttccttgaaaacctggagcatgtatccatcttatagcagagatcactttcacaatgtttgggctcttgatttgaattgatgatgtaatgagccctctatccagattgtaactaattactctgcgaattgactggattccacacccttctaatattttacttttcctcttttatcaactctcattctcgctgccatgatcaatggaccaac

SEQ ID NO: 1175 - DNA, 300 bp, Homo sapiens
ctgtgcacacaaattagaatccttgtaaaatggccatgattctgtttatgaccctggccctccaaccagaccagcctctctgccctctggcttttttagatcactggcatggtttctgcctactccaggtgccagtattattttgtgaatgttttttttcttcatatctactcatctttatactactttcctcgtaaaaggaaactagagaacatgatcttaaatgaaaaccaacgatcacttgccagaaagaacaggtaactaggctttgaaaaaataagttagaggagatagcataat

SEQ ID NO: 1176 - DNA, 300 bp, Homo sapiens
tccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaa

SEQ ID NO: 1177 - DNA, 300 bp, Homo sapiens
ctggagggagacccccaaaaagaattagggtgctaacatcccaccaaaagcatcatcccacccaaaatgttgcttttcattctatgtcaataatttaaggtggaatttctctcaccctgtggagatgaaagtggcaaaaggttgtcccagcagtgttgggggatggggtgtgcacatcattcttttgggggtagatgacctgctggctggtgggcttttctccaggactactgcaggtagagaccctctgggcttgtgtggagtgggagcagccgtgttgggactatggggaggagctgg

SEQ ID NO: 1178 - DNA, 300 bp, Homo sapiens
gcaccagcaggtagtggcccctgtaagcagggccagagtcgggacaaagagcaggagtgaagcagccaagagacagaggaccaggctggagccagtgggcacgcaggagcctgcctgggaaaagccggggggcaaggctggcatgggaatgaacacctgctggtgacacctctctgagcttcagttcccttaactagaaaaatagaacaggcccggtgcggtggctcatacctgtaatcccagcactttgggaggctgaggcgggtggatcatgaggtcaggagatcaagaccaccctgg

SEQ ID NO: 1179 - DNA, 300 bp, Homo sapiens
ggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcg

SEQ ID NO: 1180 - DNA, 300 bp, Homo sapiens
cagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttacca

SEQ ID NO: 1181 - DNA, 300 bp, Homo sapiens
ataggcatactgacaatacaaaccgaaatccttctaacgtagtggaccttttcaggccagcattttttccttgaaaacctggagcatgtatccatcttatagcagagatcactttcacaatgtttgggctcttgatttgaattgatgatgtaatgagccctctatccagattgtaactaattactctgcgaattgaatggattatacacccttttaatattttacttttcctcttttatcaactctcattctcgctgccatgatcaatggaccaactatgcttataaccacaaatggtga

SEQ ID NO: 1182 - DNA, 298 bp, Homo sapiens
  misc_feature 275, 287: n = A,T,C or G
gcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcctcctgtctccacacagacggcttctgcacgtttgngaatctacaggncactccttgca

SEQ ID NO: 1183 - DNA, 300 bp, Homo sapiens
gcagagagaagggccgttctcggctggtatcaggcccaagagagtcaacaaaggggggacgaaagggagacagggaagagaacagtggtggggctgtaagttgacctccaggtggcagaaaataaagttggaagaattgactgggacagacagccagggccctgcaggaagggcgggagaggaagcctgcggacacctgccctttgtgattgaaccgcagacaccaggcctggcggggtcgcttgcctccgctgcccaagctaaggctccgctaagctggtcctgagaacatacttcatg

SEQ ID NO: 1184 - DNA, 300 bp, Homo sapiens
ccagcccctcctctccccgccttctgggaggaggaggtcacacgctgatgggcactggagaggccagaagagactcataggagcgggctgccttccgcctggggctccctgtgacctctcagtcccctggcccggccagccaccgtccccagcacccaagcatgcaattgcctgtcccccccggccagcctcccccacttgatgtttgtgttttgtttggggggatatttttcataattatttaaaagacaggccgggcgcggtggctcacgtctgtaatcccagcactttgggaggctg

SEQ ID NO: 1185 - DNA, 300 bp, Homo sapiens
  misc_feature 225, 229, 234, 240, 250, 252, 273, 276, 280, 283: n = A,T,C or G
aagctgctaggttccagttttaatttttagggttagttggactctgttatgaaaagataggttatgggtgggcgacaggttgatacagtcttagaaaaagcaggtaatatcaaaggattggaaagctagcatgcatgccctcttacctgggtatcttcccccttttttccttttaaactcttgagcctcctataacagaaggattatgtgcttcaaaccttcttntttnactgngccatnaagtgggctngngcccaaaatatttacttgcanaanatcngtnactggcttaaatacttc

SEQ ID NO: 1186 - DNA, 300 bp, Homo sapiens
agaagattggggatgaggagtgaggagaaggctggagaccagttagaggctaccgtagcagcgtagagaggctgaaaatctaactagggtggaagcagccaggcaggctggtcctaatgttgggagttgttcagatctggtggagaggtcattacttatagagttattaatttataccccaccttaattgcaaagagattcaaagcagtaagccatcactttagaatttaatgttctgttttcctttttatttactcattcagcagctatttcaatgcctgctgtgtgccaggtgctatt

SEQ ID NO: 1187 - DNA, 300 bp, Homo sapiens
gctgcacagtgggaagggcactgggctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatg

SEQ ID NO: 1188 - DNA, 300 bp, Homo sapiens
ctgggaaggaataattcaatttgattggcagatatatataatacagtaggagaataatgggagaaagataaattgagactagaataggtagactttaaatgcctgtctggtttaggtatttgaactttcaaggtgtggtaaatgtttgagtaaaggaataatgtgtccaaagattattatggaattgtctctctgcatacctctatcgctgtttgtcacagctgtgttcttatgtgactgattcttcctgaagattagaaactcctcaaagactggttattagagcttattcttcattat

SEQ ID NO: 1189 - DNA, 300 bp, Homo sapiens
aaaaagtaaagcttttcatgagcacaaatcccttgcattgtttgatgttactgatattcgtaaaatgaatattttttgttttgttttgttttatttttttgagacaagtcttgctttgttgcccaggctggagtgcaatggcatgatcttggctcactgcaacccctgccttgcgagttcaagtgattcttctgcctcagcctcctgagtagctgggattacaggcgctcaccaccacacccagctaatttctgtatttttagtagacacagggttttaccatgttggccaggctggtct

SEQ ID NO: 1190 - DNA, 300 bp, Homo sapiens
agaaatgtagcacaaaatggagaagtcgttcaaccttgaccctgtcagagttcttatttgaaagccacattgctgctagtgttcttattgtgttttggattctgtttcttgccctttttcttattagccaagtagtaacttaaggaagcagataagaacaatgaattttggactaaaggaagtaagaacaatgaaccagaaatcagataggaatgtggtgataattgtgacatggtcacatagtcatagtgggagctcatgtgagtaaaaatagcttgatacatttgttaagaggcttgt

SEQ ID NO: 1191 - DNA, 300 bp, Homo sapiens
caaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtaggctccctcagacgcagccccaccatggtccttcggcctcagcagttccaattctaccagccacaggggatcccctcctccccctcagccgtggtggtggagatggggtccaagcctgccctcacg

SEQ ID NO: 1192 - DNA, 300 bp, Homo sapiens
actcctactcagcccatggacccgatgagctggacctgcaaaagggagaaggcgtcagggtcctggggaagtgccaggacggctggctcaggggcgtctccttggtcaccgggcgagtcggcatcttcccaaacaattacgtcatccccattttcagaaagacctctagttttccagactcccggagccctggtctctacaccacatggacgttatccacctcctctgtgtcctcccaaggcagcatttcagaaggtgatccacggcaaagccgtcccttcaaatccgtctttgtgccca

SEQ ID NO: 1193 - DNA, 300 bp, Homo sapiens
agaatgctgccacagatgtgagacgggtgtggctttcttcagtggtggatcactttcattcatctttaggcgacaaaggttggggttgtggttacagaaatttccaaatgctactttcatcattattacaaaatgatgcttacgacgattgcttaaaaggtatgttgattccttgcattccaaaaattcaatctatgattgaagatgcatggaaggaaggttttgatcctcagggggcctctcaacttaataacaggttacagggaacaaaggcctggattggagcatgtgaagtatata

SEQ ID NO: 1194 - DNA, 300 bp, Homo sapiens
aaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaata

SEQ ID NO: 1195 - DNA, 251 bp, Homo sapiens
  misc_feature 237, 238, 239, 240, 241, 242, 243, 244, 245, 246, 247, 248,249, 250, 251: n = A,T,C or G
cacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgnnnnnnnnnnnnnnn

SEQ ID NO: 1196 - DNA, 300 bp, Homo sapiens; identical to SEQ ID NO: 197

SEQ ID NO: 1197 - DNA, 300 bp, Homo sapiens
tgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctggtgagttcagcttttaccagcctcagtgtggaggctccatcccagcacacaggcc

SEQ ID NO: 1198 - DNA, 300 bp, Homo sapiens
cccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaaca

SEQ ID NO: 1199 - DNA, 300 bp, Homo sapiens
cttggaaatgcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttttttccgtcaaaattggatttgtaattaaattgtaagcctcgtaggatgtatgttggaattttaagtctttcctttggttctatgcaaataaaa

SEQ ID NO: 1200 - DNA, 300 bp, Homo sapiens
ccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcacc

SEQ ID NO: 1201 - DNA, 300 bp, Homo sapiens; identical to SEQ ID NO: 192

SEQ ID NO: 1202 - DNA, 300 bp, Homo sapiens
atcaccctggcacgttcccctcagctgggctctgcagggcagctaagattgggcactgatgttcctggcttcagtcctacccgggttatgcagctacggcttcatacatacaccagttgcactaacttgggatgaaaattaagttaaaaccagtagaaaatttcatcctatgttttggtggtaaaagaagcaaatgaacaaatgaatagaggctgccaaacagttgtctcaccaactgttccgactagctaacaagattagctaggtcatacctagtcgtaaaagaatactataagaact

SEQ ID NO: 1203 - DNA, 300 bp, Homo sapiens
ctcgattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgatcatttcacttgtcacatcaggaaccctatcctcttagttctcccattgagatttcactgctggactaagattattcttgattcgtagtcattggtttctgtttccattcattttcagcactgat

SEQ ID NO: 1204 - DNA, 293 bp, Homo sapiens
  misc_feature 188, 189, 190, 191, 192, 193, 194, 197, 198, 202, 203, 208,210, 214, 219, 224, 225, 231, 239, 240, 241, 244, 251, 252,257, 259, 260, 261, 263, 264, 275, 277, 279, 280, 284, 286: n = A,T,C or G
ggagttttttttttcattataattttttcaggaaagacttatggaaaaaaatatctctctcccacctccttttatccccatgagacacagtttcccactgtaatcagggtaatatgcatttgtaagttctgatatgtgattcatttatgtgatggcaaagataagtctgtcttgaatgcaggtactannnnnnngtnnacannttatncnaatntcaancaacnntaattnctactacnnngtnttctgannaagangnnntnntcatttagatntngnnaccntnctgatta

SEQ ID NO: 1205 - DNA, 300 bp, Homo sapiens
gtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatctttttattaatgtta

SEQ ID NO: 1206 - DNA, 300 bp, Homo sapiens
ccaggtagctctcaaacttcctcctcaatccactcctccttttacattcatggaaagggagggggaaagaagcccagtctccaaggtcagccagttacaccagaagcagtgccaaccagaatatgagccccgccctgggacagggcacagagccctcactagcatgctggagaggggccaccccaggtcctgggtgtccctatacccagctgcttctcttcaagctggtgaagcccctgccactgccaccacctcctcccctaccttgggactttgtgtttaatcctggaagtcacaatt

SEQ ID NO: 1207 - DNA, 300 bp, Homo sapiens
  misc_feature 273, 274, 275, 276, 277: n = A,T,C or G
attacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatggagaagaggannnnngagctcagcaaactcctgcctcg

SEQ ID NO: 1208 - DNA, 262 bp, Homo sapiens
cttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgacctt

SEQ ID NO: 1209 - DNA, 300 bp, Homo sapiens
agttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatatacagtatcccttgtcctcaagatttttagttt

SEQ ID NO: 1210 - DNA, 300 bp, Homo sapiens
gatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggtt

SEQ ID NO: 1211 - DNA, 300 bp, Homo sapiens
cagtcctccccacactcagagatctgtggggaagctccgcccagccacactccttgggataatactagccggttctgcctgattccttttccccggagccagcctagggggcccgggactcctctagtgagccttgactgttaggtaagagacaggaagcagacaagccaagaggttgctgcagctgcccccaggaggaaacgggcagcagggagtgtggcccagcccccactgtacccctccaggggcccgagcccttgccagcccaatgacaccttgaagtcaccacttttcctttct

SEQ ID NO: 1212 - DNA, 300 bp, Homo sapiens
attttgctggacactcagacacaatttagagtatttatatataacttgaaaacagtaacatttccaaaaaccgatgaaccccaccctgtcccaaggaatgattggtatgtatgtgaagttcattttctgacaaaaataattacgttccacttaggatgcacaaccatgctgtcctgtagagaagtcacaagttttgtgagaatttttaaactgatgatgtttatttccatggtaacatgagtatacattttaccttctattgtagtgatgaatcacaattagtctttttttataggttgg

SEQ ID NO: 1213 - DNA, 294 bp, Homo sapiens
  misc_feature 264, 266: n = A,T,C or G
atgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaangnctctgacagagggtccaggaccagacct

SEQ ID NO: 1214 - DNA, 241 bp, Homo sapiens
cacactccaggctgagaaagagtaattaggaggcctgaggaggggcccgaggaaaggctgttggggtgggctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgtgtg

SEQ ID NO: 1215 - DNA, 297 bp, Homo sapiens
  misc_feature 223, 224, 225, 226, 227, 228, 229, 230, 231, 232, 233, 234,235, 236, 237, 238, 239, 240, 241, 242, 243, 244, 245, 246,247, 248, 249, 250, 251, 252, 254, 255, 257, 258, 260, 261,263, 270, 276, 281, 283, 285, 286, 290: n = A,T,C or G
ccaagtcgcagggagcttgtggccctttggtgtttattgcagcagctttagttctgcagtggaggtgggctggagcaggggacgaggtcttgggagtctgtgaggccactctggccgagggtgtgggtttgcttcctcagctgaagggatacatggaaacccacctttgcatagttcagtaggggttacggtgtggttcatggaagccatttctgtgggttgnnnnnnnnnnnnnnnnnnnnnnnnnnnnnntnntnntnncncagaatnatgagntcaananannagcntgatatg

SEQ ID NO: 1216 - DNA, 300 bp, Homo sapiens
gttttttggtgaacactgattttattggtgtcttagatccctagtctacccaaataattttaacagtactgttttttctaatcctgaagtctgatatttatgactcattagcaggaatcaaaactagtgatcagtagaacactttcaaaataaaaatttggaatgcagacttttatgaaaatttaaaagtgctccttaacagaatatcatgggttttcctataaaacttctttaagtattgtaattccagtctgccccaacttaaaaaaaaattcttattaatatgtcagtcattaattg

SEQ ID NO: 1217 - DNA, 300 bp, Homo sapiens
gtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaactta

SEQ ID NO: 1218 - DNA, 300 bp, Homo sapiens
gaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtttggccttggggcacagagctgagctgaggccgctgaagctgtaggaagcgccattcttccctgtatctaactggggctgtgatcaagaaggtt

SEQ ID NO: 1219 - DNA, 300 bp, Homo sapiens
ggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaatacgatggatgggg

SEQ ID NO: 1220 - DNA, 300 bp, Homo sapiens
ggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatgggg

SEQ ID NO: 1221 - DNA, 300 bp, Homo sapiens
gatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcattttt

SEQ ID NO: 1222 - DNA, 300 bp, Homo sapiens
ataacacacatcacagtatgctctcagaaatttctttatttgaaccctataccaatatctgttgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttggtaaaagtactcatccctaatattacattgttctggaaggac

SEQ ID NO: 1223 - DNA, 300 bp, Homo sapiens
ttagtgtactggatgtcaggtccctcaaagattccttggaccattttcatgtgaatgaagaataaatcaattgtctttcattgaatcacacggacaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcacgtgatgctgtggagtcttcaaaaagcccgaccactctggatta

SEQ ID NO: 1224 - DNA, 300 bp, Homo sapiens
ttagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggatta

SEQ ID NO: 1225 - DNA, 296 bp, Homo sapiens
  misc_feature 254, 267, 275, 281: n = A,T,C or G
gaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagcgaccacacaaatattctattacgaaactgttncagaaataaattngcactgtncattcntctggcctcgctggt

SEQ ID NO: 1226 - DNA, 300 bp, Homo sapiens
gccaacttcaattcccttttagtcatctacttcctactaacagctgtaactaggatgagtcaaaatcaattgcctatgctcaccagatccctgataaattcccatgaagccacctgaaaggtggtaaaagcaaggtaaaacgtggtgaaagcaaggtaaagaaggtagatttcacaattttgttttttaaaaaggggaatcttccctgaattctttgaggtactaagtacgtggtttaatgcatattttcattcttgttagcagtttaaaaataatgtttcagagactgtattcacgatt

SEQ ID NO: 1227 - DNA, 300 bp, Homo sapiens
gataggccacattccagtaagaactcaatttgactcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatattcctttctttattaatgatgccaaaaccaaaagtagctgtgt

SEQ ID NO: 1228 - DNA, 300 bp, Homo sapiens
ctttagttcagataaaggaaacatccaaaaatactgagatgagtaaaattttattcaaagtaggttcctgctttgtcttgatctcaatccattctaactcctgatgtcatttaccgtgtgagatcttagtacaatcatgaaaagaatatgagcatttatcaaaactctctgacatctgtatgtttagaaatgaacttacacagcaaaatatgatttccttgcacttatttaatttttctaacttcaatttctacctatgtgtctctgccagtttgacctgattcagacacccagaacttg

SEQ ID NO: 1229 - DNA, 300 bp, Homo sapiens
cctttccaagcccactgctcagccttagaggaaagtgtggatttgaaatttcctcatggaattgatggaggtttttaggtagattcatagaatataacgtatctaccaaagattccgttttcaagggatctagaagatgttagtgcacacgcaaaaaccagacaaacgtctctacacggataaaggcacatatacaattatgcacacagggaagggcatacactctattgtgggcacagaatgacatgcaattatggacacacaaaaacacatgcacccaattatggacaccaaaatata

SEQ ID NO: 1230 - DNA, 300 bp, Homo sapiens
tgctcttgggtgcttcctgaggtgtggttgcacagggtggttattcctgaatgcaagggcttactatgattttctcttagtgcctctcatttctgatgctttctgtcctatgaggtcagtctacttactagttagtattctatattaataagtatgccaaatgacttaactcctccagaaatgttattcgttaaaagatgagatgtgctgagacaagaggatcgcttgagtccggaaggttgaggctgttgtgtgctataattgggcctgtgaatagccactctgttccagcctgggcaa

SEQ ID NO: 1231 - DNA, 300 bp, Homo sapiens
gccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggcccgtacagaattcctacggaagaaagccagacatcagaactcactgcctgagcttgaagcagcagaggcgggagccccaggttctggccctgtggacctgtttcgggagctgctggaggaagggaaaggagtgatcagag

SEQ ID NO: 1232 - DNA, 300 bp, Homo sapiens; identical to SEQ ID NO: 209

SEQ ID NO: 1233 - DNA, 300 bp, Homo sapiens
ctaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggttagaatgcagatgtgcaaaagacagacaactgaacaaattacaaatgaact

SEQ ID NO: 1234 - DNA, 300 bp, Homo sapiens
cctctctgtcataatgtacccaaaatagagtaagaatatcatgcttttcagtaatactccagtgaatgaggctaagagtaccatttttgttcttataaaagaatttttttggacatgaatacaaagatgtcaggttaccaaatcatttgctagtagatcctaacaatatcacctataggaaactgaacgtagcctttaaacattaagtgatgataatggatttggccgggcgcggttgcctataatcccaacactgagaggctgaggtgggtggatcacttgaggccaggacaggaccag

SEQ ID NO: 1235 - DNA, 300 bp, Homo sapiens; identical to SEQ ID NO: 208

SEQ ID NO: 1236 - DNA, 300 bp, Homo sapiens
gttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagcctacacactcaatggcaaacacagcaccgagtctgctctga

SEQ ID NO: 1237 - DNA, 300 bp, Homo sapiens; identical to SEQ ID NO: 212

SEQ ID NO: 1238 - DNA, 300 bp, Homo sapiens
ctgcgacccctcggaccagtgcccgccccaggcccgctggagcagcctgtggcacgtggggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctgga

SEQ ID NO: 1239 - DNA, 300 bp, Homo sapiens
gtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaat

SEQ ID NO: 1240 - DNA, 300 bp, Homo sapiens
ccatcgattcggtgtcactatcctcatagatagagccaaaacatttctatcacaccggcaatttcctatgtgtcccatcccaatcaatcctttcccctttgctggctccaaacaatgactctttcctatcttattagaaagattagaattgcttttctagagttccagtaatggaatcatacagtgtctaagtctgtttgtggtgctgtaacaaaatacctgagactgggtaatttataaattataggaaattatttctcacagttctggatgctgaaaagtctatgatcaaggcactag

SEQ ID NO: 1241 - DNA, 300 bp, Homo sapiens
agactactgaactctacgcttaaaaattattaagatggcaaatttcatcttgtttttttttaacttaaaaaaactacatataagatagttttgcctgttttcaggtttcttttcagtgttttaggtattcagtatttaaatcacaaaatttgtgatttgaacatttttttcttccttcatgagattttaagtggattgatacttgctttccattctgtcccgatgtctgacctttgtaatgtaaagaagaacattttgtttaattgagagaagtctgctgtgttcttgttgatagaggac

SEQ ID NO: 1242 - DNA, 300 bp, Homo sapiens
aaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttcctgtttgtggcatggtgagaaaacccatgctgaaaagattgtactttgtgatccccctcag

SEQ ID NO: 1243 - DNA, 300 bp, Homo sapiens
ggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatg

SEQ ID NO: 1244 - DNA, 300 bp, Homo sapiens
gctatgttgtcgttacaacatcaaagtgattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctcgtctgggctctcgtcgttggccttgtagatcaagtaggggaagtgagtgat

SEQ ID NO: 1245 - DNA, 300 bp, Homo sapiens
tttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgag

SEQ ID NO: 1246 - DNA, 300 bp, Homo sapiens; identical to SEQ ID NO: 217

SEQ ID NO: 1247 - DNA, 300 bp, Homo sapiens
aggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaag

SEQ ID NO: 1248 - DNA, 300 bp, Homo sapiens
gggattacaggcatgacccaccgcgcccagcctgtaatttcttatactttgtattttgtacttgtattatgcttctgatacgctataattatttatgtacatgttttttttcttcaatagactgtgaactcttcgaatgtaggactcctagagctagatactcaattattttttattaaattgaatgacttgaaactacagatcctttatttaaacttcccaaatttctgctttatctaggcaactctttaaattcttttatctcatgtagatttcaaaggctgaaataattgagatttt

SEQ ID NO: 1249 - DNA, 300 bp, Homo sapiens
aaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgt

SEQ ID NO: 1250 - DNA, 300 bp, Homo sapiens
cgtctcaaaaaaaaaaagtattttacccatccacaggcagcagacaaggaagtaccttctgtgactgtctggcaaggtcaaaggcatcagggaaggtaaaatactgaaactatatttttaaaaataaaagtattcccttttgagtgtgaattaggaatcaatgccccttctcactacttttgtgaaaaaaatcacagttcctgcagcaagtctatgcctgggtaacaaccaacccacaaaatccaagaggaggtccccctctcccgcctctgtgaggcttgaggagcagtatgtatctgg

SEQ ID NO: 1251 - DNA, 300 bp, Homo sapiens
ggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagct

SEQ ID NO: 1252 - DNA, 300 bp, Homo sapiens
ttttcaagaggtagtaagtctgaaccaaggtgttggcagggagagtagaaaagatttgggtaaggttgcagaagtagaagcacaagatttgacagctcattagatattaaagaagaccaatgaatcaggagatggtaatgccaagatttagacccgctggaacgatgatgagttggtggtggtgagagtaagtagtgagcataatgatatgttgaaatcagtaggaagattgtgtttgaggaaaatataaggtatccgtccattcattctttatttattcctgttaatctttaaaaagct

SEQ ID NO: 1253 - DNA, 300 bp, Homo sapiens
gggttccatcccttccacccaggaaatggaggcacgacttgcagcgttgcagggcagagttctaccttctcaaaccccccagccggcacatcacacaccggacaccaggacccaagcccagcagacacaggatctgctaacgcagctggcagctgaggtggctatcgatgaaagctggaaaggaggaggcccagtgaccctccaggactatcgcctcccagacagtgatgacgacgaggatgaggagacagccatccaaagagtcctgcagcagctcactgaagaagctgccctggatga

SEQ ID NO: 1254 - DNA, 300 bp, Homo sapiens
ctggaccgggtcttggtgctttccagctcagggcgttggtccacttggttattcttggggaccaaaatccaagctaggatggggacagaggcctggagacaacctgctggcctccttccattaaagccattacagtgtcaccacaggattgtaagaattacaaatgcgttttccagagtccccagagaaaaaggagtctggcagttagaagagtaaagtgcatctgtcaacaaaagaaataccaaagatgagactacagcagcgacttgtcacctcttccgtgttgctactgcctgagaa

SEQ ID NO: 1255 - DNA, 300 bp, Homo sapiens; identical to SEQ ID NO: 225

SEQ ID NO: 1256 - DNA, 300 bp, Homo sapiens
cagccttggtgacagagcgagaccctgtctctaaaaaataaataaataaaatattgtgagtctctgatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcatgtggatgatttgaggccacgagtttgag

SEQ ID NO: 1257 - DNA, 300 bp, Homo sapiens
cccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccg

SEQ ID NO: 1258 - DNA, 300 bp, Homo sapiens
  misc_feature 8, 10, 20, 23: n = A,T,C or G
accagttntngttaatttanccnacgagggttaacccatcctaacagggaaggtaactgtacgtccatcagtccactagagggcatcacaacttgtttaatgagataatcaaacatatgatgtaattttaaagggtttacatttttaaaaatttaatagggtatcagttaactaattttacttagatggaacttctgtaagcttagtaggtatgcttaaataaagcctgctaataaaatagagattcagactcaatagaatggttttacatatgtaatatatgttttaaacagcataaaa

SEQ ID NO: 1259 - DNA, 300 bp, Homo sapiens
cagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatagctgtgcaggaagaagagctgcaggtgcatgctgctgatatggagtctctgaccaggaacatacagattaaagaagatctcataaaggacctgcaaatgcaactggttgatcctga

SEQ ID NO: 1260 - DNA, 300 bp, Homo sapiens
ctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacattt

SEQ ID NO: 1261 - DNA, 300 bp, Homo sapiens
tcccaggaacacccaggaagccatattttagtgctaaccgggacaaaagccatagtgtttttcccagtgttgactactctgcctggcctctctcttctgtcttaatacttactgtgttaaagagctttggttgagtatagattctcctaggcttaccgtagagttacatcctgataagcccattataagttgaaaatgtttttagccgtggtggctcatgcctgtgttcccagaactttgggaaggtgaggtgggcgatcacttgaggccaggagttcgagaccagcctgggcgacagag

SEQ ID NO: 1262 - DNA, 300 bp, Homo sapiens
ccaaatccctggtttcctgtcccttagtggtgtggccgtgggcaaacgccttaacttccgtgagctttgacagtctgtctgggaggcagggctcaggcatccctggcctcttggggttgggtgagagggagacagaggtttgtgaagcgctttgcacacctgggcatctggtcagtgttcagtaaatgccagctgggctcagtggtgcactcctgtaatcccagcactttaggaggctgagtggggaggatcacttgaagccacgagttcagggctcagcctgggcaacagagaaagaca

SEQ ID NO: 1263 - DNA, 300 bp, Homo sapiens
gagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcaggtacctaagttggagctgatgcccctggagacaccgcaggccctgcccccga

SEQ ID NO: 1264 - DNA, 300 bp, Homo sapiens
ggaagcagcagggtccaggggtagaagggctcccagaccccgagaacaggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgca

SEQ ID NO: 1265 - DNA, 295 bp, Homo sapiens
  misc_feature 58, 204, 252, 253, 262, 276: n = A,T,C or G
accaagagaacgcggtcagaaggaggtggaactggggagtcctctcagggagggacangcaaaagactcaaagtagatggacagaaaaactgctgtgaggaggggaaagaggagcagcagggatgtgcaggggacggtggggaagacagggtagaagagatggttatggaggttggagagatggtgcaggactgggccatgcanagccctgggcagccaggggacctgcccctgaccactggaaagcatggnncccctgganaagaggggctagtncatcactgcagccctggct

SEQ ID NO: 1266 - DNA, 300 bp, Homo sapiens
gtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggc

SEQ ID NO: 1267 - DNA, 267 bp, Homo sapiens
  misc_feature 29, 53, 59, 85, 86: n = A,T,C or G
cttatcctggtggatgtgctattttcttnaaggagtatgaagcccttttctanctatcntcccagtggagcggagttctcagtgnncagttactccatagtgcaatccatattaataggcttcttctcttaagtcttcatctcttcttttgcttaattactgaaccgtaaattcccttcagagaaatttaaatgctggtatttggactttatacatgatactttttgtagtttcttttaatttttgaaagatgaactgcttcctttt

SEQ ID NO: 1268 - DNA, 300 bp, Homo sapiens
cctggtttcctgtcccttagtggtgtggccgtgggcaaacgccttaacttccgtgagctttgacagtctgtctgggaggcagggctcaggcatccctggcctcttggggttgggtgagagggagacagaggtttgtgaagcgctttgcacacctgggcatctggtcagtgttcagtaaatgccagctgggctcagtggtgcactcctgtaatcccagcactttaggaggctgagtggggaggatcacttgaagccacgagttcagggctcagcctgggcaacagagaaagacacttgcct

SEQ ID NO: 1269 - DNA, 300 bp, Homo sapiens
gggaattgctcttctctccgaggctctgtttcttgtagctatcaggaagtggcagctctttgaataagtgccttttcctctcccatctgccacctttgtcttccctctggacatatcctgggggttcaggagcttccagctgtgcagttggccacaggactaggggagcccccttcccttccagaccagtgtccacatacccttccctgtgcccacacaccttcccctgtgcccgcactgtcacccaccacaagcctactccagcaggagcaccacagccttctgcggtcacgctgtgca

SEQ ID NO: 1270 - DNA, 277 bp, Homo sapiens
  misc_feature 170, 171, 172, 173, 174, 175, 176, 177, 178, 179, 180, 181,182, 183, 184, 185, 186, 187, 188, 189, 190, 192, 198, 200,202, 207, 209, 212, 213, 218, 222, 225, 228, 229, 232, 235,237, 238, 243, 246, 247, 248, 255, 260, 268, 273: n = A,T,C or G
atttcaggaccagtgagaaatagtcaatttaggatctaattatttgctttgtaggtttatgtattgcccatttggggtagatttaggaaaatattttctaaatccaagagttcaaaaccaggctggacaacatagcaagaccatatctctaccaaaaaaaaaaaaaaaannnnnnnnnnnnnnnnnnnnntngccccngnanccccnanttnntgggngggntgnggnnggnggncnnttggnccnnngggggtnagggntgcagggnccctnggcc

SEQ ID NO: 1271 - DNA, 300 bp, Homo sapiens
ctgatctaatgagctttatgatggagttgaagatgcttttggaagttgccttaaagaatagacaagagctgtatgcactacctcctcctccccagttctactcaagccttattgaagagataggaactcttggttgggataattttaaaatatttttcttgctggcagccaccagaaactggaagaggcaaggaatagattctctcctagagcctccagagggagcacatctttgctgacaccttgatttttgcccagtgaacagatgtggaacccctggcctccagaactagagagaat

SEQ ID NO: 1272 - DNA, 300 bp, Homo sapiens
tttctatacaatttttccttctgatccagagacacggaaaaacaaagggcaagatggaaataagggatgagaaggtctatgtggaaaaacagttacaactggagtggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttct

SEQ ID NO: 1273 - DNA, 300 bp, Homo sapiens; identical to SEQ ID NO: 236

SEQ ID NO: 1274 - DNA, 300 bp, Homo sapiens
caatcagtgataagctatattttgagttttaaaattgtttttacaattacccctgttttgagtatatatcttgtcaaatcattctaataaatatttgctgataactgtgtggaatacataaatggtaggtagaaatttggaagaatcactacatattttcagttatcattctctgtgtaaattcatgctttaaaaatatgagaagttaaagtgccttggatattattttattttctatattttgtcccatattgtattgtctaattttcattgaaaccacataacatgcttgaataggca

SEQ ID NO: 1275 - DNA, 300 bp, Homo sapiens
tggctggtattataggtgcacaccaccacacccaactagttttttgtgtttttagtagagatggggtttcatgatgttggccaagctggtctcgagctcctgaccccaggtgatccacccacctcggcctcccagggtgctggaattataggcgtgagccactgcgcacggcctggggaggttttatttcttgacaaaggtatttgatactcgtgcagaccctggagggtctcactggagagacaacatttaggctgagatctgattaacaggaggcagctgcagtgcagaggtcaaaag

SEQ ID NO: 1276 - DNA, 300 bp, Homo sapiens
cccaggctgacaggggctctgccgtctttaacatgtgactttctaggtcagtcatctggtcattgcttttccacacagcagataagacaaaggagtggaaatagaggggtagagattttctcttaaacgtgtgaggctggagtggtatgcttcattggcaagaacctggtcctagcctgcctagctgaaaggaggggagtcagggagatgcactttgcagccaaaattctgttgccaagaaggggaaagtagatttggttgattttgatctgtgtttgctgctgtgttactctataattc

SEQ ID NO: 1277 - DNA, 300 bp, Homo sapiens
cacctagctttatcatttgtaaaatgagtctctaggtacagccctttctggggttgagacagagtttctgaggagtaaaagccatgtcattgtggaaacaggcagctattctcacagctggcatgagcccactactcccctataatcagtgctgataaactgctctcatttgttggacttcagactttcctgacccactttgaatgggggccactttgaatggaaactttctatgtattgaattaaaagatctccaagataaatggttaaatgaaaaagcacagtgcaaaagggcatatg

SEQ ID NO: 1278 - DNA, 300 bp, Homo sapiens
aagataaaagagataaggaagaaaaagaaagcagcagagaaaaaagggagtggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctg

SEQ ID NO: 1279 - DNA, 300 bp, Homo sapiens
agagtcaaggaaaagtgcaagatagatctatcccatttcttcctccacctggagattcctgagctatgctcagcctctgtggggcagggaagactggggacatttttagtcaggatgctgagaagtaattcctgctggggccaggcatcttttcagggctgctgtgatgccaacaaagaaggggccccaggcccatccttactcctggtcccaaaaaggatccaagtgggatgggaagctggcagcaccaacccacttgtagattaacaacaacaacaaaacaccaacaaataaaaaaag

SEQ ID NO: 1280 - DNA, 300 bp, Homo sapiens
aagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattc

SEQ ID NO: 1281 - DNA, 300 bp, Homo sapiens
accaggaataatctagggctcattagagatgtcaaagatctgttctagtttcttaacctaaaacaagagtgttttagttccattttataggcggggagtctgagccaaacatgttatgtcactttccaagtctccatagcacagaagtcttctgtctccccatcctgactttcccagctcatagggactgtcaaaggcagcagctctggccggctgtgatgcctcatgcctgtaatcccagtaatttgggaggctgaggcaggaggatcatttgaacccaggggttcaaaaccagcctga

SEQ ID NO: 1282 - DNA, 300 bp, Homo sapiens
gcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaa

SEQ ID NO: 1283 - DNA, 300 bp, Homo sapiens
cagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaa

SEQ ID NO: 1284 - DNA, 300 bp, Homo sapiens
tcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctggccagcgtaatagttttatttagattttttaaaattctgtagattaaagcaaatgacagttattgaactatcacaaaac

SEQ ID NO: 1285 - DNA, 300 bp, Homo sapiens
gtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcgga

SEQ ID NO: 1286 - DNA, 300 bp, Homo sapiens
gcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttg

SEQ ID NO: 1287 - DNA, 300 bp, Homo sapiens
tttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggtttttttttttagtgtgtgttttccctccaagtgtgatatttcctgctgaattaaattatacttcagttgtt

SEQ ID NO: 1288 - DNA, 300 bp, Homo sapiens
ctcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgag

SEQ ID NO: 1289 - DNA, 300 bp, Homo sapiens
ggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagaatgtgaccttatttggaaatactg

SEQ ID NO: 1290 - DNA, 300 bp, Homo sapiens
  misc_feature 2, 7, 43, 46: n = A,T,C or G
gnctttnaaaaccatctacttgttctttttgcaggatcccatngangtcgggagaatgctggccacagatggtgctgcccaacaggcccataccactcgttccagtcagaggtgcttggcctttggggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcattt

SEQ ID NO: 1291 - DNA, 300 bp, Homo sapiens
  misc_feature 150, 151, 152, 153, 154, 155, 156, 157, 158, 159, 160, 161,171, 172, 179, 196, 201, 213, 217, 225, 243, 258, 269, 272,273, 275, 281, 283, 292: n = A,T,C or G
gccagatcctgcaggagagcgcgatgcagaaggctgcgttcgaggcactccaggtgaggaaagacctgatgcatcggcagatcaggagccagattaagttaatagaaactgagttattgcagctgacacagttggagttaaagatgaagnnnnnnnnnnnngaatgcctanntgagatnatttgacctggtccttntttgnatttgacccggnccanatctacanggtcacttggttcatctnctggacccctgcttnttctgggctgngcnntnaatgcntncgttccttnagagaaca

SEQ ID NO: 1292 - DNA, 300 bp, Homo sapiens
  misc_feature 261, 262, 263, 264, 265, 266, 267, 268, 269, 270, 271, 272,273, 274, 275, 276, 277, 278, 279, 284, 287, 288: n = A,T,C or G
gttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttccttttttttttttttnnnnnnnnnnnnnnnnnnnttgcnttnncccccaggttga

SEQ ID NO: 1293 - DNA, 300 bp, Homo sapiens
gccaagcctcggcctccactgcacctgctgcggagtggcacctttgcctgcaaggccctctaccccatggcccagtgtcatctcagcagggtctttggccactcaggaggcccttgtggtgggttgctcagtctgtccttccctcatgagaagctactgcttatgtccacagaccaggaggagctgtcacgctggtaccacagtctgacttgggctatcagcagccagaaaaactagaggaatcttatagattccagaactcaggatacctcagggataggtcacagccaagagtacaaa

SEQ ID NO: 1294 - DNA, 300 bp, Homo sapiens
gccaagcctcggcctccactgcacctgctgcggagtggcacctttgcctgcaagtcccggtaccccatggcccagtgtcatctcagcagggtctttggccactcaggaggcccttgtggtgggttgctcagtctgtccttccctcatgagaagctactgcttatgtccacagaccaggaggagctgtcacgctggtaccacagtctgacttgggctatcatcagccagaaaaactagaggaatcttatagattccagaactcaggatacctcagggataggtcacagccaagagtacaaa

SEQ ID NO: 1295 - DNA, 300 bp, Homo sapiens
ccattgttagcatcgtacacgattgtgatttttatgtcaaaagaagccaaaacttgcaatactatttttagcagacaaaaaaaagaactaagtataaaatgtataaatatttttgacttgaacatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagta

SEQ ID NO: 1296 - DNA, 300 bp, Homo sapiens
gcaggatgtgatgtcaccgagatgcagaggatactcagtcaaccaacatttactgagcatctacttcgtgccgtatgtcttgtcaacggaaaggggtccctatccagaccccaagagagcattcttggatctcttgcaagaaagaatttgaggcgaatccatagagtaagcaaggcaagttacttctatatagaagggtgcacccttacagatcaaacaatgcttagtgatgtgtgtcagacctctgagcccaagcaaagccatcatatcccctgtgacctgcatgtatacatccagatg

SEQ ID NO: 1297 - DNA, 300 bp, Homo sapiens
cctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctc

SEQ ID NO: 1298 - DNA, 300 bp, Homo sapiens
cacctcctaggttcaagcgattctcctgcctcagcctcccaagtagctgggactataggcatgggccaccactcctggctaactttcgtatttttagtacagatagggattcaccatgttggccaggctggtcttgaactcctgacctcaggtgatctgcccgcttcggcttcccaaagtgctgggattacagttgtgagccactgcacccagccaggaatgacatttcaaattattcaattttgctatcaacaccttaatataaaaccaaagaggtaagcatgctggttactatagaac

SEQ ID NO: 1299 - DNA, 221 bp, Homo sapiens
  misc_feature 58, 205, 206, 207, 208, 209, 210, 211, 212, 213, 214, 215: n = A,T,C or G
ggggcggccattactgaaagcctgcacatgaggagtgggttttctctctctctcctcntcaacattgagttgatgatgatcatgatgtttgagacagtgtctcactctgtcctgcctcagcctcctgaggagctaggaccacaggctcatgcctccacatcctgctacattttttattttttttgtagagttggggtcttgctgnnnnnnnnnnntttata

SEQ ID NO: 1300 - DNA, 300 bp, Homo sapiens
gaaggcagttatatggttttttactttttcatcaattccataccatcgggagtaactaaatgaaacatacttcaaagaaagaagtcaaattaaatgactgtcattgcccattaataaaaacaacaatctgagcttaacaaaaaatttaacaaacagggaagacagaaagatggtatatttattgcctgactacactggcataactcactttaacaaaaattatcacatttaataatataacctgttatagctaaatattaaacacatattaattagggccaactttgaaggatttctaat

SEQ ID NO: 1301 - DNA, 300 bp, Homo sapiens
aagtagctgggactacaggtgcccaccaccatacctggctaattttttgtatttttagtagagacagggtttatccatgttggccaggctggtctcaaactcctgacctcaagtgatcctcctgcctcggcctcccaaagtgctgggattacaggtgtgagccaccatgcccagccaataatttcctgatataataaaaatgccaatactatacaattaaatagtaaagtgataaaaaataggataacatgataaccactaattaatatatactacataatcatccttttcgtgagttga

SEQ ID NO: 1302 - DNA, 300 bp, Homo sapiens
gcagctgtggagagaactgtacgtggtaagggggagatataagatgtcctgcataagtattttccctgtagattgcaaagtcatctatggagaggaaaggtccaaaatagtcactggggagagcaggtgaattagatggccaagcagggtggatggatcatttgaggtttggggtgacagatcaactgagatccacttacacttctgaaaacgcaagaacactttagaacattaacaacacttaaagctttttacatcatttgtaaataactggtggaacttaacaccacaaaataaagt

SEQ ID NO: 1303 - DNA, 243 bp, Homo sapiens
cacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgtgggaag

SEQ ID NO: 1304 - DNA, 260 bp, Homo sapiens
  misc_feature 243, 244, 245, 246, 247, 248, 249, 250, 251, 252, 253, 254,255, 256, 257, 258: n = A,T,C or G
cacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgtgggaannnnnnnnnnnnnnnntg

SEQ ID NO: 1305 - DNA, 300 bp, Homo sapiens
ggcaggtcatgttttcaagagtagccagaagtctggattcttatgcaaagcctgttttgttgtttgtttgtttgtttgtttgaagtttggcagcagatttaacatttttaaagtactgtgcaggccaaacaaaacacgcctgttgactggttgtttgccatcctaaatataaagtggggcccatgtgtggtggctcacacctgtaatcccagcattttgggaggccaaggcaggaagatcacttgagcccaggaggtcgaggctgcagtgagcagtgatcgcaccaccgcactccacctg

SEQ ID NO: 1306 - DNA, 300 bp, Homo sapiens
gccaggtgtcattgcacatgcctgcagtcctggctactagggaggctgaggcaggagaattttttgcacccagaagttcaaggctgcagtgagctatgatcacaccatggcactccagcctgggcaatagaatgagacccagtctctaaaaaagtagaagttaaaaaaaaagattaagaatagatgtagggcagcagaatttcgaacttcttttcagcatcacaatactttaaaacagtgattgtcatctgcctcaaacccattgcctctcacataggaaatattttgaaacatattttt

SEQ ID NO: 1307 - DNA, 268 bp, Homo sapiens
  misc_feature 9: n = A,T,C or G
gctgcactntggcctgcatgcactctggcctgcatggcagaacaagaccctgtggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgt

SEQ ID NO: 1308 - DNA, 300 bp, Homo sapiens
catgagttaaaggatattttcagtcctgttatcttcaattgcagtctttaaaaaaacccaccctattgttctacttgttatatgtctattcatacagtaaattcatttcaaggtttatgccagtgggtattattggtgctttttgaagttgaggtgaaccatccaggaaggtcttgttaatgttatgttcatctataatggcataggggaaatatatatatttttaatattgtaaacatttgtactgaataacctttttttccccccctccgcaagcaaaactggttgaacagcggatga

SEQ ID NO: 1309 - DNA, 300 bp, Homo sapiens
attagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaa

SEQ ID NO: 1310 - DNA, 300 bp, Homo sapiens; identical to SEQ ID NO: 260

SEQ ID NO: 1311 - DNA, 300 bp, Homo sapiens
agtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtcttttttttgtttgttttagacggagtttcactcttgttgcccaggctggagtgaagtggcgtgacct

SEQ ID NO: 1312 - DNA, 300 bp, Homo sapiens
ctggaaatgaaattattattttcacccatagtagcaataaaaagaatactcagtaatacgtatggaatactacttagtcataaaaaggaatgaaataatggcatttgcagcaacctggatggaactggagaccattattctaagtgaagtaactcaggaatggaaaaccaaacgtcgtgtgttctcactcttaagtgggagctaagctgtgaggacgcaaaggcctaagaatgatacaatggactttggagactcaggggaaagggtgggagggcggtgagggataaaacagtgcacact

SEQ ID NO: 1313 - DNA, 300 bp, Homo sapiens
  misc_feature 103, 104, 105, 106, 107, 108, 109, 110, 111, 112, 113, 114,115, 116, 120, 121, 129, 134, 141, 155, 157, 178, 189, 194,217, 222, 226, 228, 236, 256, 260, 264, 270, 271, 282, 283,285: n = A,T,C or G
gacagtacctttcccccccctttcatggcccattttattgtctgcctttcagtactaagtatgaccgttcctatctcagatcttaataaagagaaaaaaaaannnnnnnnnnnnnnaatnnggccttanttgantatactngttagcaagcgtgngngacagagagtggggaaagctncatcattgaanatttngataaactttaccgacttgagtntggtncatntntccctttncctaaattaactagcactgnctgnaagncatttnnctgtctgacgnntntcccttccattctgc

SEQ ID NO: 1314 - DNA, 300 bp, Homo sapiens
actgcctccttccacacgagtgcccctttggccaaagaagattattatcagatattaggagtgcctcgaaatgccagccagaaagagatcaagaaagcctattatcagctgctctgctcagttagtttttattcccggggtaccaagcagctgcacagtcggtgcctgggaggcacgtagaggcccctggctcaggcagagggagatggttagactcttgcagggctaaaactctaatttggaattgaatattgtggatatcttagttaaaggccatgcttacagcttagaaatgaagcc

SEQ ID NO: 1315 - DNA, 300 bp, Homo sapiens; identical to SEQ ID NO: 262

SEQ ID NO: 1316 - DNA, 300 bp, Homo sapiens; identical to SEQ ID NO: 263

SEQ ID NO: 1317 - DNA, 300 bp, Homo sapiens
atttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgc

SEQ ID NO: 1318 - DNA, 300 bp, Homo sapiens
aacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagtt

SEQ ID NO: 1319 - DNA, 300 bp, Homo sapiens
ttacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgta

SEQ ID NO: 1320 - DNA, 293 bp, Homo sapiens
  misc_feature 18, 34, 48, 50, 58, 61, 64, 70, 83, 90, 110, 112, 135, 138,140, 141, 147, 153, 170: n = A,T,C or G
tcatattagtgttgccangagcaaaaggtggggnaggtgttgactttnanagcacagnagnaanttttcntgttgttgttcgnttatctngattgtgttagtgcccacangnctgtatgcatttttcataattcncananntgtatnctaatnagggtgcacttcactgnacataaatgaatctcaacagacaaaaggttaaatcatttgttcattcctttaacaagtatgtgtcgagtgcctactatgtgctgggcactgtaggttcaatggtaagaaaagcagatacaggc

SEQ ID NO: 1321 - DNA, 300 bp, Homo sapiens
gatgagttcttttctttctttccacctcctgcaaattatgtgatttgcataatttgtacatagttaggttcatttgttagtttgtattccttttggcttcccccatatcctcgttgactttttctttcttttgtaacttacatatgttatgaaatttatatgaggatatataattttcataaatgtttatggtttacatgtattagttgttattattaagatcaccctgggattgactggccaagcatttggtggaagatagcaataaataatacatcataaaagactttaatgtaaaaa

SEQ ID NO: 1322 - DNA, 300 bp, Homo sapiens
aagccaggagcgaggggactaacagcgcaccccctccaccagtgccgacggaaaccccgttttaaattaaaaaataagccagtatacatcgtagaaaatttctcttaaaaatctcacaatttgtaaatgtatattttttctttaacataaaagtttacaatataccgtaaaacaaaaggctcaggaaaataatttccaaaaaaaaggaagaaaaagaaacctgaagttttgaattaaagctgaagacatttttttaaaccctgttgttgaaccagtgacttttttttattgtgctgatgg

SEQ ID NO: 1323 - DNA, 231 bp, Homo sapiens
cctcccaggttcacgccattctcctgcctcagcctcctgagtagctgggactgcaggtgcccgccaccacacccggcttattttttgtatttttagtagaggtggggtttcactgttagccaggatggtctcgatctcttaacctcgtggtccacccgcctcggcctcccaaggtgctgggattacaggcgtgagccactgcgcctggccttgggttgttatactggggtc

SEQ ID NO: 1324 - DNA, 300 bp, Homo sapiens
gttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactgctgttgtcactccactctcctaggcgctgtcctgggctggctgatgactccccgagtgcct

SEQ ID NO: 1325 - DNA, 300 bp, Homo sapiens
  misc_feature 100, 103, 127, 128, 141, 151, 163, 169, 227, 259, 263, 265,283, 290, 296: n = A,T,C or G
gtgatcacaagggtcctttgctgtggaatagtgaggtggttgagtcagaggcagagtgatgcaatgactgaaagacttttccagccatctccggctttgnatncggaagtcggtcatgagccagggnntgcaggcaggctntgggagctgnaaaaagcaaganaatggnttctcccctggagcctccagaagggatgcggtcctgccaaccccttgtcagtgagccntttcagatttctgacttccaggactgtaaganaatnancttggcttgtcgaacggnttcaganttcaancact

SEQ ID NO: 1326 - DNA, 300 bp, Homo sapiens; identical to SEQ ID NO: 269

SEQ ID NO: 1327 - DNA, 300 bp, Homo sapiens
gggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcttctatttcatatatttctatgacattatatcttagatgtgtaa

SEQ ID NO: 1328 - DNA, 300 bp, Homo sapiens
caaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctccta

SEQ ID NO: 1329 - DNA, 300 bp, Homo sapiens
gtgaggctctcttaaaaaatttaaaaatactgaagaaacaaagggaggagtttgtagaatctggagtggaggaaacttctgtgtcaccaaacacagaaaccatcaaagaaaatctttcacttccaaaattagtctatagaaaaaaaaaagaaaatcttaacccaaataagagactgaggcaagagcttcaatcaatcgaggtttactgagccagagttggagcgtgcccaggaaagcaacacaagtcaaagaaacgtctgtggcctgtgctctcccaagaagttttcaggaggctcaata

SEQ ID NO: 1330 - DNA, 300 bp, Homo sapiens
cattaaatacacacaagacttcaattgctgggtcctccattgattaatgaaaaaatgattgtttttggaatttgagtgaaacacttcttaatggctgagtagggtggcttacgcctgtaatcccaccactttgggatcacttgaggccgggactttgagaccagcttggccaacatgaggaaagcacgtctttactaaaaatacaaaaattagctgggcctggtggctcatgcctgtaatcccagctacttgggagtctgaggcgagaggatcgcttgagcttgggaggtggaggttgca

SEQ ID NO: 1331 - DNA, 300 bp, Homo sapiens
gtctagtataatcttgatgctcaaaccagataaggacaatacaagaaaggaagagtataggctaattctacccaataactaaatgaagtattagcaaaccagattcatcaataatcttttaaaaatcaagaattaattggatttaggaatataacactgtgtataacaagtttaagagaaatatatgagaatgataagactgcaattgaaagtagaggctttctctggagggaaaggtgaggaggatgtgatttggaagaacagcatggggaggcatcagttgtattgtaatgtttattt

SEQ ID NO: 1332 - DNA, 271 bp, Homo sapiens
  misc_feature 3, 5, 7, 10, 13, 14, 22, 28, 31, 39, 65, 70, 71, 72, 73,74, 75: n = A,T,C or G
aancnangtnatnncaagggtnattggntgnggaatagngaggtggatgagtcagaggcagagtnatgcnnnnnntgaaagacttaaccagccatcaccggctttgaatacggaagacggtcatgagccagggaatgcaggcaggctctgggagctgaaaaaagcaagaaaatggattctcccctggagcctccagaagggatgcggtcctgccaaccccttgtcagtgagccatttcagatttctgacttccaggactgtaagaaaataa

SEQ ID NO: 1333 - DNA, 300 bp, Homo sapiens
aagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcatcttcaaagactagtacttacacagtttagaagatttcaaggtactgctgacagtagtttattatgtcagtatacatacgtgtagag

SEQ ID NO: 1334 - DNA, 275 bp, Homo sapiens
  misc_feature 197, 198, 199, 200, 201, 202, 203, 204, 205, 206, 207, 209,213, 215, 216, 221, 223, 225, 228, 233, 237, 239, 243, 249,252, 269, 272: n = A,T,C or G
gcactgtggcgctcacctgtaatcccaccattttgggaggctgaggcggaggaccacctgaggcaaggaattcagaaccactctgggcaacataatgacactaacaaagactatctctaatcaaggctagaaccaagggaaggctaataattgcccagtactgtgcatctactgaaagccctacccaaggccaccannnnnnnnnnncntctntnntatgncnantcngaaanaacngnaacnttcacnttnttgactgacgactgtcnacncat

SEQ ID NO: 1335 - DNA, 300 bp, Homo sapiens
tgatgccttagtcacttggccacacagttttgtggtttacgagtcatgggaattgcttgtcttactctgactgctaaagttctgtcctattgtcttttcatgtaatagcaacatgactctgatgacaaagcccaactaattacacaacttaatttaatagtttaaagcgcaaagggcattccctgagcagtaaaatcttttgtttggaaattttaaaacaaattatattttactttatgttttatatttacgtaataagtatttacaagaacacaattttctcaagatttaaactgctca

SEQ ID NO: 1336 - DNA, 300 bp, Homo sapiens
gtcaactctccttggtgagtgcctcagaacttaggaaaagagaacagcgcatgtctctctcatgaagatgacagaggacaaaagcaagcagaaatatacaaggatttgcgtactctattatgaatttctctttgagaaataatacctgtgagaatgctgctccttcaattaggttcaggattggaggaaaaatcatataaaataggttcctgcaataatattgccccttgagtatgggtgggcttgtgacctgctcagtgctaaggaaatgcagtggaaatgatgctgtgtaacttctga

SEQ ID NO: 1337 - DNA, 300 bp, Homo sapiens; identical to SEQ ID NO: 278

SEQ ID NO: 1338 - DNA, 300 bp, Homo sapiens
gtcactctgtcacccaggctggagtgcagtggtgtgatcatagctcactgcagcctctacctcctgacacaagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtattta

SEQ ID NO: 1339 - DNA, 300 bp, Homo sapiens
gaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcac

SEQ ID NO: 1340 - DNA, 300 bp, Homo sapiens
gttatgaaaaattattcccaggtcctaagttccactctaggaacttctaacattgccaccttgatttcagaattatgtgcaccaataactatgttgttcctctcattttttccacttttgagcaagaaggtcacatggcagttaccctctgcctgtcctaccattgtcttttgggtatgtgttgggcaggtaatttgtctcttaagttccagaaacgagattgagagaagcaatatatattcaaggagcagcatttaaggaactacctacacccaggaaatttcatctgtacctgcacct

SEQ ID NO: 1341 - DNA, 300 bp, Homo sapiens
gtcacatcttaaatggatggtggcagacaaaaagagagagcttatttagggaaactctgtttttaaaaccatcagatctcatgcaacttattcaccatcacaagaacagcagggcacagacccatccccatgattcaatcatttcctactgggtttcttccacagcatgtaggaattatgggagctacaagatgagatttgggtggagacacagagccaaaacacatcagatgccatggaaatacaatgaggaaaagacagtctttccaataaactgtgctgggaaacctggctatccat

SEQ ID NO: 1342 - DNA, 300 bp, Homo sapiens; identical to SEQ ID NO: 282

SEQ ID NO: 1343 - DNA, 300 bp, Homo sapiens
cttaacagagaaggtacctgaggctcaaaaaggatgactgacagtcctagtggcagaatggaggtgggatctggaacccacaacttgattcctaggactctttttttttaattcccacattggctgggtgtggtggctcacgcctgtaatcccagcactttgggaggctgaggtgggtggatcacctaaggtcaggagttccagaccagcctgaccaacatggtgaaaccccgtctgtactaaaaatacaaaaattagccaggcatggtggcccatttcctgtaatcccagctactcagg

SEQ ID NO: 1344 - DNA, 300 bp, Homo sapiens
gggctgaccttaagataaggagatgatcctggattatctgggtggacccaatgtaatcacaagggtccttaactgtggaatagtgaggtggctgagtcagaggcagagtgatgcaatgactgaaagacttaaccagccatcaccggctttgaatacggaagacggtcatgagccagggaatgcaggcaggctctgggagctgaaaaaagcaagaaaatggattctcccctggagcctccagaagggatgcggtcctgccaaccccttgtcagtgagccatttcagatttctgacttccag

SEQ ID NO: 1345 - DNA, 300 bp, Homo sapiens
ctgagatctgcttttactgaagtggatcaatgatgaaactagccaaatctgagcatcagaaggctttccggtctacctgatgcatgatctctacagttctgagaagcagaactataaaacaatgtaaaacaataagggcatatgtctggtgtgtgtgtggggggtgtgtgtgtgtgtgcacccacacgtgtttataaaggtagcagttgtaggaatgaatgagattgggggtgagggggtgcatatgtatgtctatgaaagcctaatcatttctgggcaatgatgtaaaggttttacgac

SEQ ID NO: 1346 - DNA, 260 bp, Homo sapiens
  misc_feature 160, 161, 162, 163, 164, 165, 166, 167, 168, 169, 170, 171,172, 173, 174, 175, 176, 177, 216, 232, 233, 245, 246, 249,251, 254, 255, 257, 258: n = A,T,C or G
caccatcgaatatttttatttattttgagagacagactctgtcacccaggctagtcttaaactgttggtgaatcttaagtgattctcccacctcagcctcccaaagtgctgggattacaggcatgagccactacccttggctgtgatcaagtatttagtnnnnnnnnnnnnnnnnnntaaatagtctgaagtagagaaaatagcacccaatctaanataaggtgaggtctanncacttatttaannctncnttnntnnct

SEQ ID NO: 1347 - DNA, 294 bp, Homo sapiens
  misc_feature 228, 229, 230, 231, 232, 233, 234, 235, 236, 248, 253, 259,262, 266, 271, 274, 276, 283: n = A,T,C or G
gctatgctaaacagcctttacatgtatggtctggttaaagttcctttgttccttttgttttaataaaatgtgtcactgattttttagctcaaaatcatcactgttaatttccagtcaccccaaatatggttaaaagatttttttttttaatcatgaagagaaaattagtagcatttctttctctccccattatttattggttttcctcactaatctttttttttttannnnnnnnnccaaaaatattnatctnggtttnacntttnaattnccntncttaatnggaattttttt

SEQ ID NO: 1348 - DNA, 300 bp, Homo sapiens
cagaacttcacagcagcctgtcctcatcagcaacccaaccaccttcatcagcaacccaaccaccttcatcagcaacccaaccacctcgtcagcaacccaaccacctcgtcagcaacccagccaccttcatcagcaacccaaccacctcatcagcaacccagccaccttcatcagcaacccaaccacctcatcagcaaaccaaccactttcatctgcaacccaaccactttcatcagcaactcaacaccttcatctgcgcccaaccaccttcatcagcaaaccaaccaccttcttcagcaa

SEQ ID NO: 1349 - DNA, 300 bp, Homo sapiens
gcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgcagccagggactaggc

SEQ ID NO: 1350 - DNA, 276 bp, Homo sapiens
  misc_feature 7, 9, 12, 15, 24, 27, 30, 31, 35, 57, 62, 65, 76, 133, 138,144, 147, 153, 159, 164, 186, 190, 196, 197, 198, 199, 200,201, 202, 203, 204, 205, 206, 207: n = A,T,C or G
ccaagtntncancanccaccaaanggnttnnccgnatgtggtccttatacacaatanagtgntantcatccatacnaaaagaatgagatcctatcatttgcaataacatggatgaaactaaaagtcattgtgntatgngaaatnagncaggcncagaangtcanaatatcacgtgttgtctcctcntctntaggannnnnnnnnnnnaagccatctgaactgacagagatggagaatggaaggatggttaccagaagttggtggggaagggggaag

SEQ ID NO: 1351 - DNA, 300 bp, Homo sapiens
aaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatc

SEQ ID NO: 1352 - DNA, 300 bp, Homo sapiens
tgaagccaggaaagggggtgggctagggggtgctgttttaggtagagtgatgggaacagccccactgagcaaactttagccacatgagtagctggaagaaaagccttctaggaccagggaacagcaagtgcaacagccctgagacaggatgggcttgtcagtttgaggagcagtgggaggcctgaaccaggttacatggggcccagccagtatggccacgactttgtgttttatccagagtacaaaggagcctcactgagggacaagggaagtggcatgatgtgacccgcatattaagag

SEQ ID NO: 1353 - DNA, 300 bp, Homo sapiens
gcctgggaaagcgtggcgcccatgaatatccgcaggagcacgcatgacctgggggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcctcccacatg

SEQ ID NO: 1354 - DNA, 300 bp, Homo sapiens
tgcaacatcactgatatcagcatcctttaaaatattatctgcttcttgttctaagagcaacaaagctgggaattccttatagagttattcacaatgcctccataatgaatgctgtaggctgctgtggtttacagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttg

SEQ ID NO: 1355 - DNA, 300 bp, Homo sapiens
gtatcacctgagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacatttt

SEQ ID NO: 1356 - DNA, 300 bp, Homo sapiens
gggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttact

SEQ ID NO: 1357 - DNA, 300 bp, Homo sapiens
cgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaagggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcga

SEQ ID NO: 1358 - DNA, 290 bp, Homo sapiens
  misc_feature 261, 262, 263, 264, 265, 266, 267, 268, 269, 272, 275, 282,284: n = A,T,C or G
agtatgagaagggaggatgggggagaatctgattaaaaaaaatgattcattccttcacagacactaacaaacatggctaaaaagcacatgtcagaacacagaagcctaggtagatggttgacatttttataacttccttaagtgagtagttaaaccagcagtcttaattctgttggtcttccaagagtgtttaattacataagtattacctgtattcatttcccacaactgttgggtttttctttcttttttttttttttnnnnnnnnnctnccnaaaaaancncccggg

SEQ ID NO: 1359 - DNA, 300 bp, Homo sapiens
  misc_feature 2, 11: n = A,T,C or G
anaaggcgcangaagcagaagcgcagagcgaggacgacgacgaggatacagaagaggaacagggggaagaaaaggaaaagggagcgcaggagaaaaggagggggaagagagtccgttttgcataagatgaagaatagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaaca

SEQ ID NO: 1360 - DNA, 300 bp, Homo sapiens
gctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttcca

SEQ ID NO: 1361 - DNA, 300 bp, Homo sapiens
ggaaccatgagaaccgaagctagaattgctattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcct

SEQ ID NO: 1362 - DNA, 214 bp, Homo sapiens
ctcagacaaagaaaccattgaaattatagacctagcaaaaagagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaa

SEQ ID NO: 1363 - DNA, 300 bp, Homo sapiens; identical to SEQ ID NO: 300

SEQ ID NO: 1364 - DNA, 300 bp, Homo sapiens
caccgccaggccagctgtcaggaaacaggggctctaggcccagcttcaccacttaggagctatggctttgttcagaaacattgtgactctcttacccacacattcctctgctggaaggggagattgacaaaccagcatcatctctaatttactacaaaagccctcactggaaattattcttaacttagcagctggtaggatccattaaaaaaaaaagtaagttagactgtgttactctgctgctcaaagccctgcagtgcctcctcattttacctagcgtaaaacctaaagtcctttcca

SEQ ID NO: 1365 - DNA, 270 bp, Homo sapiens
  misc_feature 221, 240, 241, 247, 253, 254, 256, 258, 259, 261, 262, 266,268, 269: n = A,T,C or G
cacagttctgcatggctggggaggcctcacaatcatggtggaaggcaaggaggtgcaaaagcatgtctcacatagtggcaaggcaggagagagcatgtgcaggggagctcccatttataaaaccatcagatctcatgagacttagtcactaccacgagaacagtatggggggaaccatccccatgattcagttatctgcacctggccccacccttgacacntgggaattattccaatgcnnggtganatttgnntngnnanntttncnna

SEQ ID NO: 1366 - DNA, 300 bp, Homo sapiens
attgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatg

SEQ ID NO: 1367 - DNA, 300 bp, Homo sapiens
tgaagaatggcgtgggttggttcctttcaaatgcacttgagcagcggtctccaaccacagggccacagagctggaggtgagcagcaggcgagtgaagggaaacttcatctgtatttctagcccctcccatcgcttgcatgaccacctgagctccatgtcctgtcagatcagcagcagcattagattctcacaggagcacaaactctgttgtgaagtgtgcatgcgagggatctaggttgtgtactccttatgagaatctaatgcctgatattctgttactgtctcccatcaccccagatg

SEQ ID NO: 1368 - DNA, 300 bp, Homo sapiens
caagaagagttttctgttcagtttggaacaagattttgagaagacatttaggatgtactagtttgagtttttaaatgtatatttgagatattttctcaactttctctttgggtctgtagctaaaatatgcagtataatgttatatttatttattttttaagagatggggtctagctattttgcccaggcagactcaaattcctgggctcaagtgatcctctgccttggcctcctgagtagctgggacttacagacatgtgccaccaaacctagtggctatataatttttaaaaatattct

SEQ ID NO: 1369 - DNA, 300 bp, Homo sapiens
gccacacgggcccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctgg

SEQ ID NO: 1370 - DNA, 300 bp, Homo sapiens
ttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagtt

SEQ ID NO: 1371 - DNA, 300 bp, Homo sapiens
atccagagaaatgatgtgccttgtgtaaagttgtggttaggaagggacagagccaggactctaaattctgtcctccggccataattccaaaactttctccaatgttaggtatgtaggctaaaatgtgctaacagcacttgtgtttttgtttccttttgttttactttttattatggcaaatttcaaacatatacagatacagaatagtttaatgaactcccatgttctcatcatgccagttcaaacatgaatacatggtcaaccttgtatcacttaaactcttgcacacaagccctgccc

SEQ ID NO: 1372 - DNA, 296 bp, Homo sapiens
  misc_feature 185, 186, 187, 188, 189, 191, 199, 211, 214, 217, 223, 227,231, 232, 236, 238, 242, 243, 249, 250, 252, 255, 266, 269,274, 277, 283, 285, 288, 289, 290: n = A,T,C or G
gtaagttatttgttaagttagaaccctcagtgcatggtctagggatctctggaggtccccaggaccctttcagagaagccatgaggtcaaaactgttttcataagcagaaccaaaacattatttgactttttcaatgcattggcatttgcattgatggtacaaaagcaaggatgagtaaaatggnnnnntncttagcgngatcaagatggnaanaantgcacnaganaacnntgtntncttnnctgcanngngcnttttaagactnccnattcnaantaaganancannnacggcc

SEQ ID NO: 1373 - DNA, 300 bp, Homo sapiens
aaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttg

SEQ ID NO: 1374 - DNA, 300 bp, Homo sapiens; identical to SEQ ID NO: 304

SEQ ID NO: 1375 - DNA, 300 bp, Homo sapiens
cttagattctacctgtaacattttataaaacttgctttataacacagatatctatcaatctcatctttaaatttaattttttttttgcaacagagcaaaacccagtctccaaaaaaaagaaaaaggaaaaagaaatgtatttaaattatccatgcttttagctatttacttatgagcctttataacagattcttcatagtctgccttctatactcccagggtgatggtctggggaagggggagctaggacctgtctttcctttggtcttatcaccacctcttccaggggctgctccttcc

SEQ ID NO: 1376 - DNA, 300 bp, Homo sapiens; identical to SEQ ID NO: 305

SEQ ID NO: 1377 - DNA, 300 bp, Homo sapiens
gattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttgg

SEQ ID NO: 1378 - DNA, 300 bp, Homo sapiens
gcctggcctaaatgaagtaccacatgaccgaccgaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacagtgagctgtgatcgtgccactgcactccatcctgggtggcagagtgaggccctgtctcaaaataaataatccagtcccccccaagaaaggaatgaagtgctataatgagaaaaatccta

SEQ ID NO: 1379 - DNA, 300 bp, Homo sapiens
tggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggca

SEQ ID NO: 1380 - DNA, 300 bp, Homo sapiens
agtgcacgcagcccgagcccacgggcgactgacagctctgcaggagagatttcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataa

SEQ ID NO: 1381 - DNA, 267 bp, Homo sapiens
tttacattttgtttgaatcaggatccaaataaggtttaaatattgcaatttgattaatacattaagattcttttaatctataagttcctgctccatctgtcattttatttttatcccttgaaatttatttattgaagaaactatatcctttgctttgtaaaattttccacagtgtggctggctttggctgattgctagcgtcatttgctatttatttttgtcctgtatcttggatctggcgccttgatcagatttaagttgattttt

SEQ ID NO: 1382 - DNA, 300 bp, Homo sapiens
ggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggttggggctctcgtcgttggccttgtagatcaagtaggggaagtgagtgatgttcagtcacgctgctgggacacttggatttccag

SEQ ID NO: 1383 - DNA, 300 bp, Homo sapiens
accagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttccctctttctaatgtttaaatcccataaagctaagtttcccgttaaagggaagtgctttgaagatgtgtacccatttttgtaagttaatcatgattatcctggaaaaagaagaaaagagcttcttctttgcagaga

SEQ ID NO: 1384 - DNA, 297 bp, Homo sapiens
  misc_feature 2, 3, 35, 39, 48, 111: n = A,T,C or G
gnnctatagaatacaagctacttgttctttttgcnggancccatcgantcggaattatagtattgacgtgaatcccactgtggtatagattccataatatgcttgaatatnatgatatggccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattg

SEQ ID NO: 1385 - DNA, 300 bp, Homo sapiens
aatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcccttgaagatacagtttttgaggcttcttcaga

SEQ ID NO: 1386 - DNA, 300 bp, Homo sapiens
gactgtgtgtgctggtgtgtgtgtgagttctacgtttctaccatatgtgatcagtttaatagtaactttatttatttaaaaaaaagaaacacaattagttactgttaaactgataaagggtgtttatttttaccttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgctta

SEQ ID NO: 1387 - DNA, 300 bp, Homo sapiens
ccagagctggcagaagaaaacagtaaagcttagagtagaaataaatgaaataaagaacagagaaatatagaaaatcaaaaataccaaaagttggctctttgaaaagatcaacaaaattgccaacccttttaagtagacaagaaagaatgaattgttggtggtgcagtggtgagcatagctgcttttcaagaacaaaaaagactcaaatgactaaaatcaagaatgatcaagaatgagagagtagacattactacagatcttacagaaatgaaaggattattaatgagtactgtgaacagt

SEQ ID NO: 1388 - DNA, 300 bp, Homo sapiens
gtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagca

SEQ ID NO: 1389 - DNA, 300 bp, Homo sapiens
taagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattca

SEQ ID NO: 1390 - DNA, 298 bp, Homo sapiens
  misc_feature 264, 265, 266, 267, 268, 269, 270, 271, 274, 277, 279, 291: n = A,T,C or G
gaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatacctaattcgaattacaaaacttacactaaagcgacagaggaaacttgttcctttgagtaacgaaggtggagcgtagannnnnnnnganganangaaaaggccttnttagctg

SEQ ID NO: 1391 - DNA, 300 bp, Homo sapiens
agtaaatgataattgtgccactgcattctcacctgggtgggtgacaaagcaagaccctgtctccaaatatatgtatgtatgtgtatatatatatatgcacacacacacacatatacacacatatatatattctgaatatatatattcgtgactccccgaaataaattcagtttatatatatgtaaataaattctgaagactctacatgtgtgtgtatatatacacatatatttttgtattaacgttaatagtaatattaacatgagttcagggtattagccagttctgtctttcgggatg

SEQ ID NO: 1392 - DNA, 300 bp, Homo sapiens
atcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaag

SEQ ID NO: 1393 - DNA, 300 bp, Homo sapiens
tctccttgcctttctcctgaaaggtatgagactacttgccttactgtcatattattgagggaatcagcgcaaagcctgaggaaatgaacagtagctgtgggtcaaagccatgtctccaggttcacggctcactcccccaggacaagcctagttaggtagtggctgcatctggtatccctgggacagaaatgcaggtgagagggggtatcaagaatgcctcgagcctctagaactatagtgagtcgtattacgtagatccagacatgataagatacattgatgagtttggacaaaccacaa

SEQ ID NO: 1394 - DNA, 300 bp, Homo sapiens
gaaccaagaaaatatttaaaaatctaagcagtcctttgctcattaaaggataaatcagtagttaacactttttctacaaagaaatggtgtgcctggatggtcgtgtaggtgagttttaccaaggattatggtaacaaatgagtgagacctctatggagaaaatattgaaggacattaaagaagacctcataaatggagagagatatatcattaatggataggaagcctcaatggcataagtatgtcagtttctttcaaaactcacctatggattcaatgtgattccaaaccaaatcccaa

SEQ ID NO: 1395 - DNA, 300 bp, Homo sapiens
gctacttgttctttttgcaggatcccatcgattcgaattcggcacgaggtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagag

SEQ ID NO: 1396 - DNA, 300 bp, Homo sapiens
  misc_feature 21, 24, 26, 36, 38, 45, 55, 56, 61, 72, 74, 77, 79, 89, 95,97, 100, 102, 103, 108, 113, 115, 116, 120, 138, 141, 147,151, 153, 157, 166, 169, 172, 181, 185, 190, 192, 197, 198,202, 204, 206, 207, 214, 216, 225, 227, 229, 253, 260: n = A,T,C or G
  misc_feature 262, 265, 266, 267, 268, 277, 290: n = A,T,C or G
cgcaaactggctaatctctgntananaactatgatntncgccatnatgttgatannagggnccttagggggnanatngnaaaaaacctntgaccnangcncnnatgantcaangnnttgntactccacgtgtaatgcntcncaaacnttgncntatngctctgaanacnctncgcgaccangaanaatananaagannctgnanannatgctananttttggccnananaatgaacgaggctaaagagattcncctggancnaannnntgaatagantcatactttcctntctgctagct

SEQ ID NO: 1397 - DNA, 297 bp, Homo sapiens
  misc_feature 83, 84, 85, 86, 87, 88, 89, 90, 91, 96, 104, 107, 110, 112,114, 127, 128, 132, 139, 143, 145, 153, 155, 167, 170, 177,188, 192, 200, 205, 209, 210, 213, 221, 223, 226, 227, 236,238, 244, 254, 255, 260, 266, 268, 278, 290, 291: n = A,T,C or G
aggaagttgaagctgcaatgggctatgatcgtgccactgcaccccagcttgggccacagagcaagagcctgtctcaggaaaannnnnnnnnaaaantccaaaantanttngnangttccaaattgcnngccnttctganaaangnaatacgancnaatcttccaccntcntactccntcccacctaanatgngaaccctntttgnccannggntccaaacngnatnngctacttgngngttagnaatcaaccanngatancagggnancttttaacgnaggagtgctttnntgggta

SEQ ID NO: 1398 - DNA, 300 bp, Homo sapiens
ttattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttatccagatgaaaacacataa

SEQ ID NO: 1399 - DNA, 273 bp, Homo sapiens
  misc_feature 231, 233, 237, 238, 239, 245, 248, 250, 251, 255, 256, 261,264, 267, 269, 270, 271, 272: n = A,T,C or G
ctctatcttgtttattgttgatgccatcttagaggaaaaaatgtaaaggtaagtaattaagcatatgacagcaacaaataagatacttataacctaatgggactttattttgtagttttatgtattacaaaaaatccacctttctctaagggaagtttgtaccccattgattcttggtgcctttgggatcgactgggttttaatggcctagttatttgaggattttgctgngntgtnnncatggnctntnngatnnccttnganganannnnc

SEQ ID NO: 1400 - DNA, 300 bp, Homo sapiens
gtgccatcttgctatgtttcccaggctggttttgaactcccagcctcaagcaatcctccctttccgcctcagcctcccaagtggctggggttatgggcctgagccactacacagctaagagtgtcttgtatgtgctaatgagatggctggtgtctgagagcccctagagagcttcaagatgggggctagtctttagaaagtccaagcaatggctaggtatggtggccactgcctgtaatcccaggagtttgggaggccaaggtggacagatcacctaggagtttgagaccagcctggcca

SEQ ID NO: 1401 - DNA, 300 bp, Homo sapiens
ttctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggg

SEQ ID NO: 1402 - DNA, 300 bp, Homo sapiens
gtactccaggttgtgtttgtgaatcaagatgaacagcccgttcaaggccaagaggctgagggcccccccgaggtcgcaggcgcgggtgaggaagtcgatcatgagcgtgggctgcgccagctgcggcaggatggcgtcatgcacaatcagcagcaccttcttgtagaggctgaggggcagcttgtgcttgaggaagctgagccacatggcctggaaaaccctcctgtgctccttcaggtgagcaacctctcgtgccgaattcgaatcgatgggatcctgcaaaaagaacaagtagcttgt

SEQ ID NO: 1403 - DNA, 300 bp, Homo sapiens
gaaaacatctaactaagatggtttcactggtgaattcaatcaaatatttaaggaacacataataccaaaaccataacacatacaaatatatggcccttcagattttgtacttctttttgtgtcagtgttaataatacgtatctttcaaagaatatccccctttttttttggtagagatagggttttgccatgttgttggtagcaagccctaaccctgtcataaacaggccttaaataaactggccataaacaggatttctgcagcaatgggacatgctcatgatggctgtcatgcacact

SEQ ID NO: 1404 - DNA, 300 bp, Homo sapiens
acactgtcccactccatcacccaggctggagtccagtggtgtgatcatagctcgctgcatcctccagttcctgggttcaagccatccctcctgcctcagcctccccagtagctggaactacaggtgtgtgccatcacacctggctttacatttttctgtggggtcttactatgttgcccaggccggtctcaaactcctgagctcaagtgatcctctgcctcagcctccagagtatctgggattacatatgtcggctaccgtgtctggccgttcacatctttggccactatttgcttgtga

SEQ ID NO: 1405 - DNA, 300 bp, Homo sapiens
aatgagaaagaaggaggaatctgaagccttgggtaaggatttggggcacagtaccaggaggggggcttggtgccagacctcatgaggaagaaggattttcctatgtacagagaaggggaccctgtcctgttgggaggtgctgtgcaaacctaaccaagttactaacccctctgttttatgtgctacacaaaggggataaatacaagcttccctctctagccaattctatttggttcctgagtttggaaaagtgatagatactgattttctatgattttatgaggacttaaataagctcct

SEQ ID NO: 1406 - DNA, 300 bp, Homo sapiens
ggaggacgaggaggaggacgacgaagaggaggaggaggaaaaggaggtggaggagcagcagcagcagctgcagcagctaatatgttgtacttattctgtgctgggcaaaattctggatatttttcatgtactatttaagcctcacaaaaatcttatgatataggaaatgcttgtttccatttggcacatgaagaaactgaagaacagagaaatgatgaaacttgcgcagggtagtctgtccagagtctgtattttaactactgctgtgttgcctcccattgcatagtgacttcacgtgta

SEQ ID NO: 1407 - DNA, 300 bp, Homo sapiens
gcctattcagttcctggtaagggctgtcttcctggcttgcagttgaactacttcttgctgtgtcttcacaagcatgcccccatcctgtgccgataagaactccagaccccaaactcagctcatacacacacggaagagagaagcatctgaacatcaagaagagaagaagctgctggacatcagaaactgtgaaaggagaggagtttggctgagctccaggggaagactgcctgcacattctatccccttttcagttccccatcctgctgtcagccacatttaccactcaataaaatcttc

SEQ ID NO: 1408 - DNA, 299 bp, Homo sapiens
  misc_feature 132, 133, 134, 135, 136, 137, 138, 172, 175: n = A,T,C or G
gagaagccaagggagaggaggaggaggaaactaacgattccctgcccacccccacacccagcaccaccaacaggtgggcaagcttgccgagaaaacgcagagggcatcctgtgagcagcaaacactctgagnnnnnnnaagacgcagagaagtaaagatcaaagcgctactncangatcccgtaccagactcaagccatggctggtcccttctccgtctgctgtccgcccgcccggactcagcttctggttttggccgagcgggtcttacccgtgggtttctgctccgacggaacctgt

SEQ ID NO: 1409 - DNA, 300 bp, Homo sapiens
cttgagcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcacttgaggtcaggagttcaagaccagcctggccaacatggcaaaacccagtctctactgaatgaaaatacaaaaattagctggcctagcagttggtggtggcaggtgcctgtagtcccagctacttgggaggctgaggcag

SEQ ID NO: 1410 - DNA, 300 bp, Homo sapiens
attttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatata

SEQ ID NO: 1411 - DNA, 300 bp, Homo sapiens
tcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttttccagatgaaaacacataaataa

SEQ ID NO: 1412 - DNA, 300 bp, Homo sapiens
  misc_feature 14, 25: n = A,T,C or G
gctcttgttctttntgcaggatccntcgattcgtttaaggaaaaccagcaaataacaagaaaaccatttaatgtaaagatttgtaaataatcacttcaaaagaagtgccttgttgctgtcacatttagtccatcttcatataattcttatctgggccagtttcttgggcatgggacatgtgcagttacacaagcctgtgctcttaagagggtcttacccatagtttaatgttctgctgttgtagtcttgaaattcttaatgatttaacaaggggtcctccattttcattttgcactgggc

SEQ ID NO: 1413 - DNA, 300 bp, Homo sapiens
aagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttc

SEQ ID NO: 1414 - DNA, 300 bp, Homo sapiens
cccaggatgaactggttgcagtggctgctgctgctgcgggggcgctgagaggacacgagctctatgcctttccggctgctcatcccgctcggcctcctgtgtgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaatt

SEQ ID NO: 1415 - DNA, 300 bp, Homo sapiens
gttgctttcaaaagacacatatcaccatagtacatgtaataacacacataggctcaaagtaaaggggtggcgaaagatctgttatgcagatggaaaaaaagatcaggggtcactattcttgtatcagataaaacagactttttaaatcaacaacagtagaaaaaggactagggcattacataatgaagaagggttcaattcaacaagatttatcctatacacacccaagattggagcactcagatttctaaaactattatttctagacctaggaaaagaattaaacggccacataataat

SEQ ID NO: 1416 - DNA, 300 bp, Homo sapiens; identical to SEQ ID NO: 321

SEQ ID NO: 1417 - DNA, 300 bp, Homo sapiens
  misc_feature 152, 153, 154, 155, 156, 157, 158, 159, 160, 161, 164, 169,171, 175, 182, 184, 201, 205, 206, 209, 211, 218, 228, 229,230, 231, 235, 237, 264, 267, 269, 283, 291, 293: n = A,T,C or G
ggctgcgaggttttcggctttggctcctgatatgcagcgacagaattttcggcccccaactcctccttaccctggtccgggtggaggaggttggggtagcggaagcagcttccggggaaccccgggcgggggcggaccactgccgacctctnnnnnnnnnnggnacggnantacnaataacncnccaccgtacgcgccctnatcnnggncntaccgtnccaggtgctnnnnaagntncaccaggccctaaccggggttctggcngancncaatggccctgaangacgccgncnagcaccg

SEQ ID NO: 1418 - DNA, 300 bp, Homo sapiens; identical to SEQ ID NO: 323

SEQ ID NO: 1419 - DNA, 300 bp, Homo sapiens
gtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgt

SEQ ID NO: 1420 - DNA, 300 bp, Homo sapiens
aagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgt

SEQ ID NO: 1421 - DNA, 300 bp, Homo sapiens
  misc_feature 122, 123, 124, 125, 126, 127, 128, 129, 130, 131, 132, 133,134, 135, 145, 165, 181, 204, 211, 230, 237, 242, 245, 251,268, 273, 280, 282, 284: n = A,T,C or G
actcgagacgctgaggcaggagaatcgcttgaacccgggaggcggaggttgtagtgagctgagatcgtgccactgcaccccagcttgggcaacagagcaaaactctgtctttaaaaaaaaannnnnnnnnnnnnnaacaaacaancaaaaaaaaccttatatggnctgggctgggcgtggngccttatgcccacaatcccagcnttttggnaggccaggatgggaggatnacttgancccanaantttganaccagcctgggctacanagtanggccccntntntacaaaaaaaccttaa

SEQ ID NO: 1422 - DNA, 300 bp, Homo sapiens; identical to SEQ ID NO: 327

SEQ ID NO: 1423 - DNA, 300 bp, Homo sapiens
  misc_feature 211, 212, 213, 214, 215, 216, 217, 218, 219, 220, 229, 230,235, 238, 248, 249, 250, 252, 253, 260, 261, 266, 279, 292: n = A,T,C or G
ggcagaccatccacatcagtttcagagaaaaacaataatcttgtttgtgccgtgatgaagaggactgacagctagcagcagaaacaatagtcacggaggttgagaacaggctggttaacatggtgaaatgccatctctattaagaatacaaaaattagctaggtatggtcgcagacacctgtaatcccagctccttgggaggctgaggtgnnnnnnnnnnttgaacccnngaggnggnagctgctgtnnncnngactcgnnatatnactgcacctgggngactgcagtgaanctttatct

SEQ ID NO: 1424 - DNA, 300 bp, Homo sapiens
atacactgcatttgctggtgctgtttttatatagtgaagcaacagctgtacagcaaaataataaaatactcacttcttcgttaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccaaaaggctccgcctcc

SEQ ID NO: 1425 - DNA, 283 bp, Homo sapiens
  misc_feature 111, 112, 113, 114, 115, 116, 117, 118, 119, 120, 121, 122,123, 124, 125, 126, 127, 128, 129, 131, 134, 136, 137, 139,145, 154, 155, 157, 158, 161, 163, 164, 170, 172, 173, 176,178, 179, 183, 184, 186, 187, 192, 199, 201, 206, 208: n = A,T,C or G
  misc_feature 209, 212, 214, 220, 225, 229, 232, 233, 234, 238, 239, 242,244, 245, 249, 253, 255, 256, 260, 262, 266, 268, 269, 276: n = A,T,C or G
gtcctaaagccgctgaagcaaaaaccatgataaaacattctgctttcttttcttttacaaccccacgaacgcaaaaaaaaaaaaaaccaaaaccaaaccaaaaaaaaaaannnnnnnnnnnnnnnnnnntnttngnngnaaaaangggttttgnncnnggnannaaccantnnaantnnaaanntnncaaanaggggtnanctttntnnctnancttttnaaaangttnatnnnaatnnccngnnaaanccancnnggtntngccntnnaaaggtnacctaaa

SEQ ID NO: 1426 - DNA, 283 bp, Homo sapiens
  misc_feature 7, 14, 19, 21, 22, 23, 37, 39, 41, 49, 51, 53, 59, 61, 62,66, 68, 70, 71, 82, 91, 92, 96, 97, 99, 105, 106, 107, 108,110, 111, 117, 118, 124, 125, 134, 136, 138, 140, 145, 149,161, 163, 165, 166, 167, 168, 169, 170, 171, 172, 173: n = A,T,C or G
cccaacnatagccntttcnannnttaaaggtttttgnantnctgggccntncngacgtnanncctnancnnttttttaagcnggtttgccnngggnncnggtggnnnntnnggggtnnttggtnnctgggggcnanancnacttncctnccccgggccatncntnnnnnnnnntgtaggaaagttcttcacttttttctctgagggctgggggttgggggagtcagcatgattatattttaatgtagaaaatgtgacatctggatataaaatgaaaataaatg

SEQ ID NO: 1427 - DNA, 300 bp, Homo sapiens
gtcgtctttaatttgtctcatcagtgcctccatgtgtttttgatgcctttgaactggtatttttaaaatttcaatttctaattgttcattatagaaacacaattgggttttatatattggcattgtattttgcaactttcctaaactcactagtaattctagtagctttttttggtagattcttaaggattttctgtgtaaatagtcatgtcatttgtgaataaagccatttttttttccttttcaaattttgtgccttttatttcttattcttaccatatcacattggcaaagacctcc

SEQ ID NO: 1428 - DNA, 300 bp, Homo sapiens
aaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatgaaaaaaaggtaagac

SEQ ID NO: 1429 - DNA, 300 bp, Homo sapiens
  misc_feature 288, 289, 290: n = A,T,C or G
gtccagaaatactctgatactagctatggtcagcaacatttaatgaaaacccttatgttaaaaataaacccctgcctcctggcttcaagcgattctcctgcctcagcctcctgagtagctgggagtataggcacgtaccaccacacccagctaattttttgtatttttactagagatgggtttcacagtgttagccaggatggtttcgatctcctgacctcatgatccgaccgcctaggcctcccagagtgctgagattacaggcgtgagtcactgtgcccggcctcnnnatgttaggaa

SEQ ID NO: 1430 - DNA, 300 bp, Homo sapiens
caagggcctctggatggaatgtgccacacacagcacaggcatcacccagtgtgacatctatagcacccttctgggcctgcccgctgacatccaggctgcccaggccatgatggtgacatccagtgcaatctcctccctggcctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatggaggac

SEQ ID NO: 1431 - DNA, 300 bp, Homo sapiens
ggactaacttacagaggagctgtgtatcctgaagattcagcgactggcaaggaatttccttgggagcaatgtgtgagggaggccatctgaggagatctgtggctttcttttgttgtgggaatctggcttatggatgaatctacgacacaggattgtgaaattacagctctttgggaacaaaaggaaggcagtattgcatgacttagtttcccagcttcactttccctttggcatggtgagtttggggtcttgagagtctattttctttcacacccatcagcactgttaagtaagcaggaa

SEQ ID NO: 1432 - DNA, 300 bp, Homo sapiens
aaaaacctgggtatgtatctagaagtggaaaaacaaaaaaaggaaataagttatgaaaataaaaaccatgtcttgagctgggtgcgctggtgtgtgcctatatccctagattctcaagaggttgagacaggaggatcacttgagcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcact

SEQ ID NO: 1433 - DNA, 300 bp, Homo sapiens; identical to SEQ ID NO: 333

SEQ ID NO: 1434 - DNA, 300 bp, Homo sapiens
ggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtg

SEQ ID NO: 1435 - DNA, 300 bp, Homo sapiens
gagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcat

SEQ ID NO: 1436 - DNA, 275 bp, Homo sapiens
  misc_feature 43, 44, 45, 46, 47, 48, 49, 50, 51, 52, 53, 68, 74, 84, 98,102, 111, 114, 120, 121, 131, 136, 141, 142, 143, 144, 145,151, 160, 165, 168, 169, 187, 191, 196, 204, 207, 224, 228,231, 232, 239, 246, 253, 258, 259: n = A,T,C or G
gaaatgtgtatttcagtgacaatttcgtggtctttttagaggnnnnnnnnnnnatatccttggctttntaggcnatatgctcanagtgcgacagcggnaccntgccctcanatncttacnnaagctttgantaggnccatnnnnngctacntccctgaantcctnccnnccctcactggctgccctnacangccanctgacgantgnccttaaaggcattaacncgcntcnnttgtggngtcctcnggcttanggagnnaagaggtggctcttga

SEQ ID NO: 1437 - DNA, 300 bp, Homo sapiens
tgacattgtcagtgtgaaatttaacagactttggttttaggagttaggtttaggttgcagacctaaagttgcagttgacatgtccttgttttataggaggatatacatcctgaaagttttagggactggcaaagaatttactgctgagcaatttgtgattgcagtcacctggagattcatgaggctttttgcctttttgtggggatctggttaatgcataatattttgacacaaggttgcaaggtaacaggtatccatttgggaaaagaatgacagttttggagaacattagttctgcag

SEQ ID NO: 1438 - DNA, 300 bp, Homo sapiens
  misc_feature 34, 38, 59, 79, 106, 124, 130: n = A,T,C or G
acctaagactgctttgaaacataaagtaataatnaaanaaatgggctgggtgtggtggnttatgcttataatcctagcnctttgggaggctgaggcgggaggatcntttgagctcaggagtttnagaccngtttgggcggtcccagttatcaggaggctgaggtgagagggattacttgtgcccaggaggtcaaggctgcagtgagctgtgattgtgccactgtactccagccctggcaacagagagagaaccctgtctcaaaagaaagggggggggaggaacggaggaagggaaggagg

SEQ ID NO: 1439 - DNA, 300 bp, Homo sapiens
attatggtggaaggggaagcaaatgccctacttcacatggtggcaggaaggagaagaatgagaaccaaatgagggagaagccccttataaaaccatcagatcttgtgagaacttactatcatgagaatagcatgggggaaactgccctgtgattcaattacttcccactaggtcactcccaccatacatggagattataggaactacaatttaggatgagatttgggtgggaacacagccaaaccatatcaagtattaacagcagaattaaccaagctgaggaaagactctcagagctca

SEQ ID NO: 1440 - DNA, 300 bp, Homo sapiens
gcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggcctccgtcgtggccccctcggggctgacactaatggacagaggctctcggtgccgaagattgcctgccagaggactgaccacagcctggctggcagctgctctgtggaggacctccaggactgagactgggctctgttttccaagggtcttc

SEQ ID NO: 1441 - DNA, 300 bp, Homo sapiens; identical to SEQ ID NO: 337

SEQ ID NO: 1442 - DNA, 300 bp, Homo sapiens
ggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtga

SEQ ID NO: 1443 - DNA, 300 bp, Homo sapiens
agaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcaccttcagttcagcacagcctgagcagtgagaaggtctgaaaggagagtatatagttaagatccttgagaaagggctg

SEQ ID NO: 1444 - DNA, 300 bp, Homo sapiens
tttggattgattcaggagaaatttgcactgatggctcagaaggcttacgtcatggagagtatgacctacctcacagcagggatgctggaccaacctggctttcccgactgctccatcgaggcagccatggtgaaggtgttcagctccgaggccgcctggcagtgtgtgagtgaggcgctgcagatcctcgggggcttgggctacacaagggactatccgtacgagcgcatactgcgtgacacccgcatcctcctcatcttcgagggaaccaatgagattctccggatgtacatcgccctg

SEQ ID NO: 1445 - DNA, 300 bp, Homo sapiens
ggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgt

SEQ ID NO: 1446 - DNA, 300 bp, Homo sapiens
gccttttgtggggtctcatacataactcagtttccacaaagctgtgccccagctcagccctatggatagaagcatggtctggggttcctttgctgaccagggtgtgtgctttgtccaagttactgaccttcccaaacctcatcaatgcacataaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggc

SEQ ID NO: 1447 - DNA, 300 bp, Homo sapiens
  misc_feature 14, 17, 34, 40, 56, 57, 68, 92, 100, 107, 109, 112, 114,115, 120, 123, 125, 177, 182, 189, 193, 201, 212, 235, 238,246, 250, 253, 260, 263: n = A,T,C or G
ttaatatgggaacnccngtttctaactgtcatcncccccnccccaacacccccaanncagcagttttnttcacccgctgcagccgttccgtnccaaacanagggccncncanannccccncgntntatataaggaggaaaacgggaaagaatataaagttaaaaaaaagcctccggnttccnctactgngtanactcctgntttttcaagcncctgcagattttgatttttttgntgntgttgttntccnccnttgctgntgntgcaggggtactattgtttaaaaacaggaaaaaaaat

SEQ ID NO: 1448 - DNA, 300 bp, Homo sapiens
cttactttgatcctcgtgaggcatacccagatggaagtagcaaagaaaagagaagagcagcagttgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctc

SEQ ID NO: 1449 - DNA, 300 bp, Homo sapiens
  misc_feature 174, 175, 176, 177, 178, 179, 180, 187, 188, 192, 198, 201,202, 205, 206, 207, 212, 216, 221, 222, 223, 224, 227, 228,238, 239, 247, 249, 251, 261: n = A,T,C or G
gaacattcggactcgagataatcgtcgccttggggagtgggacttgcctgaggctgtgcagctgactggtggagctaccgaacacgagggtcccatatgcccgaagaaaatttctggccctttgtacatacatgacgccaaccactgcgagtgccatcagctctctcttgttgnnnnnnncccccgnnatgntgacgntgnngannncttanaccnttttnnnnctnngaaaggaggnntgattgcngntnccctgagatntggcttcccaagagcacttattgacccttcctcaggcct

SEQ ID NO: 1450 - DNA, 298 bp, Homo sapiens
  misc_feature 9, 15, 18, 19, 20, 24, 25, 27, 28, 32, 39, 40, 44, 46, 49,53, 55, 59, 65, 67, 68, 86, 88, 97, 100, 102, 107, 113,120, 125, 134, 140, 142, 143, 156, 169: n = A,T,C or G
cccccggantaaggntgnnntatnntnnccanaaaaaanngggncnatnatgngntcgngaaggntnnggaacaacaaggactgcntnattggaagnggncncaggnttgaanccaaagntaaangagtgaatnaggtgntnntggggaatgaccngctcatggagatntgagttctgagcaagtcagactccttccttttggcctccaaagccacagatgttgcccggcccacctgtttaactctgtatttatttcccaataaagaagggcttccaaaggcatgctggagacttgtg

SEQ ID NO: 1451 - DNA, 300 bp, Homo sapiens
atggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttatt

SEQ ID NO: 1452 - DNA, 296 bp, Homo sapiens; identical to SEQ ID NO: 341
  misc_feature 173, 174, 175, 176, 177, 178, 179, 180, 181, 182, 183, 184,185, 186, 187, 188, 189, 192, 193, 199, 201, 203, 205, 207,208, 221, 222, 224, 227, 229, 230, 231, 234, 236, 239, 242,245, 251, 253, 254, 255, 263, 266, 267, 277, 281, 284: n = A,T,C or G
  misc_feature 287, 288: n = A,T,C or G

SEQ ID NO: 1453 - DNA, 300 bp, Homo sapiens
cgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctca

SEQ ID NO: 1454 - DNA, 300 bp, Homo sapiens
agaataactaccagacaacatttgttaaaactcaggacagtatgtattttaaataagcaagtgcatgtgtgaaaatggctcattcagtttataaaatattacattaaatttgaggtttctgttttttttcttttgtgacagtcttgctctgttccccatgctgtattgcagtggctccagttcacctcactgtaacttccacatcctggtttcaagcaatttgtgcctcagcctcccaagtagctgggattacagtcatgccaccatgtccagataatttttatatttttttgtatagat

SEQ ID NO: 1455 - DNA, 300 bp, Homo sapiens
agatgggttaaaacttaaatgtcacatctgaaacagtaaaaatcctagaagaaatcctaggaaaaactcttctggacattggcctaggcaaagaatttatgatgaagacctcaaaagcaaacataacaaaaccaaaaatagacaaatgagatttaattagaaaaacttctgcacagtaaaagtaataatcaacagttaatagacaacctatagaatgggagaaaatatatgtaaattatacatctgacaaagaactaatatccagaatctacaaagaactcaacaagaaaaaaaccaacc

SEQ ID NO: 1456 - DNA, 300 bp, Homo sapiens
tcctggctgttaggatttgttcgtgtttgggagacctttagagcgtggttaaacccatatgttgggatttatgctgcttttatggtagcaataccctatattaagatttgaagtagacccggaaagttagtggccggttagctcagttggttagagcgtggtgctaataacgccaaggtcgcgggttcgaaccccgtacgggccagtgggtggcttttttttgtgtgtgttttgttttctgaccctctgctgttatccggaagtttctacccggagccagttgccttctggtaacagaat

SEQ ID NO: 1457 - DNA, 300 bp, Homo sapiens
aaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttc

SEQ ID NO: 1458 - DNA, 300 bp, Homo sapiens
agacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaat

SEQ ID NO: 1459 - DNA, 300 bp, Homo sapiens
tgggacatgctcatgatggctgtcatgcacactgcgaaaagttgttggtttactggagcagggcaaggaacacctggccccgcccggagcaaaaaactgctcaaaccacaaacgatagcaggaaaggcctgtgccttggcagcatgtttttgctgcagataatcagccagagcctgtttctctgctcctcgctgagattgctttgtttcccataaagattgcttttagctaatctacaatctatagaagcaatgcttatcactggctttctgtcaataaatgtgtgggtcaagctctgtt

SEQ ID NO: 1460 - DNA, 300 bp, Homo sapiens
  misc_feature 279: n = A,T,C or G
gctacctgggcggcgacgggctggacgtggacgtgcccacgcgtctggagggctggttcttctgcacgcccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccaatnggggccacttcgtggccgagc

SEQ ID NO: 1461 - DNA, 300 bp, Homo sapiens
  misc_feature 1, 3, 4, 14, 22: n = A,T,C or G
ngnnattgagcccnttgaatcnagctacttgttctttttgcaggatcccatcgagtccatctcatatgagtgagaaagcttaccagtgcagcgaatgtgggaaagccttccgagggcactcggacgttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatc

SEQ ID NO: 1462 - DNA, 300 bp, Homo sapiens; identical to SEQ ID NO: 344

SEQ ID NO: 1463 - DNA, 300 bp, Homo sapiens
aattccgttgctgtcgaattgttcctgtcctgccccaactgatcaatcgaccttgtgacattcttcttctggacaatgaatcttatgatctccccaccatggaccctgtgaccccctcctctgctgacaatagataaccacctctaactgtaacattccactgcctacctcagtcctataaagctgcccctctcctatctaccttcgctgactctcttttcgtactcagcccacttgcacccaagtgaataaacagccctgttgctcacaaaaaaaaaaaaaaaaaaaaaaaaaaaaaaa

SEQ ID NO: 1464 - DNA, 300 bp, Homo sapiens
agaatacaagctacttgttctttttgcaggatcccatcgattcgaattccgttgctgtcgaattgttcctgtcctgccccaactgatcaatcgaccttgtgacattcttcttctggacaatgaatcttatgatctccccaccatggaccctgtgaccccctcctctgctgacaatagataaccacctctaactgtaacattccactgcctacctcagtcctataaagctgcccctctcctatctaccttcgctgactctcttttcgtactcagcccacttgcacccaaggaataaacagc

SEQ ID NO: 1465 - DNA, 300 bp, Homo sapiens
actatagaatacaagctacttgttctttttgcaggatcccatcgattcgaattccgttgctgtcgaattgttcctgtcctgccccaactgatcaatcgaccttgtgacattcttcttctggacaatgaatcttatgatctccccaccatggaccctgtgaccccctcctctgctgacaatagataaccacctctaactgtaacattccactgcctacctcagtcctataaagctgcccctctcctatctaccttcgctgactctcttttcgtactcagcccacttgcacccaagtgaata

SEQ ID NO: 1466 - DNA, 300 bp, Homo sapiens
gtgggagggggtagggggaggaagtctgtggtgagcaaagtttgccttattacactgataaagtgtaattacactaataaagctggatcacctgaggttaggagtttgagagcagcctggccaacatggcaaaaccctgtctctactataaatacaaaaattagccaggtgtggtggcagggcacttgtgatcctatctactcgggaggctgaggcaggagaatcgcttgaacccaggctgtaaaggttgcagtgagccaagatcatgccactgcactccagtctgggtgtcagaatgag

SEQ ID NO: 1467 - DNA, 300 bp, Homo sapiens
caatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaatta

SEQ ID NO: 1468 - DNA, 261 bp, Homo sapiens
  misc_feature 140, 141, 142, 143, 144, 154, 155, 158, 164, 165, 166, 167,171, 172, 175, 177, 179, 182, 185, 188, 191, 195, 197, 202,204, 210, 211, 220, 222, 224, 226, 228, 230, 235, 239, 242,243, 244, 246, 247, 248, 250, 251, 253, 255, 258, 260: n = A,T,C or G
gtgaaagagttcatgacctccttgcgccgggcctggtgctctgcgatcaagggctgcagaacctgtatgagtgccttcttgagctcaccggtgagcatggctccgctggtgtaatccttcctgatctgctcgagcttgtnnnnnacctggaggnntanggtatnnnncatnnttnanangcncgnatnatnctgnanctacncngtctgnnacggtattnangncnantnctatnatgnaannnannntnngngnctntnc

SEQ ID NO: 1469 - DNA, 298 bp, Homo sapiens
  misc_feature 171, 172, 173, 174, 175, 176, 177, 178, 179, 180, 181, 182,183, 184, 185, 186, 191, 213, 215, 220, 223, 225, 227, 230,233, 234, 236, 244, 250, 256, 265, 268, 270, 272, 277, 279,282, 291: n = A,T,C or G
tttttttgagacggagtcttgttctgttgccaggctggagtgcggtggtgcaatctcagctcactgcaatctccacctcctgggttcaagaggttctcctgcctcagcctcctgagtagccggggagctacaagcatgcaccaccacacccagctaatttttttttttttnnnnnnnnnnnnnnnntgtcncccaggcttgagtgcaggggcncnatctnggntnantgnaanntntgtctccngggttnatgccnttctcctgnttnancntcccnantantcccaggantagctgg

SEQ ID NO: 1470 - DNA, 300 bp, Homo sapiens
ggtaaggatttggggcacagtaccaggaggggggcttggtgccagacctcatgaggaagaaggattttcctatgtacagagaaggggaccctgtcctgttgggaggtgctgtgcaaacctaaccaagttactaacccctctgttttctgtgctacacaaaggggataaatacaagcttccctctctagccaattctatttggttcctgagtttggaaagtgatagatactgattttctatgattttatgaggacttaaataagctcctatggaaagtgttttgtgcagtgccgtgcccat

SEQ ID NO: 1471 - DNA, 300 bp, Homo sapiens
gcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagcgccgtaattgacacatctcttatttgagaagtgtctgttgccctcattaggtttaattacaaaatttgatcacgatcatattgtagtctctcaaagtgctctagaaattgtcagtggtttac

SEQ ID NO: 1472 - DNA, 300 bp, Homo sapiens
ggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcg

SEQ ID NO: 1473 - DNA, 295 bp, Homo sapiens
  misc_feature 7, 9, 15, 17, 36, 37, 42, 50, 68, 89, 96, 100, 101, 110,112, 114, 117, 122, 123, 146, 149, 151, 161, 188: n = A,T,C or G
ggtggtntnagtggnanaaggatcgcagtggagacnngtgcnaatagggngatcctggtaaggtgctnatgtcatgctgcaatgtccancagcagnaggnntttgatgtnangngcnggagnngagtggaccaggggtgctgtgtnatnanttgattcagnggcttatggcatcactgccttctgttnccgggggagcatggatctagatgtcctcgcctctgaaaaccaagtgtcagagccccttccccttgtttttattttactgttataataattattaacttccttgtaat

SEQ ID NO: 1474 - DNA, 300 bp, Homo sapiens
tggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcg

SEQ ID NO: 1475 - DNA, 290 bp, Homo sapiens
  misc_feature 133, 134, 135, 136, 137, 138, 139, 140, 141, 142, 143, 144,145, 146, 147, 152, 165, 169, 171, 172, 175, 182, 194, 197,212, 217, 224, 225, 271, 277, 280: n = A,T,C or G
gcctagggccccctagcaccccactcgatcaccgagggtaccagtccctgtcagacagccccccgggggcccgagtcttcactgagtcagagaagaggccactcagcatccaagacagcttcgtggaggtatnnnnnnnnnnnnnnnggccnctggttcatgatntggntnntanatgcaanaggctgtggctnctnaagtcctaaggattnctcantgatcanngatccagggccgttcatgaaccactgggctggatttgactgttgantgtggnagnaaatgcccgt

SEQ ID NO: 1476 - DNA, 300 bp, Homo sapiens
gtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtttgcagtcactcattgaaaaacattttcctgctccagacaggaaaaaactttatagtttactaggaatcgatttgacagctccaagt

SEQ ID NO: 1477 - DNA, 300 bp, Homo sapiens
cacagtccttctggaagccagacccgaagccacagtagcagtgccagctcagcagagagtcaggacagcaggaagaagaagaagaagaaggaaaagaaaaaacacacagaaacatataaagcataagaagcataagaaacatgcaggcactgaagtggaattggaaagacgccatctacacgaccacaggaaccagaagaggacctacactcagattagagcgtgaggaagtgagttcttggagacgtgctgatgacaggaaagatgaccgggtggaagagcgggaccctcctcgtcgag

SEQ ID NO: 1478 - DNA, 300 bp, Homo sapiens; identical to SEQ ID NO: 353

SEQ ID NO: 1479 - DNA, 300 bp, Homo sapiens
ccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttggtcctaaccttacagaaaaatcctt

SEQ ID NO: 1480 - DNA, 300 bp, Homo sapiens
  misc_feature 288: n = A,T,C or G
gctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaatagggaatgaagctgtcagaaatccccttgactctgcattctgtttcagagctggtgcggctctgcttgcncagatctgatgt

SEQ ID NO: 1481 - DNA, 300 bp, Homo sapiens
  misc_feature 174, 175, 176, 177, 178, 179, 180, 181, 182, 183, 190, 213: n = A,T,C or G
ctttgcagctccccttccactgagagccacttccaccatttaataaaatcgtccacatccatcaactttcaaaccattcatgcaacctgattcttcctggatgctgaacaagaacctgggtaccaacagggcagggtgtaaaaggctgccaccctgactctccttgagtgggtnnnnnnnnnnctgtccnggatggcaactgctaaaagagcntgaattgtaacacatccctaaatgcgctgttgggctggagcccaaaagtgctcatcgaagccctggcacccgcttgcctgcgtgctc

SEQ ID NO: 1482 - DNA, 300 bp, Homo sapiens
  misc_feature 162, 163, 164, 165, 166, 167, 168, 170, 177, 178, 179, 185,188, 194, 213, 244, 265, 268, 271, 284: n = A,T,C or G
aacctatctgcatggacctctgtggaccacagcgtacctgcccctttctgccctcctgctccagccccacttctgaaagtatcagctactgatccagccactggatattttatatcctcccttttccttaagcacagtgtcagaccaaattgcttgtttctnnnnnnngnactacannnatatgnatnctggtncgctgggcaagttcactgngcccatgctgaaagaggcctgccgggcttangggctgaagagtggtctgaanaancangaactgctggaanccctcaccaagcactt

SEQ ID NO: 1483 - DNA, 300 bp, Homo sapiens
agttttcctgtgattagtgtttttggtgttgttttattttttttcttacaggaactcttgcaagaagaaaggactatgagttcaactttagagggagccatggggactaaacaaaattctgaggccccctcaaccatctaaatggacttccttctgggccaggacactcgaaaattaaacctgaaagactggttcaggccatgatgggaagtgggagtcgaacatgcctcatcataccctccagcattaacatcaacacagaccttaaggctgataagaagcatttacaatctattctct

SEQ ID NO: 1484 - DNA, 299 bp, Homo sapiens
  misc_feature 257, 258, 259, 260, 261, 262, 263, 264, 265, 266, 267, 268,269, 270, 271: n = A,T,C or G
gttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggacactgnnnnnnnnnnnnnnngcttccaaggaagaactgaagtggttag

SEQ ID NO: 1485 - DNA, 300 bp, Homo sapiens
cagagacctgacagtggcaatgtatggccacgttactgaatctacatgttgcaagagaaaaactagcagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatggga

SEQ ID NO: 1486 - DNA, 300 bp, Homo sapiens
gagagcttgggatgtggtaatgccagccacactcctgggagccgtggccagatctcggcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcaca

SEQ ID NO: 1487 - DNA, 300 bp, Homo sapiens
gcctgccagaatggaagcatacagatctgggaccgaaatttgactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggc

SEQ ID NO: 1488 - DNA, 300 bp, Homo sapiens
  misc_feature 126, 127, 128, 129, 130, 131, 132, 133, 134, 135, 136, 137,138: n = A,T,C or G
ccggagagaagcagcaggagggcggcggcgccgtgcgctgcgacacacctgccaactgcacctatcttgacctgctgggcacctgggtcttccaggtgggctccagcgggtcccagcgcgatgttnnnnnnnnnnnnntggcaattaacaacatcttaaaactgactcagctcacccagtcttccatgtattcacttcctaatgcaccctctctggcagacctggaggacgatacacatgaagcctgtgatgatcagccagagaagcctcactttgactctcgcagtgtgatttttgagc

SEQ ID NO: 1489 - DNA, 300 bp, Homo sapiens; identical to SEQ ID NO: 355

SEQ ID NO: 1490 - DNA, 300 bp, Homo sapiens
gcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggcca

SEQ ID NO: 1491 - DNA, 278 bp, Homo sapiens
  misc_feature 129, 130, 131, 132, 133, 134, 135, 136, 137, 138, 147, 151,153, 154, 163, 164, 172, 175, 178, 179, 180, 184, 185, 186,188, 191, 193, 196, 197, 198, 199, 208, 211, 212, 214, 218,219, 221, 222, 232, 233, 235, 239, 240, 241, 244, 247: n = A,T,C or G
  misc_feature 249, 250, 257, 262, 264, 272, 273, 274: n = A,T,C or G
ggtgactgccatcctggagccctacccctgcatccacttccctctggccacatatgcccctattatctctgctgaaaaagcctaccatgaacagctttctgtagcagagataaccattgctatgctttnnnnnnnnnnacctgatgntaananntgaacctcnntgcggttnttncannntttnnntntcnantcnnnnacgtcttgnttnntncttnntnntttctcgcannantttnnnatntcntnncctttgnttttncntcttcttnnntaat

SEQ ID NO: 1492 - DNA, 150 bp, Homo sapiens
ccccggtcgtgtagcggtggtatactacggtcaatgctctgaaatctgtggagcaaaccacagtttcatgcccatcgtcctagaattaattcccctaaaaatctttgaaataagggcccgtatttaccctatagcaccccctctagaggg

SEQ ID NO: 1493 - DNA, 277 bp, Homo sapiens
  misc_feature 7, 14, 16, 17, 18, 29, 31, 38, 39, 41, 42, 43, 48, 51, 55,57, 60, 63, 64, 66, 69, 72, 74, 76, 77, 79, 80, 81, 82,94, 97, 105, 109, 112: n = A,T,C or G
gaagaangcctatncnnnctattagctananatagtcnntnnnaatanganaganangtnacnnanaangcnananngnnnnagagatagctcnacntaaagacngganaangatcttcgccttaatacttttttattttgttttattttgaatgatgagccttcgtgcccccccttcccccttttttgtcccccaacttgagatgtatgaaggcttttggtctccctgggagtgggcggaggcagccaggggttacctgccacaaacggggaccag

SEQ ID NO: 1494 - DNA, 300 bp, Homo sapiens
gaggtagtgacacaggctgtgggagggggtagggggaggaagtctgtggtgagcaaagtttgccttattacactgataaagtgtaattacactaataaagctggatcacctgaggttaggagtttgagaacagcctggccaacatggcaaaaccctgtctctactataaatacaaaaattagccaggtgtagtggcagggcacttgtgatcctatctgctcgggaggctgaggcaggagaatcgcttgaacccaggctgtaaaggttgcggtgagccaagatcatgccactgcactccag

SEQ ID NO: 1495 - DNA, 300 bp, Homo sapiens
ggcacagtaccaggaggggggcttggtgccagacctcatgaggaagaaggattttcctatgtacagagaaggggaccctgtcctgttgggaggtgctgtgcaaacctaaccaagttactaacccctctgttttctgtgctacacaaaggggataaatacaagcttccctcactagccaattctatttggttcctgagtttggaaagtgatagatactgattttctatgattttatgaggacttaaataagctcctatggaaagtgttttgtgcagtgccgtgcccataaagaagagctca

SEQ ID NO: 1496 - DNA, 300 bp, Homo sapiens
acgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacggga

SEQ ID NO: 1497 - DNA, 300 bp, Homo sapiens
tgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccg

SEQ ID NO: 1498 - DNA, 294 bp, Homo sapiens
  misc_feature 264, 275: n = A,T,C or G
ccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccgggganaggggcagctngggctggagaagcacagcc

SEQ ID NO: 1499 - DNA, 300 bp, Homo sapiens
acagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactg

SEQ ID NO: 1500 - DNA, 300 bp, Homo sapiens
tcaagtttgtttgaagacacgtgtgcctttgtacccattataagatggtcataagacccaagaactgataagctttggtttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaatgcagatatgttcagataacttttatttttt

SEQ ID NO: 1501 - DNA, 300 bp, Homo sapiens
aaatgtttttgaatcaagtttgtttgaagacacgtgtgcctttgtacccattataagatggtcataagacccaagaactgataagctttggtttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaagcagatatgttcagaaac

SEQ ID NO: 1502 - DNA, 300 bp, Homo sapiens
ctatgatcaggactgactaggtagttggcatggcccatagagaacaaggaaagatgggctggtggattggcccacctgggagccacatggggcaaggggagccctcaccctcagccagccagacgagtgggatttcccccagcacagcatacccccttcacaaagggacaactaaagtgcttcattaagcaagtcctggatcctgtgccccccaactgggtgagacaccccaatgggtcaccagacaccttatacaagagcatttctactggcatcaggtgggtgcccctcaaggacaga

SEQ ID NO: 1503 - DNA, 300 bp, Homo sapiens
gttttggctgggcatgatggttagcgcctgcagttccagctacctgggagggtaagcccagttcaaggctgcaattaactatgatggtgcccctgcatttcagcctgggtgacaaaattaaatcctggcccaaaaaaaaaaagtagccaggcatggtggcgggagcctgttgtcccagctgttccgtaggctgaggcacgacattcacttgaacctgggaggtggaggttgctgtgagctgacaccacgccactgcactccagcctgggtgacagtgagactctgtctcaataaataaaa

SEQ ID NO: 1504 - DNA, 280 bp, Homo sapiens
  misc_feature 124, 125, 137, 146, 154, 156, 159, 161, 163, 174, 177, 181,185, 188, 190, 191, 196, 198, 203, 212, 214, 215, 218, 219,221, 222, 223, 225, 226, 228, 229, 230, 238, 240, 242, 243,246, 250, 254, 255, 256, 257, 260, 264, 266, 267, 268: n = A,T,C or G
  misc_feature 274: n = A,T,C or G
attcgaacatatgcagttattccactaaatgatgaatgtgggattattgaatgggtgaacaacactgctggtttgagacctattctgaccaaactatataaagaaaagggagtggatatgacannaaaagaactttnccagtgctnctacctcngnctncngntttatctgaanagntggnagtntcncnngatangncctgntttgcatcntnntanngnnntnnannngccctttncntnntgnttgncggnnnngcnttgncnnnagtcanccgctg

SEQ ID NO: 1505 - DNA, 294 bp, Homo sapiens
  misc_feature 8, 9, 10, 15, 22, 28, 37, 39, 44, 53, 63, 65, 66, 72, 73,78, 80, 81, 87, 94, 97, 111: n = A,T,C or G
aataggannnctaanaggctangtgagnaatatcaancnccgcnctgtttttnggtggttaangnngtatanngggcntnnatgggnaggaatncanatggtagttggganaggggaggatacaggtggatgggactggaggttgtataaggtgttcttggaaggaaggggcaggagttggaattagttggtccctactgtcccccatgaggttgtgaacccctcccccaacttttcatgtttcttaaaggcattttggttttttaaaatctgtacagcaagagcaactttttc

SEQ ID NO: 1506 - DNA, 279 bp, Homo sapiens
  misc_feature 6, 9, 11, 17, 29, 34, 35, 36, 37, 39, 41, 42, 43, 46, 49,52, 53, 54, 55, 62, 64: n = A,T,C or G
gaaaanggnangactgntttatgggggcnccaannnncngnnncanttncannnnggccccnanaatggccaatgctcgtttagggaaccgccattctgcctggggacgtcggagcaagcttgatttaggtgacactatagaatacaagctacttgttctttttgcaggatcccatcgattcgcaggaatcgatctcgtgaagcccgcaaggaccgaacacccccaccccgatttagacctgcaggtgctgccccacgtcccccaccaaagcccatgta

SEQ ID NO: 1507 - DNA, 300 bp, Homo sapiens
gctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccct

SEQ ID NO: 1508 - DNA, 300 bp, Homo sapiens
tcgtttagggaaccgccattctgcctggggacgtcggagcaagcttgatttaggtgacactatagaatacaagctacttgttctttttgcaggatcccatcgattcgaattcggcacgagcatggtaatcctgctcagtacgagaggaaccgcaggttcagacatttggtgtatgtgcttggctgaggagccaatggggcgaagctaccatctgtgggaggaaggaggcaggctgtggtgggactgggtagggtatagtatcactcctgagttccactgctctagaatctaaccagaaat

SEQ ID NO: 1509 - DNA, 298 bp, Homo sapiens
  misc_feature 216, 217, 218, 219, 220, 221, 222, 236, 256, 266: n = A,T,C or G
cccgaggagcggagcagaggcacccaggcagcctgcgcggagaaattggatcggcggggacggcctgcagctcccgcgcgcggggaaagggaagaagtcctcccctacaaagcaaattcacaaacttggaagaagcaatttacacaggatgtgcagatctcaatggaaggacacgggaaacgtgaaaaagcaaggaagtgggacgcctccaaaggnnnnnnntaattctccagcancagatccccatccaaaaganattcaagaantgtcatatagagaattgtggaaactgatttta

SEQ ID NO: 1510 - DNA, 272 bp, Homo sapiens
  misc_feature 123, 124, 125, 126, 127, 128, 129, 130, 131, 132, 133, 134,135, 137, 143, 149, 151, 155, 156, 158, 159, 163, 164, 170,175, 183, 184, 186, 190, 192, 195, 196, 197, 198, 199, 200,202, 203, 204, 208, 210, 215, 219, 220, 221, 222, 226: n = A,T,C or G
  misc_feature 228, 229, 230, 231, 233, 234, 237, 238, 239, 241, 245, 248,252, 253, 255, 257, 258, 259, 261, 265, 266, 267, 269: n = A,T,C or G
gacagccccaatccgggagcaggagggcctcctgccttggcatatagacccctgggcgcctccctgggatgcccaccaggcccagggatccacctaggtgggtttggctatcctggtgatggnnnnnnnnnnnnntnaacctntctttntntacnncnntacnnctcatntattntcctctanngntaantntgnnnnnntnnncttntnccaantagnnnntttngnnnncnntcnnntnaatntanattnntntnnntntttnnntnatt

SEQ ID NO: 1511 - DNA, 300 bp, Homo sapiens
ggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtggaatctggtgaacagtaacaaactttggtgaaatttcaggaaccatagccattgaagtggatgagggaacctatatacatgcactcaacaatggtctttttaccctgggagctccacacaaagaagaatcg

SEQ ID NO: 1512 - DNA, 300 bp, Homo sapiens
attaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttttgtcattaagaaagactggggtgggtgtggtggctcacgcctgtaaccccagcactttgggaggccaaggtgggcagatcacgaggtcaaga

SEQ ID NO: 1513 - DNA, 300 bp, Homo sapiens; identical to SEQ ID NO: 364

SEQ ID NO: 1514 - DNA, 300 bp, Homo sapiens
acccgaggctcggtgtactaggtgcgaatgccgccttctgtggtgaccactgtcttctcatcctttgcacctataggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccat

SEQ ID NO: 1515 - DNA, 300 bp, Homo sapiens
  misc_feature 10, 19, 20, 24, 31, 32, 38, 48, 61, 63, 67, 70, 72, 78, 81,91, 95, 102, 126, 136, 150, 159: n = A,T,C or G
ataatttggngcatttccnnacantgtcttnncaagantaaaatgtgngcgccaaaatttngnattntantnggaganttnttatccaaantaangctgccntaggaagtctaaggaattagtagngttcccatcncttgtttggagtgngctattctnaaagaataagcaatgctcgtttagggaaccgccattctgcctggggacgtcggagaaagcttgatttaggtgacactatagaatacaagctacttgttctttttgcaggatcccatcgattcgaattcggcacgagcagga

SEQ ID NO: 1516 - DNA, 300 bp, Homo sapiens
ggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcga

SEQ ID NO: 1517 - DNA, 285 bp, Homo sapiens
  misc_feature 230, 231, 232, 233, 234, 235, 236, 237, 238, 244, 245, 257,267, 268, 270, 272, 274, 275: n = A,T,C or G
gtgagacaggttagttttaccctactgatgatgtgttgttgccatggtaatcctgctcagtacgagaggaaccgcaggttcagacatttggtgtatgtgctacgtcgccctggacttcgagcaagagatggccacggctgcttccagctcctccctggagaagagctacgagctgcctgacggccaggtcatcaccattggcaatgagccggttacgctgccctgaggcnnnnnnnnngccttnnttactggcatgntgttctgttnntncngnngagtacattc

SEQ ID NO: 1518 - DNA, 292 bp, Homo sapiens
gtcaatggtgtacaagcaatgctcgtttagggaaccgccattctgcctggggacgtcggagcaagcttgatttaggtgacactatagaatacaagctacttgttctttttgcaggatcccatcgattcgaattcggcacgagggggattcataattccagacaggtagagaacggttttatttatgtagagacagagtctcgctctgtcgccaggctgaggcgggagaatcacttgaacctgggaggtggaggttgcgctgagctgagatcattacactgcactccagcctg

SEQ ID NO: 1519 - DNA, 271 bp, Homo sapiens
  misc_feature 3, 7, 14, 15, 24, 26, 33, 38, 45, 46, 47, 49, 50, 51, 52,53, 54, 55, 56, 57, 58: n = A,T,C or G
canaccnattctcnnttggcaacnangatcganggggnacctagnnnannnnnnnnnnaatgacgcaaatgggcgttccattgacgtaaatgggcggtaggcgtgcctaatgggaggtctatataagcaatgctcgtttagggaaccgccattctgcctggggacgtcggagcaagcttgatttaggtgacactatagaatacaagcttactttgttctttttgcaggatcccatcgattcgaattccgcacatgaatctcccctcctcac

SEQ ID NO: 1520 - DNA, 300 bp, Homo sapiens
aaatgatgacagagagaaccctgttgaaagagcgttaccaggaggtcctggacaaacagaggcaagtggagaatcagctccaagtgcaattaaagcagcttcagcaaaggagagaagaggaaatgaagaatcaccaggagatattaaaggctattcaggatgtgacaataaagcgggaagaaacaaagaagaagatagagaaagagaagaaggagtttttgcagaaggagcaggatctgaaagctgaaattgagaagctttgtgagaagggcagaaggtaactgatgttaagaataaaaa

SEQ ID NO: 1521 - DNA, 289 bp, Homo sapiens
  misc_feature 124, 125, 126, 127, 128, 129, 130, 131, 135, 138, 153, 159,162, 163, 175, 180, 182, 184, 187, 190, 192, 196, 198, 201,203, 204, 208, 213, 218, 222, 224, 232, 235, 252, 254, 255,257, 258, 260, 263, 266, 267, 272, 274, 275, 276, 281: n = A,T,C or G
gcgagccaggattcccgatccagagacaatggccccgatgggatggagcccgaaggcgtcatcgagagtaactggaatgagattgttgacagctttgatgacatgaacctctcggagtcccttnnnnnnnncttntangcctatggttttgangaactnttnngttttatttttntgttnantnttngtngnctgntntgntnntgtnggatngagangaanantttctttntgngccatgtgctgatggangnntnntnttntcnnatttntnnnttttnatgttttt

SEQ ID NO: 1522 - DNA, 300 bp, Homo sapiens
ggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtctcagttgtacctgatgaggtagccaccattgcagctgaggtcacttctttctccaaccgcttcacccatgtcctcacagcagggggcatcggccccactcatgatgatgtgacctttgaggcagtggcacaggcctttg

SEQ ID NO: 1523 - DNA, 300 bp, Homo sapiens
ttcaccaatgacatgatcttatagcgattctataaaaacagaataattaacaaattcagcaaagttgtcaaatacaaaatcaacacacagaaatcagttgcatttctatatagtactagcagtgaacacttcatgaaggaaattagcagtttcatttaaatagcatcacatagaataaaatacataggaattaaccaaggaggtgaaagacttgtacacagaaaactacaaaatattgttgaaagaaattaaagaagacataattaaatggaaagacatcctgtgttcaattatatccat

SEQ ID NO: 1524 - DNA, 300 bp, Homo sapiens; identical to SEQ ID NO: 374

SEQ ID NO: 1525 - DNA, 300 bp, Homo sapiens; identical to SEQ ID NO: 376

SEQ ID NO: 1526 - DNA, 300 bp, Homo sapiens; identical to SEQ ID NO: 377

SEQ ID NO: 1527 - DNA, 300 bp, Homo sapiens
ggtacaccaaagaagaaagctgttgtccaggctaagttgacaaccactggcccggtgacttctccagtgaaaggcgcctcatttgtcaccagtaccaatccccggaaattttctggcttttcagccaagcccagagtggatttgggcatagtaatcagcaaaagctacggaataattctaagaattagatgtttccatatcattaaaaccaaggatccatgaggggcagaagggaggattcaaagattttaaaaaaatcaaattttagaccttggttaaatattaactggaatgggatct

SEQ ID NO: 1528 - DNA, 300 bp, Homo sapiens
agactccctttcccggtctgctcagtaacgggtgccttcccagacactggcgttaccgcttgaccaaggggccctcaagcggcccttatgcgggcatgacagaaggctcccctcttgccttctattcacttctcacaatgtcccttcagcacctgaccctatacctgccggttattcctaggttatattattaatgcaacagagtaatattaaaagctaatgattaataatgtttataataatgatggataattgttcatgatcatcgctgtatctaatttgtattatgactattcttat

SEQ ID NO: 1529 - DNA, 300 bp, Homo sapiens
ggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctat

SEQ ID NO: 1530 - DNA, 300 bp, Homo sapiens
gggccgctcagtttttacgtaaaatggcagatccacagtccatccaggaatcgcagaatctgtccatgttcctggccaatcataacaagatcacacagtctctgcagcagcagctcgaagtgatttctggctacgaagagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaa

SEQ ID NO: 1531 - DNA, 300 bp, Homo sapiens
gtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccgtaaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgg

SEQ ID NO: 1532 - DNA, 300 bp, Homo sapiens
  misc_feature 144, 145, 146, 147, 148, 149, 150, 151, 152, 153, 154, 155,156, 157, 158, 159, 160, 162, 166, 172, 174, 177, 180, 181,182, 183, 184, 185, 186, 194, 198, 201, 206, 207, 212, 213,216, 219, 221, 234, 236, 238, 240, 242, 247, 254, 256: n = A,T,C or G
  misc_feature 258, 259, 272, 274, 284, 289, 290: n = A,T,C or G
gagagagagagagagagagagagagagagagagagagagagagagagagagagagagagagagagagagagagagagagagagagagagagagagagagagagagagagagagagagagagagagagagagagagagagagagnnnnnnnnnnnnnnnnncncacnctcttntntcncgnnnnnnntctctctntgtntcnctctnngtgtnnganatntntctctcttatatntntntntnttttntctctcnanannctctctctctctntntgtgtctctntcacnnccctctctct

SEQ ID NO: 1533 - DNA, 286 bp, Homo sapiens
  misc_feature 112, 118, 136, 143, 148, 152, 153, 154, 155, 159, 161, 165,167, 172, 174, 175, 179, 181, 182, 185, 187, 189, 191, 192,194, 196, 199, 200, 201, 204, 206, 209, 212, 213, 214, 218,221, 223, 226, 227, 230, 233, 234, 237, 238, 240, 242: n = A,T,C or G
  misc_feature 243, 247, 250, 253, 254, 255, 256, 261, 262, 263, 264, 266,269, 273, 276, 280: n = A,T,C or G
gtggtctctccccctgtacctagaaagctatttgagctggatccgtccctctgatcgtgacgccttccttgaagaatttcggacatctctgccaaagtcttgtgacctgtanctgccncgttttgaagagcttganctggttnccctntggnnnntcgntntgtntntctcntnntgtncnntcnanantnntnanttnnnatngntgnatnnntaangcntnatnnttnctnnatnntntnngagnctnttnnnnttttnnnntnatncttngtnatgntcatta

SEQ ID NO: 1534 - DNA, 272 bp, Homo sapiens
  misc_feature 4, 5, 6, 9, 13, 14, 15, 16, 20, 23, 25, 26, 35, 39, 43, 46,48, 49, 52, 53, 55, 57, 61, 63, 68, 70, 71, 74, 75, 77,81, 82, 85, 88, 97, 105, 106, 109, 116: n = A,T,C or G
aaannnaanaagnnnnaagnaancnnttaagagangaangatngangnnagnntntnaatngnaaggntnnatnncnacanntgntantctcggatntaatgtannccnatgaagnaagaaaaccttggaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaag

SEQ ID NO: 1535 - DNA, 300 bp, Homo sapiens
ggcacgaggcactaagcaggctagtgctctcagcttcccggcctccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccacc

SEQ ID NO: 1536 - DNA, 300 bp, Homo sapiens
aaaatgccttcattttcctttttactttatcatgagacataagatttattggcttcatatcaacccttaagtattgttaactttatgtaatagcatttgggttggggattggtgtgttttcggttgtacatagcatagttgaattatgttaggcataattatgaccttattattgtctttatttgaaaattatatatgatctcaggaaatgtgtatgagttcaagttgacaaggagtggatttgggatggttgatactgagtgtcaacttgattggattgaagcatgcagagtaataatc

SEQ ID NO: 1537 - DNA, 300 bp, Homo sapiens
  misc_feature 143, 144, 145, 146, 147, 148, 149, 150, 151, 152, 153, 154,155, 156: n = A,T,C or G
ggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgnnnnnnnnnnnnnntattcagcttatcctaaacctgaaagaagagtgagtagactttaaggatcaagataatctggggcttcccagttgtgtcggccaaggacctgagacctgaagggttgactttacccatttgactgggagtgttgagcatctgtc

SEQ ID NO: 1538 - DNA, 300 bp, Homo sapiens
ccccggtgtccccgcgaggggcccggggcggggtccgccggccctgcgggccgccggtgaaataccactactctgatcgttttttcaattgaccgtggaggcccccatgcccaagctagccacgcagtccaacgagatcaccatcccagtcaccttcgagtcgcgggcccagcttgggggcccagaagctgcaaaatccgatgagactgccgccaagtaaaccccttagcccggatgcccacccctgctgccgccactggctgtgcctcccccgccacctgtgtgttcttttgatacatt

SEQ ID NO: 1539 - DNA, 281 bp, Homo sapiens
  misc_feature 117, 123, 135, 136, 145, 151, 153, 171, 180, 181, 192, 194,198, 221, 223, 225, 226, 228, 231, 232, 234, 235, 237, 238,243, 247, 249, 255, 256, 258, 263, 267, 274, 275: n = A,T,C or G
caggcgtactgacaggtggaccaacggactgatttagaagagaacaagcatgcgctccctacattccagccacatatcacaaacgactacggtctggacaactttgacacacagttnaccagngagcccgtgcanntgaccccanacgatnangatgccatatagaggatngaccagtcnnagttcgaaggntntgantatatccatccattattgctgancncnnanganncnntnntcatntacntntagtcnntnttttngctntctcccnnccactc

SEQ ID NO: 1540 - DNA, 300 bp, Homo sapiens
tttcggccaactagaggagtctgaaggaccagacaattgctcagaaacagaaggctgtttagaattttctaaattcattaagggcaattctggtacttttctggaaattggctttaagagctcatcctgcatttttaaaatctctccaactggatcaaattttttatatactcgtttgataggtttttttaaaacacatgactcttcaggactacaagcagtattagtctggtttcctacagaagcctgtcctgaggaagaatttggactagctggtctggaacttaagttagaacccac

SEQ ID NO: 1541 - DNA, 262 bp, Homo sapiens
  misc_feature 222, 223, 224, 225, 226, 227, 228, 229, 230, 231, 232, 233,234, 235, 236, 237, 238, 239, 240, 241, 243, 244, 245, 247,248, 249, 250, 253, 254, 256, 257, 259: n = A,T,C or G
gtcagggctggactgtgagcctgtgcttgggtcctggaggaggtgagggaggtatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgnnnnnnnnnnnnnnnnnnnnannntnnnntanngnntnatg

SEQ ID NO: 1542 - DNA, 295 bp, Homo sapiens
  misc_feature 250, 251, 264, 274, 283: n = A,T,C or G
gggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgannggaagaatgggtncctcacttgntattgaaanctctgaagaaga

SEQ ID NO: 1543 - DNA, 300 bp, Homo sapiens
agaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtct

SEQ ID NO: 1544 - DNA, 300 bp, Homo sapiens
aagtagaggaggaagttcagacaatttcataagtgtctaaaaagagacagttatgcgaccattgacgaggagtaaaagtcgtctattgagcatcttattcactacaaatagaagaaagaaataccagtttcctgacaagccccaccccatgcttggccagttcctgagtacacttaatatattttagaggaaaagatgctagaaccacaggagaatggcgtgattgacctaccagattatgagcatgtagaagatgaaacttttcctcctttcccacctccagcctctccagagagacaa

SEQ ID NO: 1545 - DNA, 300 bp, Homo sapiens
gtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccacccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgccgtct

SEQ ID NO: 1546 - DNA, 300 bp, Homo sapiens
ggcgtgcctaatgggaggtctatataagcaatgctcgtttagggaaccgccattctgcctggggacgtcggagcaagcttgatttaggtgacactatagaatacaagctacttgttctttttgcaggatcccatcgattcgaattcggcacgaggaaggaggacctaggcacacacatatggtggccacacccaggagggtagtggggagttagatttcagagtccaggccctaggttgggacccactccaaataatctcctcggtgtgggtggtggttctatagagggataaagaataa

SEQ ID NO: 1547 - DNA, 300 bp, Homo sapiens
ccaaggcgcagcccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccattgatgtgcggaagctggacttccccagtgcttcttttgatgtggtgctcgaga

SEQ ID NO: 1548 - DNA, 300 bp, Homo sapiens
gagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgca

SEQ ID NO: 1549 - DNA, 300 bp, Homo sapiens
  misc_feature 198, 199, 200, 201, 202, 203, 204, 205, 206, 207, 211, 222,223, 238, 240, 241, 242, 248, 251, 272, 274, 276, 283: n = A,T,C or G
agtccacattaaaaagaaaacaaaacaaaccctaactaacttccaaatgggtctcctggtgcgggggcgtgagtggccgtgccctgggtgtgctgcctgtctgagcaagcttccctagctgaggaaccccgggccccctgctgcgggctctgccttggtgtcatgcctgctgcacccccgtttacactgatgtgccannnnnnnnnntggnggtttggagcnnacatgctactggtcnannnacacangtnccggggcatcatgagaaaggntngntcttggnaccttgtcctccccagt

SEQ ID NO: 1550 - DNA, 300 bp, Homo sapiens; identical to SEQ ID NO: 387

SEQ ID NO: 1551 - DNA, 300 bp, Homo sapiens; identical to SEQ ID NO: 388

SEQ ID NO: 1552 - DNA, 300 bp, Homo sapiens
aaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgac

SEQ ID NO: 1553 - DNA, 285 bp, Homo sapiens
  misc_feature 163, 164, 165, 166, 167, 168, 169, 170, 171, 181, 185, 197,210, 216, 218, 219, 221, 229, 237, 242, 246, 253, 254, 257,260: n = A,T,C or G
gagagagagagagagagagagagagagagagagagagagagagagagagagagagagagagagagagagagagagagagagagagagagagagagagagagagagagagagagagagagagagagagagagagagagagagagagagagagagagagagagannnnnnnnnggtcttctcntgcntgatgcctcttntcactgcctgganccctgntnnangccctcgnatctcccntgctnccgngcctttnnttngancctggtggtctcctctcccattgct

SEQ ID NO: 1554 - DNA, 275 bp, Homo sapiens
  misc_feature 164, 165, 166, 167, 168, 169, 170, 171, 172, 173, 175, 177,180, 192, 193, 195, 198, 199, 201, 203, 205, 207, 209, 210,224, 227, 233, 236, 242, 243, 249, 250, 251, 252, 253, 259,261, 262, 263, 272, 274: n = A,T,C or G
gagagagagagagagagagagagagagagagagagagagagagagagagagagagagagagagagagagagagagagagagagagagagagagagagagagagagagagagagagagagagagagagagagagagagagagagagagagagagagagagagagnnnnnnnnnngngngcnctcccgcgcgcnngnctnncncncntntnntctctctctctcgngcncccccnccncccccnncacacnnnnncagagngnnnctctctctntnt

SEQ ID NO: 1555 - DNA, 266 bp, Homo sapiens
  misc_feature 192, 193, 194, 195, 196, 197, 198, 199, 200, 201, 202, 203,204, 206, 213, 217, 218, 219, 220, 221, 222, 225, 228, 229,230, 231, 232, 233, 234, 238, 239, 241, 242, 246, 247, 248,249, 252, 253, 254, 257, 259, 260, 261, 262, 263, 264: n = A,T,C or G
ataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcatcgactgaaggactgcttttggcttctggatgccctnnnnnnnnnnnnntngtgtggngtgnnnnnntanctnnnnnnntttnngnncctnnnntgnnnttntnnnnnnct

SEQ ID NO: 1556 - DNA, 300 bp, Homo sapiens
gtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccaggtaatggttgtgatgactcctacctgggaggacgccgtgattgggctgagctaccttgattgagtgagggggcaatctgcaatttgcagggaaatcctgagttcaggctgcactgcagagcgttccttgagccaccca

SEQ ID NO: 1557 - DNA, 300 bp, Homo sapiens
tgtggagaagccttctttttctatgggaaatcacttctggagttggcaagaatggagaatggtgtgttgggaaacgccttggaaggtgtgcatgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttga

SEQ ID NO: 1558 - DNA, 291 bp, Homo sapiens
gttttgctcgtttagggaaccgccattctgcctggggacgtcggagcaagcttgatttaggtgacactatagaatacaagctacttgttctttttgcaggatcccatcgattcgaattcggcacgaggttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctat

SEQ ID NO: 1559 - DNA, 294 bp, Homo sapiens
  misc_feature 8: n = A,T,C or G
tcctccanggccgtggttgtgaaaaaggtcgaggcccctgatgggaagctggtgtctgagtcctctgacgtcctgccccagtgcacaagttcggcagcccctcccagccttcccctcctgcgctgccccagagcctgggaaggaggccgctttgcagggtagcactgggaacagggaacccccctgaggctccgccctagcccttagcccgcctggggagtttacttcctggggaccccccttgcccatgcctccagctacaacaccattccattgcttttttttttggtccag

SEQ ID NO: 1560 - DNA, 289 bp, Homo sapiens
  misc_feature 212, 215, 217, 220, 224, 229, 230, 237, 240, 242, 244, 251,252, 260, 281, 282, 283: n = A,T,C or G
ggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgctaatatatagagcacctggaagcagtaacatgcaaatgtcagcaagaatatncgntnaangganctgtnnatgctanttnananataatcnnagctgganagggagctttttaagcttaannnaatgtt

SEQ ID NO: 1561 - DNA, 300 bp, Homo sapiens
cgacggcaaggtggtgctgtcccggcagtacggctcggagggccgcttcacgttcacctcccacacgcccggtgaccatcaaatctgtctgcactccaattctaccaggatggctctcttcgctggtggcaaactgcgggtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgctt

SEQ ID NO: 1562 - DNA, 300 bp, Homo sapiens
ggggggattccactcctgttttgtgagtaggcgacccatgggctgcccagccttaaagccagaacaagggtgtcccctgacctcgttccactgccctcctcccgttcccatctttcccccctaccttccccttaggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcaggg

SEQ ID NO: 1563 - DNA, 300 bp, Homo sapiens
gtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgaca

SEQ ID NO: 1564 - DNA, 300 bp, Homo sapiens
  misc_feature 59, 60, 61, 62, 63, 64, 65, 66, 67, 88, 96, 112, 116, 155,159, 162, 176, 194, 201, 208, 215, 218, 223, 227, 233, 239,246, 258, 261: n = A,T,C or G
gtggctatccatcaacataagtaaaaaaaaaaaacacttcaactccctcccccatttannnnnnnnnttaacatattttaaaaatcanatgagttntataaataatttaaanaagngagagtatttatttttggcatgtttggcccaccacacanactntgngtgtgtatgtgtgngtttatatgtgtatgtgngtgacanaaaaatntgtaaanaanaggcncatntatggntactgntcaaatncttaaagataanttnattttcacacagtccacaaggggtatatcttgtagtttt

SEQ ID NO: 1565 - DNA, 300 bp, Homo sapiens
gtttgtgcatcacttggtcaccattgggcttatctccttctcctacatcaacaatatggttcgagtgggaactctgatcatgtgtctacatgatgtctcagatttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgct

SEQ ID NO: 1566 - DNA, 300 bp, Homo sapiens
acaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcagccccagctaaggttgaagccaaggaagagtcggaggagtcggacgaggatatgggatttggtctctttgactaatcaccaaaaagcaaccaacttagccagttttatttgcaaaacaaggaaataaa

SEQ ID NO: 1567 - DNA, 300 bp, Homo sapiens
gcaaggcgccgggggacacgttggctgcgttttcggcggactggccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctcccc

SEQ ID NO: 1568 - DNA, 300 bp, Homo sapiens
agaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgactcaaagggg

SEQ ID NO: 1569 - DNA, 300 bp, Homo sapiens
tgtagaggaggtgaggaaatactttaatgtgttggaaaccatgggtttgaacagaagatacgcatatggagtggggaatggaaagaaaactttgtgctacatttactgtaaattatatcttattgattcagtaaattcaggtggaatacggaagttcaaatttaaagattacccatggactcctgacctcaggtgatccacccgcctcagcctcccagtgggctgggattacaggtgtgagccaccatgcccagcctcatcattcttattaactggtttaatcctttcaataatcctatt

SEQ ID NO: 1570 - DNA, 300 bp, Homo sapiens
tcggcacgagggcaagggacttcctgtaacaatgcatctcatatttggaatgacccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttg

SEQ ID NO: 1571 - DNA, 300 bp, Homo sapiens
cgtccgctctcattggctctgctggtccagaaagcagcccaggcctttaactccgggctgctgtgtgtggcatgtggttcataccgacggggaaaggcgacctgtggtgatgtcgacgtgctcatcactcacccagatggctggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggac

SEQ ID NO: 1572 - DNA, 300 bp, Homo sapiens
atagtcagaaaacaacctggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacaca

SEQ ID NO: 1573 - DNA, 300 bp, Homo sapiens
gtccaggcttccttctgatggccaacccacctttaatgctggccagtctatctcacacaaagttctaagttttccaggtgtcatagtaactccatagtctcccttaaatccctttttgaaatttttcaacatagttcctagtgggatgggcttactttgtgcctgacccatgttttctcaagacaaaacaccatggcaggaacagccacttgcatctggtcccggtgccacactgcggtgcttggtgtggttgtggagcctgtccctgcgcgccttgctcccgttgagccacgctgtctg

SEQ ID NO: 1574 - DNA, 300 bp, Homo sapiens; identical to SEQ ID NO: 397

SEQ ID NO: 1575 - DNA, 300 bp, Homo sapiens
gtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgccatcatctctcagcaaggtgacatatttgtttttgacctggagacc

SEQ ID NO: 1576 - DNA, 300 bp, Homo sapiens
cactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaa

SEQ ID NO: 1577 - DNA, 300 bp, Homo sapiens
  misc_feature 290: n = A,T,C or G
ggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcancaagctggag

SEQ ID NO: 1578 - DNA, 300 bp, Homo sapiens
ggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggag

SEQ ID NO: 1579 - DNA, 300 bp, Homo sapiens
ggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgatgagcgggtccacgaggagctctgaggggcagggagcctggccaggcctgagacacagaggccca

SEQ ID NO: 1580 - DNA, 300 bp, Homo sapiens
  misc_feature 209, 210, 211, 212, 213, 214, 215, 216, 217: n = A,T,C or G
ttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccgnnnnnnnnntgacccctgccttcacacccccctcctgccgctatgccgtttaactggcgactccggtattgagctctgcccttgtcctgcct

SEQ ID NO: 1581 - DNA, 300 bp, Homo sapiens
agaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtgggg

SEQ ID NO: 1582 - DNA, 300 bp, Homo sapiens
gaatgacattcatgccagttcttccctgaatggcagaagcactgaagaagtaaggcccattgatgaaaacttggggcaaactggaaaatctgctgtttgcattcaccaagatataaatgatgatcatgttgaatatgttacaggaattcagcatttgacaagcgattcagacagtgaagtttattgtgattctatggaacaatttggacaagaagagtctttagacagctttacgtccaacaatggaccatttcagtattacttgggtggtcattccagtcaacccatggaaaattctgg

SEQ ID NO: 1583 - DNA, 300 bp, Homo sapiens
cgggactggtaccaccgcatcgaccccaccgtgctgctgggcgcgctgcgcgttgcggagcttgacgcgccagctggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccaccttggacaacctccagaagggagtccaatttgctctcaagtaccagtcgctgggccagtgtgtttacgtgcattgtaaggc

SEQ ID NO: 1584 - DNA, 300 bp, Homo sapiens
gtacgagagtctgttgaacaacaggctgatagtttcaaagcaacacgttttaaccttgaaactgaatggaagaataaactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatat

SEQ ID NO: 1585 - DNA, 300 bp, Homo sapiens
cagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaa

SEQ ID NO: 1586 - DNA, 300 bp, Homo sapiens
ggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccac

SEQ ID NO: 1587 - DNA, 300 bp, Homo sapiens; identical to SEQ ID NO: 402

SEQ ID NO: 1588 - DNA, 300 bp, Homo sapiens
agaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgaca

SEQ ID NO: 1589 - DNA, 300 bp, Homo sapiens
attcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgt

SEQ ID NO: 1590 - DNA, 300 bp, Homo sapiens
  misc_feature 3, 5, 7, 14, 16: n = A,T,C or G
ganancncagatcncnttgaaatgcctctcttttaataaacgtttcctttgttcactattgcctgctagttcatcttgtaaatccttggctttaagctccaacttagtcctctgcttaatctgctcttgtctttcagcactaagctgttctttttcttctttcatagctgaaatttttgttttcaattctctaacttggcgttcgatatcctccattttatctcttgcatcctgctgagcatctcttaattgtctggatttttctccactagtctctcgcttagcagaaagctcatcaag

SEQ ID NO: 1591 - DNA, 300 bp, Homo sapiens
ccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctg

SEQ ID NO: 1592 - DNA, 300 bp, Homo sapiens
attctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaacca

SEQ ID NO: 1593 - DNA, 300 bp, Homo sapiens
tttacaatcaggaacttaacgagactcgtgccaaacttgatgagctttctgctaagcgagagactagtggagaaaaatccagacaattaagagatgctcagcaggatgcaagagataaaatggaggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaaggaaacgtttat

SEQ ID NO: 1594 - DNA, 300 bp, Homo sapiens
gacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgatgctgacatgggaactgcagattctttgcgctacatatatccaaaacttaagacagatgtgctggtgctgagctgtgatctgataacagacgttgccttacatga

SEQ ID NO: 1595 - DNA, 300 bp, Homo sapiens
gttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccag

SEQ ID NO: 1596 - DNA, 300 bp, Homo sapiens
aaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggacca

SEQ ID NO: 1597 - DNA, 300 bp, Homo sapiens
gacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaattta

SEQ ID NO: 1598 - DNA, 300 bp, Homo sapiens
cagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaa

SEQ ID NO: 1599 - DNA, 300 bp, Homo sapiens
cagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcc

SEQ ID NO: 1600 - DNA, 191 bp, Homo sapiens
  misc_feature 129, 130, 140, 150, 151, 152, 155, 156, 160, 165, 170, 174,176, 178, 186, 187: n = A,T,C or G
cccagctccttgggaggctgaggcgggagaattgcttgaacccggggacggaggttgcagtgagccgagatcgcactgctgtacccagcctgggccacagtgcaagactccatctcaaaaaaaaaaaannaaaaaaaaanccctgttaannncannggtntaagngaatngttnangnctttaaannaggt

SEQ ID NO: 1601 - DNA, 179 bp, Homo sapiens
  misc_feature 151, 158, 163, 165, 172, 173: n = A,T,C or G
caaataagttaaatgtatatggcattggattggaattggaggtatcagtgtgaactcatggttttgggttttttgttttttgccttttttgttttgtttttgttttttgaggcagggtgtcactctgttgcccaggctggagtgcattagncaccatnacagntnagcacannctatgc

SEQ ID NO: 1602 - DNA, 300 bp, Homo sapiens
  misc_feature 190, 192, 198, 199, 200, 204, 205, 208, 220, 228, 244, 251,256, 259, 264, 272, 282: n = A,T,C or G
caacagtcccaaccagtcgaattagacccatttggtgctgctccatttccttctaaacagtagatacttctgatggattctcggcattaactcctgtttcataaaagtgtgaacagttttatgaatttgaaagaaaatttggtagctctttatagcattcattcttaaagatcagtcctaataggtgatntntaaatnnnccanntanaagaatgaagcntctctacngggtagtaacttgatncctcttnagganaanagggngctaaatngcaagctctnactaatggttctgctact

SEQ ID NO: 1603 - DNA, 62 bp, Homo sapiens
ggggtatcagttactggatctaagcatgtccactctacacgctttttttttttttttttttt

SEQ ID NO: 1604 - DNA, 300 bp, Homo sapiens
cacaaggtcaggagttggagaccagcctggccaacgtggtgaaaccccgtctctactaaaaatacaaaaattagccgggcgtggtggcacatgcctgcagtcccagctactgagaaggctgaggcaggagaatcgtttgaatctgggaggtggaggctgcagtgagccaagattgcgccactacacttcagcctgggcaacagagtgagactctgtctaaaaaaaaacactaagcatgtagtttctatataactagaagcataggatattctgatctgcaatccatcaatcagtgccaat

SEQ ID NO: 1605 - DNA, 300 bp, Homo sapiens
tttgaatatggactatagttagataatagtcttaggtaatagttaaatgtcctgggtttgattattgtggttatatgggggaatgtccttgtactcagaagacatatgctgaagtacagtatttagagataaaagtgtcatgtttgcaactaactttcaaatagttcagaaaaaaaaatatgtatatatgtgtctgtgcctgtatatgaaagagagaacacaaatgtggcaaaatattaacaattggtgggccaggtatggtgggtggctcatgcctgtaatcccagccctctgggaggc

SEQ ID NO: 1606 - DNA, 284 bp, Homo sapiens
  misc_feature 267, 277: n = A,T,C or G
cctttaaaaggcagctgcaaatgacccatttttgtgataaaactaactcagagtacaggtgcaaccccactgatgtaaacagcttttgaggctttgaggttttagatgacagtcatctaaaacaccagcttctcaaatacatcagcttcaggcctgggctgagcctgaggagcctcctaggaagttagagatttttgagctcaaagggctcaggagaggcccaatagttttcatgcttcattaacccgaaggcttcccgacaatcgnccaagggttnctaaaag

SEQ ID NO: 1607 - DNA, 289 bp, Homo sapiens
caaagatactggatactagaaggcagtggaggaaggtcttccaagtgaggatgaaacattttaaacctaggatccattaaatccgaaggctaaagaaagtcaccacacatcaggactaaaatgttgacttcccataaacactattttattttatttttattttattattttattttattgtatttttcttagactgagtcttgctctgttgccaggctcaagttgcagtgagccaagatcacgccactgcattccagcctgggcgacagagcaagattccatcttaaaa

SEQ ID NO: 1608 - DNA, 295 bp, Homo sapiens
  misc_feature 216, 224, 231, 239, 251, 262, 265, 267, 275, 281, 283, 285: n = A,T,C or G
ccagcctggccaacatggcaaaacactgtgtacactacaaatagaaaaattggccgggcatcatggtgtgtgcccgtagtcccacctactcaggaggctgaggcaggagaatcgcttgagcctggagggcggaggttgcagtgagacgataccgtaccactgcactccagcctgggcaacagcaagactccgtctccaaaaaaaaaaatttaaaangatttttnttatggnggtttcanaaatggttgtgnggcaggctggntgnantggcacangcctgnantnccagcacttt

SEQ ID NO: 1609 - DNA, 297 bp, Homo sapiens
  misc_feature 9, 10, 26, 29, 30, 33, 52, 58, 62, 71, 75, 110, 114, 122: n = A,T,C or G
cagtgaatnngtaagttcaatctgtngcnnatngaggtaaaatatttatagnataaanctgngcagcttanccanttttgaatatgcaattcagtggattaagtacattntcantgttgtanagccatcgccatcatccatctccagaagttgtgcatcttaccaaattctgtgcccagtgaacaataactccccacctccccttcccctagcaacagccaccccttttgtctctatcatcaacttcactactcatatttctcatgtaagtggaatcatacagtatttgtccttttg

SEQ ID NO: 1610 - DNA, 300 bp, Homo sapiens
ctctcatggagctccagagtgacatccagcattgttagcatgcgatcaacatcatagaccatcagtgtgcaacacgagttaccaagaggggctttcttagtggaaagagagtgataaattggtaacatggaagctacttcctgtgttctttttctgagaactagaagaaggaatacaagttggccccatgctaatgtgtatataccttttttacataccaatcactagtgtgtttagaaattaggaaaggtcagtaagtctccagtatatataaacatctatagtgtatggaaaggtctt

SEQ ID NO: 1611 - DNA, 290 bp, Homo sapiens
  misc_feature 28, 31, 37, 41, 57, 59, 62, 66, 68, 69, 71, 72, 74, 77, 84,92, 95, 100, 104, 113, 121, 128, 130, 135, 138, 150, 161,163, 164, 176, 180, 189, 191, 193, 198, 202, 206, 208, 210,213, 220, 225, 230, 233, 237, 242, 248, 249, 252, 254: n = A,T,C or G
  misc_feature 257, 260, 267, 274, 280, 282: n = A,T,C or G
cgagtttttttttttttttttttaatanatncggcantttnatttcaatcgcccaancnaanttancnngnngnaancttaaangaaccaanttnaaccnaaanagttccggnaaaaatancaaaaancngaaanttntaaaagggaagnccccctaaaancnngaaaattcaccnttcnttagggttncntnttcantttngatngncnctngaggctngcaanttttnaancaanctttnaaatcnngangnctnttntgaaaanatttcanccccancnctaaaatt

SEQ ID NO: 1612 - DNA, 300 bp, Homo sapiens
agggacaaggctataaatatcattaataccaggttcaggagtttgcactgcactaaaaatcaactcagctatttgagcaccttttatagagtggaaatggggttgggcagtagagaagagcacttttagagaggcttttctgcagtagtcaggggttacacctgttaaccagccataattttttttttaagcggctgtgctgaggatgagccccatgtagttggtgcaggtggggacacactgcctgtgtaactagaaaaactaggcatggccgggcacggtggctcacacctgtaatcc

SEQ ID NO: 1613 - DNA, 300 bp, Homo sapiens
ctgcaatttctccaaagcttgccactttccagcctgtttccccaattcctctgtgctctcctagagctctgtctgaatcctcgcagccacacctaggtctgagaactcaggctttgagttactgatcttccttggattaggagaacaggtgttcctcctcccctctcctagcagccctaatgtctgacctagcctatcaagccttaggcgctggaagaacccttctcagacacgcaggacccaggtaaagtcaaagctttgcccttttgcccactgtctgctaccagggctcacccactg

SEQ ID NO: 1614 - DNA, 300 bp, Homo sapiens
aggggccttacattactttcttgcagcactgatggcttttgtttgaggctgcacaaattcctgcatttcccttgggttgaatggtagggatgcgggcagttggtgactgggtgaaccacctgacttgagcagggctacgactctctctgcaaacgaaacccagagacatgaacagtgctgagatttctcagtggtttcccatgtaggctgctttccaagggcagcaagcatggcttcatcactcacccagtgcttctgattcagcactgtgatgctcggttaagttttaatgaggtttta

SEQ ID NO: 1615 - DNA, 300 bp, Homo sapiens
caagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggc

SEQ ID NO: 1616 - DNA, 300 bp, Homo sapiens
gagtatttgctggtgcattggagagtttcacgtaattcttgtgcagattcagcaagagagtttgccggcatgctttgcacagcccctggtacccagtaaggcgattattagcattggtgcttgctggaatcagatattccagaatattctgtcacagctcatcgttgccctcttcttttctgtgggtaaactgaggcagaaactcaggctgggtggaactctgcagcctcagctggagacctcgtctggccaaggactgtggggacacaggccctctaggctgccacctcatggtcccag

SEQ ID NO: 1617 - DNA, 300 bp, Homo sapiens
cccacctcggcttcccaaagtactgggattacagacgtgagccaccgcacctggcctaaatttcaccatcgtttctattcataacttacctgcaaagtgattatctgactagtactactgcaacaaagataataaagtgcctgatgtttatatcaaataggatatggcatgtttctgagtgtttctaaagaaaaatactgaatgaacccctcgcctaacctagtgcctgtggtaacaataactgacatgcattgagcgcttactgtgtgccaggtgcttgttcgaggtactttaccggta

SEQ ID NO: 1618 - DNA, 300 bp, Homo sapiens
ccaggcttgaagttatctctaatttagaggttagggacagtgacacaggaaagaggctctgagctttatatctggagatgtgggatcataaaaacgtctttttaatctgatgatcattaaaacacccggagatgaggcacagctgctaatcggaatacatttccatttctgcggggattgagcatgtcttcggaaccctctgcaatagctttagaaacaaacgttccttttatcaggtgagaaaactaccctatggcatgcctccggatatgtagttcttcctaggctacaaaatatcag

SEQ ID NO: 1619 - DNA, 300 bp, Homo sapiens
ttttcagccacctccactgactcctacctccaaagtttatactatcagaccttattttcctaaggatgaggttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtac

SEQ ID NO: 1620 - DNA, 288 bp, Homo sapiens
gttttctcctgttacatcatgctgaatcctttcccttagccattagcttttattatgtggtcttcataggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagg

SEQ ID NO: 1621 - DNA, 300 bp, Homo sapiens
tgaaactttgtaatttggaccccctaattttgtacatgttgatgataggaataagggcttcgtttattttcactgcatgctctctatggaaagaggatgtgctaagcaaacaagcattgtaaacaatatttcagaggcaaggttttggcctgctttaaaaaaataaaatgtttgcaagtacaattaaaaaccagtataagggacaggggtgggatgaaaacctgtctctaagattacgaagcctgcgttatttcccctaaatccccttcgaggaagatttgaatccctcatcaacaaatt

SEQ ID NO: 1622 - DNA, 300 bp, Homo sapiens
  misc_feature 225, 227, 235, 242, 245, 248, 249, 253, 284, 290: n = A,T,C or G
gcctctgtcctgaactttttaacccggtgccacaacccgagggtctccataggggcaggtaaacggggattttaatcattttaagtgtcttagaatgatattttgggaaaaagcactccttttcctaaggactgcgactcggtgaacagaaaggaggctatgcggtgtggccagccaactcaaggaggacgaagcagcctttgcctctaaactgcctggaaccanangcgtattnttctganccntcnnaggnagtgctgagtactgatgcagtctgtagggantaactnccttcccctg

SEQ ID NO: 1623 - DNA, 300 bp, Homo sapiens
gttaagagcactgaagcgggggtcagaggcctggctttgtctataactcaccgagtggcactgggcttccctctgccttcacgtttcatctctgacctgaggggcctggctagatggctcttctggctttgacacatttctactggggcccaggctcaagtctcggtggccctgggtggtcactggagactgttcctgtggaggccacttcaaggctgccccggaggtcgcccaacctgcttctacagcaccctggggtcgccccttccctaacgaggagctcccaagatgtagttttgt

SEQ ID NO: 1624 - DNA, 294 bp, Homo sapiens
  misc_feature 173, 188, 197, 209, 215, 262, 266, 275: n = A,T,C or G
ctagagtgcaatgttgcagtgcaatgctgcaatctgggctcactgcgacctccacctcctgaggcaggagaatggcgtgaaaccaggaggaggagcttgcagtgagccgagatcgtgccactgcactccagcctgggtgacagagcgagactccgtctcaaaaaaaaaaaatntaattatcaaatgcntcccattgngatagtcctacnttatgngacattaacctatattcctgggtccttttaattcccaactactgctnttanaggtcttanccttttatgttaattttta

SEQ ID NO: 1625 - DNA, 300 bp, Homo sapiens
agtttaaaaatacttctttgtaaaagttattgcacaaagaaaagacatgaatgtgtccctgttatgtactcacaaggataatgatggggttgttgctcattaatactgtttcttgtgcaataacttttacaaagaagtatttttaaactgatcattaattttatgaccacagaaatgagatgcaaaatttatgctattgtcagtggcacaggctcacagcaccactgacattttgtgtgattgtaatagaatggctgccaactaatgattctgtagacatttcatttgagtgtgcttttc

SEQ ID NO: 1626 - DNA, 300 bp, Homo sapiens
atggggctggccaggcctcacccctgatatccctgagcatctgttccttacaatattgtggagtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgt

SEQ ID NO: 1627 - DNA, 300 bp, Homo sapiens
gctgtgttgcccagactggtcttcacctcctgggctcaagtgatcctcctccctcagcctccccaagtgctgggattatagatgtgagcccctgcaccagacaattatatttatttttaaaaacgcccctcatgaagtctgggtaattctctccagatttctccttatcaacaaatttataagagttaggaaaaaaatgatgtaaataaagcacttaaattgcgacagtggttctattcttaacatcataatgcttatgactaaggagcattcttttttttataaattaaatgtattctg

SEQ ID NO: 1628 - DNA, 300 bp, Homo sapiens
cccaggtgtctatccacttgctagaaaccatcatgagagttagataccagttttctgctggaaatacagaacatttcctgaaaccgtgtggttgaggtgaaacaggcattttgcagtcttatattttgagtaaggccaaacctgcctagtgttataaaactagacaaaaaacccaggtacccggtcttgcaggatagaaatgtgtgactaaaatgaagcatcgatctgagaagactacaaattagcgggaacctttggacaggagcatgctatacattacttagattaatgttgatattt

SEQ ID NO: 1629 - DNA, 300 bp, Homo sapiens
  misc_feature 282, 287, 288: n = A,T,C or G
agacaatcccaaatatttggagattgtcttaactggtttagtgtagctataaaagaatacatgaagctggataatttatgaagaaaagaggtttatttggctcacagttctataggctatacgagatgcatcatgccaccattttcctggagcccttcaggaagcttccactcatggcagaaggtgaagggcagccagcatgttcagtgatcacgtggtgagagggaaggcaagagagagaagagggaggggtcaggctctatttaacaaccagcttttgtnccgtnncatgaggtgaga

SEQ ID NO: 1630 - DNA, 300 bp, Homo sapiens
cctatctgtctactggttggtcttttacactacaggtgcacagcaggagaagatgggttgacctcgtgagtgctgaatagcacgaggaaataaacaggggaaggaagtttgggtgaatagccaaaaggagtgtatttttccagtgatactctcatatcaccttttctaaccttcacagcatagatgtggacataggattggtgcctccatattgagagttgaagcatctgtggcaaaatactgtgtcatgcttggtgctaccacttgaaacagtgctggaacttagattgccctcgtgct

SEQ ID NO: 1631 - DNA, 300 bp, Homo sapiens
gggttctttaacctgtgcttcctctgtcctacttcccatcctgcacagttcatagagtcactttctgactatcctatagacacagtaattggacctgtgtttttttctaatctttatatgacagcacatttcctaattcagggaccatcccctatcccaaattccatcctgtgagatgtgaaacctgtgagttcatgtgaatgagtggttgaagggcttgacgccatgtagtctcttaggaaggcttcagggtgctcttatgttgttgctttgccattatcaaatggcattgattgatcc

SEQ ID NO: 1632 - DNA, 300 bp, Homo sapiens
gccaagctcagtttttcgccttgaatatgaagatgctagaaagagctctgcatttaagcagagccttgtgcaattcccggaccaaatgctgaaactgcaagagtgccctttaaaagaccttcttaggcatgtgacttgttctctaccagaacctttgggcaacatgaaggaagtcaaaggcatttactggcttgctgttgctgcctgcacagcacctgaccctcaaccagcgtgtttgctcctgcttcagtcaactttatatgctttggtcctgtcagataatctcggctcaatgagcat

SEQ ID NO: 1633 - DNA, 300 bp, Homo sapiens
agtcattacaagttaggatcctgggtaaatggcaacctccacctcccaggttcaagcagttctcctgcctcagtcccccacatagctgggactacaggggcacaccagctaatttttgtattttcagtagagttggggttttaccatgttgaccaagctggtctcaaactcctggcctcaagtgatccgcccaccttgacctctcaaagtgctgggattacaggcatgagccatcacgcccggccagctgttggttcttaatgacacagcttaactttattgtgaaaagattgcagcaac

SEQ ID NO: 1634 - DNA, 300 bp, Homo sapiens
ctcattttattttgcatatattaaattgagtaggttcagctctaacataccttaggaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacagtctgacttgctttcagtattcacaagttctttccagtttccaagtcttttcctagcagtaatttaggggagacagag

SEQ ID NO: 1635 - DNA, 300 bp, Homo sapiens
atgcctgccagctgagaggcagttggaagaccaacaagctgagcaggcatttcagcagattcagcagtcagagtgcaccaagaagggtgctttagtttggagtttcaaaaggccatactgtaatagtgaaccagaaatcaagcagccctcagaaagactgaaacgcatctacggatcatctcaatctgattgcataaaggtggttcaagatttattagtgctttttactcgcctctccaatttttcatatataatgtccagcaccacatcaaaaataacccagcatagatggagataaga

SEQ ID NO: 1636 - DNA, 300 bp, Homo sapiens
attttcatcccgaggcattgtctaatgatgtcccactgcgaaggataaagatgtagttttctttgactctgccacctcccactactcagctcactcatacttcctgccatctttcatcttcccaataagtatatcattttcattacattagtatcagactttacattattatgaccatgtaaatgctatttctaactgagccatgtagtatactctgattacttttcctttcttgcacaactttttcttttctatggattgctacttattttttattggttatttgctaagctttctgga

SEQ ID NO: 1637 - DNA, 300 bp, Homo sapiens
ctcatgaggacatcagttctattgggtcagggtcccacccttatgacttcatttaaccttaattacctctttaaaggacctatctccaaatagtcacattgtgggttagggcttcaacatatgaataatggagggatacagttcggtccataacatacactaactgtctttgtatactaatcctcattttgacagattgtcatttaagaaaaaattattcttaagtagaatcattgacttggacccaattggaagcattgttgtcacctctcttttggtgcttcctttttacctttggat

SEQ ID NO: 1638 - DNA, 300 bp, Homo sapiens; identical to SEQ ID NO: 12

SEQ ID NO: 1639 - DNA, 300 bp, Homo sapiens
ctgccatgactgtcatcttcttcatcgttagtcagtttatggaccccttgaattctatccaaggacacccaagaggaccccaagtttggagcctctagagccctgttgttggctctgccactggggagtgttagcgttgctagctctgctgaggttgaaatgaacgtggaaaaaataaactgatacacatatatgtctttgtaagttctgttcaccacatctgctttgacctacaacactgctgtgtttatatcaggttgtttataaaaccttggaaacttcgctttccactccatttgc

SEQ ID NO: 1640 - DNA, 300 bp, Homo sapiens
aggaagcattcacatatcctagaatagatgacttggctatcaaccccttgccggctgtagctccccatttgttgtagtctgtatgtgctatacccaacctagagcagggcgccatgcctggctaattttttttttttactttttacagagatggggtctcactatgttgcccaggctggtcttgaactcctggcttcaagtgatactcctgcctgagcctcccaaagtgctgggattatagacatgagcaattgtacttggctcaaatttttgttttaattgggctttttgtcagaagaa

SEQ ID NO: 1641 - DNA, 300 bp, Homo sapiens
ctgcaaaatggactgtgattcaggacctcctccttacctacgagcaccctgggagggactgactaatggcccagggacacacagtcatcctctgcaggcaacagtcaggcttctacttgctgaagccgtcaagggcttgactgtcacactcagtgttctggaaaacaaatcagtaaagcaatttagaggatcttttgcaaatcagagaaaaagaatcaatacaaggcgaaagaattctgatcagcactttaaaacgtgcttatcagaaacttttcttctctcttttaagctttggttcta

SEQ ID NO: 1642 - DNA, 300 bp, Homo sapiens
gagccacctgaatatttgccacttagcatgtctgatatctatccttgtttcttgtcacaagtatcatccacattacagaccccgttgtacaaaactgaaattctgactgtaacgccatcatgggatagttctgacctgcttgctagttgatatgtgaaagcctgaattttgcttcaaaaaagccattcaggattaacagtgtattgtgtaataaagtggactttgtgtgaaagttggagatcccttgtagataattcagaactactggaagtttcacagtacacttgtaaatgatgaaag

SEQ ID NO: 1643 - DNA, 300 bp, Homo sapiens
gataatcagaaccagactttaaaatgtcctgcacgtgtaccctgcttcttttcagcttccctgccatgtatatccgaggctttgggcctaggggccttatcagtgtgaaattagtccccagtgcaaagcagccagtctcccaagagaccttggcagagctgggagttctgtgtgctttgccttttgaagactcattcagctctgccatgtctcctctacactgttttgtacaaccttactgcacacttaacactcgcatggggatgcagcagtgccccggcataaggattggaggactgt

SEQ ID NO: 1644 - DNA, 300 bp, Homo sapiens
ctggatgaagactaagcatttaaatactaagttgagggcatagtagctggcatgtgcctataatcccagtgttttgggaggcctaggcgggaggatgccttgagcccaggagattgaagctgcagtgaattatgagccaatgcactccagcctgggtgagagtgagaccctatctcaaaacagcaacaacaacaagatacaaattgagaaactgttacttgatttgcgatatgtattctgtccagcagtgatagaataacaaggactgggtttaccttgctattttaagcaacaatatat

SEQ ID NO: 1645 - DNA, 300 bp, Homo sapiens
acctcttcttcattgttaaaatggaaataataatactacctagctcgtgggattgttgtgagacaacaacaaatgagacaacagagatctgaaactctgcctggcccctggtatataccaagtccacagttaaattagcctttgttactaaatcattgtttgggtagaaatcctcagattttggatttctcaagtgctccttttctactgtccaaaaggcagaatgttatttttgctcgattccattatgtaatatcctatgaatttgaaatttcggaggaggcacagcatggggctgtg

SEQ ID NO: 1646 - DNA, 300 bp, Homo sapiens
gtgtggaaacaactttgcatttgtaaacagtttcccctgcgtgcgaagagcctagaaactactctctctcttgagatctgatgtccccagtcccctcattgttgaatgtgaatagaataggaaccaccgttttgcactgttcatggctatgttgagttatgtgggggagaagggcatatggtagtaaactgaattctcctgtctgcctacagctgcatttctcacttgtttctcttctctttagtgctgtgtacatacctctgtcagcactaataacgtgtaattattttatctatttac

SEQ ID NO: 1647 - DNA, 300 bp, Homo sapiens
gctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtggg

SEQ ID NO: 1648 - DNA, 300 bp, Homo sapiens
cagagaggcagggataccagatatggggaaatctgtaattacatgcaggcattaaatatttaaatatatattttcttcttttaattgtggtaaaacacatataacataaaatttatcgtcttaaccatttttaagtgtactgttttgtagtgctgagtgtattacattattatacaaccaatttccagcaccttttcatcttgcaaaactaaaactctttacctattaaacaactactccctgtttctccctcctcccagtccatgagaagcaccattttactatcttttctgtgagttt

SEQ ID NO: 1649 - DNA, 290 bp, Homo sapiens
atgaggtatgaagccatttaatacgaagaagagctaaaagaatgagaacgtgattgcatgaaatgtttagccagaaatcttgggatataggagaagagggggagacttgattgattaggttgtaaatatttgtcctatggaccacggtaacgtggattagcattcagagtagtaaccagtagtgggagttggagtcatagagtattgggtctctttatcccaggagatttccaatggggtcagtttctactgaccttttagagagaccatgctatgctgtcttttttttt

SEQ ID NO: 1650 - DNA, 300 bp, Homo sapiens
ctctagcatgtgccataaattacagtgacctttaaaatctcgcttggtcactgctgaatgggtgagaataggcttggttccagtttttaaggtcacactgtcctaatttgcaatgcatcacaccatgtactaagttggtaacaaccgcttagaggaaagctttcgttatgcaagggagaacatcaaaaagggcacttatcccaaatgaatgcagcaatttaaaccaaagatgtttacgcagggcaagaacaaagtaaggcaggagtttggggtcaactaggctgatgtctttgaacaccc

SEQ ID NO: 1651 - DNA, 300 bp, Homo sapiens
atcgagaccatcctggctaacacggtgaaaccccatctctactaaaaatacaaaaaattagctgggcatagtggcaggtgcctgtagtcccagctactcgggaggctgaggcaggagaatggcgtgaacccgggaggcggagcttgcagtgagctgaaattgcaacactgcactccagcctgggcgacagagtgagactccgtctcaaaataaaaaaataaaatgggaatatcaatagggcctatttagtagggtggaagtatagctctaatgagatggtccatactggtcccccagcac

SEQ ID NO: 1652 - DNA, 300 bp, Homo sapiens
aaatattttcattggttatacaactgctgtgtcttttctgagaaactcagccccaatgtgtaacaccctggattccacggggcagcaaattccacacactgcacccatgttgtgagcggagattttcgggctgaccaaaacttgaggcgaactgagtctccatcttaacactcaaacacacttcatggcggcctggaaacaaggcaatcattatgaagcttcagcccagttcttctgaaaccaacgtattgggcctgcttcattgtctctctaggggctaatcacaaacatgtgggaagg

SEQ ID NO: 1653 - DNA, 300 bp, Homo sapiens
gtggtggctcacgcctgtaatcccaaagtgcatggattacaggtgtgagtgagccaccgcggccggcctctatcattttctgactcagcagctccaccaaaattgacatcctagcaaacactgtgaaggaattaacctaagtgcttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgt

SEQ ID NO: 1654 - DNA, 300 bp, Homo sapiens
ttatgacctatctttgttaattttcctccttttccaggcctgattcctctttttggatagaggaatatttttgaattctggttttgaaatatgagggaaggccaagtctcttaggaaagttttacataaacatctacttagcatagccgaatagttcctgactacaccagaaaagaagtttgagcttccagtctttttaattgtagacaggaaggtaggcaggagagcaataggaaggctcgacaggaaagcagtttcctagtcggtagcaaagggaaggtttaggtccagtttgtgcag

SEQ ID NO: 1655 - DNA, 300 bp, Homo sapiens
cagctatagcactaggcagccttgcatcctgggtgttgaaagtgcaggccattatcctcccctctgacctccaagatgttaggtggcctttctgtgcctcagttttatcatctgtaaattgggtatgattgtactagtgcctagtacataaggagtgctgcaaagattacatgagtgtctttaaagtccttacaacagtatctcacacatagtaagcatggcatgtggtagttactatcattagtccctcttggagcaatgtatattaaaattttaaagacagctgtctggtcaggattg

SEQ ID NO: 1656 - DNA, 300 bp, Homo sapiens
  misc_feature 201, 202, 205, 206, 210, 219, 233, 244, 247, 252, 256, 259,260, 267, 278, 294: n = A,T,C or G
ggcacagtcagggagttagttagtggtagactcagcaggagttggttgctattcagatgtgttggggaaagtgacaggcatagctgactcggggtcattcactaagccaggagcccaggaagacacacagatgcaagcagagatcgtgccattacactccagcctgggctacagagtgagactctgtgtcaaaaaaaaaannaannaaangggccttgngtggtaccaggtanaaaattgaatntcngttgncatnagnnacctgtnctgtatgatcncttcccattccccagntgacgg

SEQ ID NO: 1657 - DNA, 300 bp, Homo sapiens
ccctccttgcccagagcaggcattgctcatccactaggcacttcttcctgccaaggcacctcttcctgccaagtcagtgtctcacgatccctttcaacacagccacgaggaagccatgatacatcaactggcactggcaaataaaatcaaacctatttgcctatccagtcttatcccactttgttgttttctctaagtagttggaaaacaacatgtccagagaaaaataccagaacttattctgagtatgttcttcagagcaaacctttagaatcttaatgatgtttagacactcaggaa

SEQ ID NO: 1658 - DNA, 162 bp, Homo sapiens
  misc_feature 108, 109, 116, 125, 135, 136, 139: n = A,T,C or G
ctcggagccaccccggaagaccatgcgcagaggggtgctgatgaccctgctgcagcagtcggtacatgaccctgcccctgtggatcgctaagcctggtgactagctannacctatntggggctcntctttgtttnnganactacataggacgatcgtggata

SEQ ID NO: 1659 - DNA, 300 bp, Homo sapiens
ggcaacaagaccaaaactctgtctcaaacaaacaaacaaacaaacaaaaaacaatcacattcaaagcttagccaggagaaaaggcgctaggagataccccactgggatccttgaagaatcataacctaaaaatagatgtgaacctgaagtagacaagcgatacaaaatctcagtgagctcagtctgggattggtttagcttgatcactcccattcagctgcctaccagaggactgggcgaacgatcactgaagaaagatgggagtctctacctttctcataagttgtttcaatgaaaaat

SEQ ID NO: 1660 - DNA, 300 bp, Homo sapiens
ttgacggcgcgggctctggactcgctgcttggtaaaaaccttcctcttcctccagtgcgggacgcactctctggtatctcttttgacctcccggaggctttcctttgtcggtcgcggcgccactgtactatggcatacctcgttttattacgcttcgcagatagggcattctgaaaacaaatggagggtttgtggcagccctgagtccagcaattgtatcagcgccatttttccaacagcatgtgctcacttggtgtctctgtgttacattttggtaattctcaaaatatttaaaacttt

SEQ ID NO: 1661 - DNA, 300 bp, Homo sapiens
cagagcttagacatccaaaactaatcaatgctgaggtggctaaatacctagccttttacatgtaaacctgtctgcaaaattagcttttttaaaaaaaaaaaaaattgggggggttaatttatcattcaaaaatcttgcattttcaaaaattcagtgcaagcgccaggcgatttgtgtctaaggatacgattttgaaccatatgggcagtgtacaaaatatgaaacaactgtttccacacttgcacctgatcaaaagcagtgcttctccatttgttttgcaaaaaaatgtttttcatttcc

SEQ ID NO: 1662 - DNA, 300 bp, Homo sapiens
gagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgcaaggtcatcgtcatcggcatgggaagggcattaattaccaaagtggagacacagtcactgtctccaagagcatttggaatcacttcacagagttctcaaggaggggaaggctatctgtcagctcctggcgggactgctgccccat

SEQ ID NO: 1663 - DNA, 300 bp, Homo sapiens
agtgtgatctgcagggagagaaccaattacagtatgcttggagagggtgacatttattctgctgaacctcttctctgcttcacataacgttggccacttcacctttcctgagatgtctctgaggatgggcatattttaaagacttgagcttacatcatcgcatcttgaaagaaccgagtataattgagttgctgatacaagtgggtacttgcaccaggtccgggtcacccacatctctatggaaacacatgtttgctttaaagcccagcaatcagaagcagatccttataggagccagca

SEQ ID NO: 1664 - DNA, 300 bp, Homo sapiens
attaaagttgaagcctttctaatttttgaaggttgagcactttggttattcatggttttatatgacgatcatcttttatccatcgctgcagttttctattttgacttgaattggaggcagagctccaccaccccagtgtgtcgtctgatttcccagactagagtccagcctttcctgtgcttgcctggcttccctccatgttgcttcctaccccaccatctatacccttcacatccaaaatccaaaacctcacactcatacgagaatccctgttagggtcggtttatatttacacactaa

SEQ ID NO: 1665 - DNA, 272 bp, Homo sapiens
  misc_feature 116, 121, 138, 146, 151, 155, 159, 167, 176, 178, 181, 182,183, 187, 195, 197, 199, 206, 207, 212, 213, 217, 220, 221,225, 226, 229, 230, 235, 241, 243, 248, 250, 252, 258, 265,266: n = A,T,C or G
cctcattatccaccacgcacagatggtacagctggggctgaacaaccacatgtggaaccagagagggtcccaggcgcccgaggacaagacgcatgaatgcagaatgaccgcgtgtncttgnctgatcacctggggatnacccctgnacccntgtnttgntcaggacntcttatagntnctnnngttntctttttntnantgttgtnntgatnntttnttnntttnntgnngcttnaaggtntnatgtntntngtggtnattttanntgattt

SEQ ID NO: 1666 - DNA, 300 bp, Homo sapiens
cagatacagcctagtgtccctcagttacacaatagtgtgtcccccagtggtaggacagtctactactgagtcctcctggcatgagtcgagctgagattaggatagggtaatgacccttcagttttggggaagggaccagagctcggccagtgagaagcttccagctccgtctggccatatccaggctgctgagggtcctgggctctgtccttaaacctcatcactgacatgacccagcaaacctcctcaagaggaaaaagtccccttgggtcaaacacagcttgtgcagttctcggggac

SEQ ID NO: 1667 - DNA, 300 bp, Homo sapiens
ctttgccattgtggctgtgcgagctcagcctcctggaaacccgccctgagcttggttaacagcattcactccaggtttagcccagctccaggttatcgcaggcaggactcccgagaacaggttcatgtttgctttttgggaggtgctgcgctaaagtggaaaaccaccctgggccgagtgggacctccccagctgggcggctgttaaccagccaggatgtctgaccctgagaagtcaccgtgcactcttgggactcattcttctcatcagcaggatggggtgatggagcgggccttactg

SEQ ID NO: 1668 - DNA, 300 bp, Homo sapiens
ggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataag

SEQ ID NO: 1669 - DNA, 269 bp, Homo sapiens
  misc_feature 238, 244, 267: n = A,T,C or G
gaacaagctcagcctcatcaacttcaggtgagtgttgggctagaggtagactaggccttgaggtcacagcctgctctccacacagtgagctccagactcgagattttctctcattccattttggttctcagggaaagagtgaggcaggcagcactcccctgactcacactggcttctgcatagggtgctctggggaagcttggccttatgccataaggcatctgggcagggccactgnagctgnctgatgtagcctgcctatttagnat

SEQ ID NO: 1670 - DNA, 300 bp, Homo sapiens
cacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactat

SEQ ID NO: 1671 - DNA, 179 bp, Homo sapiens
  misc_feature 137, 165, 168, 172: n = A,T,C or G
gagctgctcagagctgccttgaaggacggccactcaggcgtgcccctgtgctgtgccaccctgcagtggctccttgctgagaatgctgctgtggacgtcgtgagggcccgagcactatcttccatccagggagtggnccctgatggcgccaacgttcacctcatngtncganaggatgg

SEQ ID NO: 1672 - DNA, 300 bp, Homo sapiens
gcttgaagtctccttggaatctttccttgtggtgcacatgttcttttgattttattccacctttgattgtcccatagcaaaacaaagaacccacttaatggaagaacttgacattctcccatgtttgtttcaaagccacataggcatgtgtctacgagatgctgctttgataatgagttggttatactcctgcatcctactcaattgcataaacattctctaattcctaatggaaaggctgaagaaccttaagcctactcacttggacctgctgttgatgagtgcctgggatgctgagtt

SEQ ID NO: 1673 - DNA, 300 bp, Homo sapiens
ggtaagtaacctgtgcagagcacagaactaggattcagacctacagacccacaagtcagcctctaaggcccacttataactgctcttctgcttgcaaggccctatggatgaaatccagttataacctccttttgctataactagacacagagggaggcgtttctccctaatctgtatttatccagacaagctgtccagcaagatttctgagtgaggggctttaaggaagcaatctgcgggtgtgtagccttttctccctcagcaaatacagaaggagcttatagcccgggctcaccctgc

SEQ ID NO: 1674 - DNA, 296 bp, Homo sapiens
  misc_feature 8, 9, 12, 18, 19, 24, 28, 33, 41, 45, 60, 68, 70, 73, 74,78, 80, 82, 86, 91, 95, 96, 100, 102, 115, 119, 123, 127,129, 135, 139, 144, 146, 148, 150, 151, 155, 158, 163, 168,180: n = A,T,C or G
ctggtcannggnggctgnnccctncccnggccnaccggccngccncatgggtttgccttncccgggcncnccnngggntncngggntgggngctnnaccntncccccctcagggntatntttncctntncccttncctncccgncnananntttnccnggggngggcnaaaaaaaaagtnaaaagaaaagaaaaaaaaaaaagaaacaaaccacctctacatattatggaaagaaaatatttttgtcgattcttattcttttataattatgcgggaagaagtagacacattaaacg

SEQ ID NO: 1675 - DNA, 300 bp, Homo sapiens
gtgggctctcccttaaagacacatggccacagacacctccttcggatatgtaatatgccttcccctgcggccttccgtggtcacagcaacagggactgctcaccccctccagctggggcttttctaacaagcacagtcagaaatgcgcaggcctggggttggggatgaacagaagttgattagtgggcacagaaatacagttagatagaaggaatagttccagcattcgatattacagtagggagactgcatttaacaataattgattgtatatttgaaaacagctagaagaataagaat

SEQ ID NO: 1676 - DNA, 300 bp, Homo sapiens
ggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgt

SEQ ID NO: 1677 - DNA, 300 bp, Homo sapiens; identical to SEQ ID NO: 903

SEQ ID NO: 1678 - DNA, 300 bp, Homo sapiens
cagacaagaatcttccctgccgtcctttagtatgtgcagtactggacctgatggtagagtttattgtaacacacatgatgaaggagtttcctatggatctctatatacgctgcatccaggtagtacacaaactgctctgctaccagaagaagtgtcgggtacgcctgcattacacctggcgggagctctggtcagccttgataaatttgctgaagttccttatgtcaaatgagactgtacttttggccaaacacaacatttttacattagcccttatgattgtgaacctatttaatatgt

SEQ ID NO: 1679 - DNA, 300 bp, Homo sapiens
agaccatttaactctaccccacactttcagtggtgggatgtgaggaagaaagcccatgccaagctaactgaaagcttatttggctccaattcggctgatgttccctcactgcagaatgtcctggaaaccaagggtttgcagctcctaaacctattgcattaggcacacccaagaagaaatcctgttcgatgcacatgctccagtttcaatcagcaacaaggtcaaaagtttccccccactttctgttccacagtgcgttccccttgcagccagacattaggcacagattcatccctattg

SEQ ID NO: 1680 - DNA, 300 bp, Homo sapiens
ctcaccaattagcactgccaccgcaggtctgtgaattgcatgtgaaaatagaatttgtccagaagtgctcatgcaaattgtgcaacacaaatgtggcctccatgtcaagtcctttcacgtgttctgacagactcatgtctttccagatttctctgatcggcgccccccacccccttgacagttaccagagctcataagccaaaggaaatagttcctgttgccatgagtactgtgtctgtggtgaggtttatgagctgctcttagggctgggtttttgcctgagaaaacaatcagatttcg

SEQ ID NO: 1681 - DNA, 300 bp, Homo sapiens
  misc_feature 228, 231, 235, 241, 242, 245, 246, 251, 256, 261, 264, 268,279, 281, 286, 290: n = A,T,C or G
ccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaattttttttttttttttnggnacanagtctnnttnngtcantgcantccanccngggnaacaaatcganantcccntttnaaaaaaaaaa

SEQ ID NO: 1682 - DNA, 300 bp, Homo sapiens
ctaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatga

SEQ ID NO: 1683 - DNA, 270 bp, Homo sapiens
  misc_feature 3, 4, 6, 7, 11, 12, 15, 16, 19, 21, 29, 30, 31, 36, 39, 41,44, 46, 48, 51, 56, 58, 60, 64, 66, 68, 69, 74, 75, 76,77, 78, 80, 81, 82, 83, 84: n = A,T,C or G
atnncnntcgnnaannatncnagaaattnnnaagtnttnancanananaanaaatnancncgcnangnnaaaannnnngnnnnncgaccccaccagctctgtataggcctcaaaggggctgggagtgggctgcccctcgggtaggtgagcttggcaacgtgtcttcaggttggagagagtggataggcaaatgccataaagcacatttccagttcctgtgaaactcctctctccgcaaaaagtggagaacaatttgaggactgaaataag

SEQ ID NO: 1684 - DNA, 300 bp, Homo sapiens
gccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccagg

SEQ ID NO: 1685 - DNA, 277 bp, Homo sapiens
  misc_feature 201, 204, 215, 216, 220, 223, 227, 232, 236, 239, 245, 248,253, 255, 262, 264, 265: n = A,T,C or G
gttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggaggatgagggaggtttcnttncctttcctgcnntggnctnctanaaagntcanagnacccantgnaagananctttaangnncagcatttagtg

SEQ ID NO: 1686 - DNA, 300 bp, Homo sapiens
  misc_feature 223, 230, 232, 248, 250, 256, 271, 272, 273, 281: n = A,T,C or G
gagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgcaaggtcatcgtcatcggcatgggaagggcattaattaccaaagtggagacacaggcactgtctccaanagcattncnaatccttcacagagtncncaaggngggggaagcctatcnnncagctccncgcgggaccggctgcccca

SEQ ID NO: 1687 - DNA, 300 bp, Homo sapiens
cgaggccagttccaggcccactttttgccctgtgagccccctgcatttctggtttctccttttccaggcagctactcggtggagcttctctatttaacatctagttgtgtattcatgtcttttgttgtttctttcagtgatgttgcttatttccccaatgacactgttgggagcttcttaagaacaggctgtctagggacaaggatgtgaagtggtacaagggaaaagtaggccgtttaggacctgtgggtgtgtcatgactgtgcttgtatctcttgttagctttgtggccttaggttc

SEQ ID NO: 1688 - DNA, 300 bp, Homo sapiens
actgaatgggctgtatctggggaatcaaggtattagggttgagcaaaagcaagaggaagtagagcatttgatctcttttcctttgattaggttgaggacaataaagtctcattctctcccttcttcccatgggcagccttatatatgattgaagaacattagtgcaaagattcctcatccagaaataaactcttgtacttctatactaattaaagattcatgtaaattactaagttcttggaaaactatggagaactctgtgggggctgtcattcacactttagtatgaattggtttaat

SEQ ID NO: 1689 - DNA, 291 bp, Homo sapiens
actgagtctgggggcactgagtcagagccagctccgcctgcccaccatgactgggtggctcttatacacatgtactcttcccatctccaggtcccagatgtcgaggcctgtccactctccttttcccctaggcagggatggaggggcgtgtcagtcctgtataatttggagtgactggaggggtgggggtattgatgcatggtattccagtaaacttctctgcttgtgtcctaaaaaaaaaaaaaaaaaaaaaaaaaaaaaaaaaaaaaaaaaaaaaaaaaaaaaaaaaaa

SEQ ID NO: 1690 - DNA, 300 bp, Homo sapiens
attgaaaaagagagttcatgtaaagccgattattatttaatctaaagttatgttcacataggaagcactagtgtagagaaatagggtctgagggacaaggagcctgtgtgcccgtgtcggcagccgagtaactgccaagggtcccctgcttggcactctgctgtcccacttgcttcctgccctctctggattctaacacttgtgccattgtgcatccgtctcaggtcatggtgctgttacttggtgagaaagcattatttaaataccccagatgaggagttaggcactttctccagtttt

SEQ ID NO: 1691 - DNA, 300 bp, Homo sapiens
cacctaacattaggtggcacttaatagtgatgataatcacttatggagtctactaagatgtttgtgaatcccttctcccattcaaaaatcttgacaaccctgtgagacagatatgctcaccttactgatgagtacgggggcttggcaaagtaggtatgttgttcatattacacagctagtaagtggaagagtcaatatcatatactcccagattcagaactttaaataaccccatgctaccttctagggaaagcttctgctatgtgtttggagggttaggtgagagaaaggtgaatttta

SEQ ID NO: 1692 - DNA, 181 bp, Homo sapiens
  misc_feature 65, 68, 78, 82, 109, 113, 123, 124, 129, 132, 137, 140, 141,152, 153, 156, 159, 163, 164, 166, 167, 168, 173, 174, 177,180: n = A,T,C or G
ccggagcagagagcgcaggagccgcggtaccccggcttcgtgctggggctggatgtgggcagttntgngatccgctgncacntctatgaccgggcggcgcgggtctgcngctncagcgtgcannatggncanaatanttnnccttatctttnntgnctngaanntnnntctgnngtnctnt

SEQ ID NO: 1693 - DNA, 300 bp, Homo sapiens
ctccctggtaccctgactaccaggaagtcaggtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaa

SEQ ID NO: 1694 - DNA, 300 bp, Homo sapiens
cagagatgagtcagaacagtctcctcaatcctgaaattcaacaaggcatcagaagggctggctgtggtcaagcccagctgctgtcatgtgaggagatgctcactgtggtcttgttgagctgatggccttggttgagctgatggacaagtgaaggaggccatggggctgtgctgtccttcctgccgtacgtgccattccactctcttcagctctcccctcaacagcatgcgagcccataccttctgcatttttccaggcctgtgagggatataggcctccccttggagcactgagtccgga

SEQ ID NO: 1695 - DNA, 300 bp, Homo sapiens
acggtgtctggtggagaagagctgagcttccctggccccttctgaaatggggtcaggaaggggatcaggagggggattaccctgatgcctgctgcctgctcccatttgatccacccacacagcctctcgaggtaggggcttggcaccccgttgtccagctgtgtgtggcctttctgaatgacgtggttcttgggcatctgagccagtcgccagccatgtgccctgccccacaggccctgggagttcctggtaggatcccacagctgttggcaagtctgaggtttgcctttgcagatggaa

SEQ ID NO: 1696 - DNA, 300 bp, Homo sapiens
gcctccctggaggattctggatgattctgggagcaggtcctggactctacgtgcttcagtgggaatctggacacgtttcttatcctttgggcctcagtttcctcatctgtagaatgggaatgacaacagtacctacctcatggggttaaggctcaggccagttaacaccctaaggagcgatgccttggatgtcgtaaatgctagaaaagcatgagttgttatgaataggtcctggtgccccccaccttccttccacaaaccaagacaaccaaggagccacacctgccacctggctttgct

SEQ ID NO: 1697 - DNA, 300 bp, Homo sapiens
acaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcggctttggcaaaacaagccaagattgactttgaagaacaattccttaaagaaaagagatttcatgatcagattgctgtggaaagagctcaagctcgttatgaaaa

SEQ ID NO: 1698 - DNA, 300 bp, Homo sapiens
aatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaa

SEQ ID NO: 1699 - DNA, 300 bp, Homo sapiens; identical to SEQ ID NO: 35

SEQ ID NO: 1700 - DNA, 300 bp, Homo sapiens
ctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcaggtgagtcaccatgaacacaacaggacttgagggccagctgactaggacaagacatgtatccttgctgccccggggcctccatgccgagactccatgccctgactccaacaggagcatcaccaaactacacctgg

SEQ ID NO: 1701 - DNA, 300 bp, Homo sapiens
ggagggcaggagagtgaccaagcagctagaagagagggtgcagcaccccaaggagaggactgggggagtgggtgttccaggaagggctctggcatgtaaagctgcacagaagtcaaatcagataaagcctgagagggatccatgggatttcttggcaaagggattgttggtgataccaggaagagcagcttcagtggctcatggggagagaagccagattacaggagatcagcaactgagagagtgagtggagagcatcttttaagaatgtcttgagtgcgggccggctgcggtggctca

SEQ ID NO: 1702 - DNA, 300 bp, Homo sapiens
ggagtggggagagggcccacacatattggaaatgcagtgtctgtctcctcccctgaacttctggaaggatcaaatctgatacacacaggcaggtgtgttcaaagtgtcctgggggtgctgatggaagaaagtgggagtgtctgccatgggctgggtcagttaacacccggggtcggcaggctgatgggtcaggagagactgagtctacctcccctttgggagggatcagaaaaatcagagaaggggagctgaaggctccacagcagggggctgtggactcaggctgaaggacctctgagt

SEQ ID NO: 1703 - DNA, 300 bp, Homo sapiens
cacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactc

SEQ ID NO: 1704 - DNA, 300 bp, Homo sapiens
tttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgc

SEQ ID NO: 1705 - DNA, 300 bp, Homo sapiens
ctcggaccttatcagcagcatcacgcaggactaccacctggatgagcaggatgctgagggccgcctggtacgcggcatcattcgcattagtacccgaaagagccgtgctcgcccacagacctcggagggtcgttcaactcgggctgctgccccaaccgctgctgcccctgacagtggccatgagaccatggtgggctcaggtctcagccaggatgagctgacagtgcagatctcccaggagacgactgcagatgccatcgcccggaagctgaggccttatggagctccagggtacccagc

SEQ ID NO: 1706 - DNA, 300 bp, Homo sapiens
ataacctcggctgtttacagtgaggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtctta

SEQ ID NO: 1707 - DNA, 300 bp, Homo sapiens
ctccaacctgcaggtgcctcctccagagccagctctgatactcattttaaaaaccatcccagccaaccaaccgtaggagaacctcgaaggcatcttggaggtccctgtctctgccaggcactccctccctgtcttctcagcaccctgctggcatcacaaggaaatgtgggccaaagaccctcatcccacactaagaatggtccaacagaaaccagcctggtcccaggtggggctcaggctcaggccacgtgccaccaagtcatctatgtgaatatagtgataaaaatgcccaacgttgac

SEQ ID NO: 1708 - DNA, 300 bp, Homo sapiens
ataacgcccgtggtgccccatccctataggagctggtgagattgcagcctgctgcctcccctccatcagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacc

SEQ ID NO: 1709 - DNA, 300 bp, Homo sapiens
actccatctcaaaaaaaaagaaagaaaatgaaaaatggttgagaaagttaagtaacgtcctgaggctggaggggccccgctcctcctcaccttggggagaaggacagcgtgaggctagcctgccctacactgggtggccccttcccctggcctgaagttgcagcacctgcaggctaaaccagcacatgcatgagggctgctgggccggggctttgggagcagccgatgctcctaaaaccctgctctgggtggactcttgggatgcagtttgggtctgtgtctggggctggcagacaagcc

SEQ ID NO: 1710 - DNA, 300 bp, Homo sapiens
ctatggcataaatgaggaacaatgccagagacccatccagggcgacggtcagaatttccacagacacaatggttggatcaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcaga

SEQ ID NO: 1711 - DNA, 300 bp, Homo sapiens
gggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagc

SEQ ID NO: 1712 - DNA, 300 bp, Homo sapiens
cggctctgggattgggttccggattgctgagattttcatgcggcacggctgccatacggtgattgccagtaggagcctgccgcgagtgctgacggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacat

SEQ ID NO: 1713 - DNA, 300 bp, Homo sapiens
agtgagtggtcttaccaaaaatccagtatccttgccatccttgccaaatcccactaaaccaaacaggcgttccttctgtgcccagtcctagtattcaaaggaaccctactgccagtgctgcaccattgggaacaacacttgctgtgcaggctgttccaacagcacactctattgtacaagccacaaggacttctttacccacagagggcccatcaggactctatagtccatcaactaatcgaggtcctatacagatgaaaattccaatttctgcatttagtacttcgtctgctgcagaac

SEQ ID NO: 1714 - DNA, 300 bp, Homo sapiens
gccaggagggcctccaggggttccttgtggaggctcacccagacaatgcctgcagccccattgccccaccacccccagccccggtcaatgggtcagtctttattgcgctgcttcgaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccaac

SEQ ID NO: 1715 - DNA, 292 bp, Homo sapiens
  misc_feature 103, 109, 113, 119, 120, 122, 127, 132, 135, 147, 165, 173,177, 182, 186, 187, 205, 206, 212, 215, 217, 218, 220, 224,232, 237, 240, 246, 250, 256, 257, 267, 268, 272, 277, 279,284, 285, 286: n = A,T,C or G
gcctgatccgccagcagcgcttgctccgtctctgtgaggggacgctcttccgcatgatcagcagccggcggcgccaggataagctgtggttctgctgcctganccccanccanaagctnntncagtncgganacntggaggagggcnccagcccttctaccctgnagagtttntccnagcancttnnctgtggccgacttgaggnntccttntgncnngnttangattgctnccatnttngggagnatgncttttnntagctttttnnggtnctttntnatttnnncttttt

SEQ ID NO: 1716 - DNA, 300 bp, Homo sapiens
gtcattcccatacaatgcaacatccggaatgaggaggaggagaataatttggtcaaatctaccttagatacttttggtaagatcaatttcttggagaacaatggaggaggccagtttctttcccctgctgaacacatcagttctaagggatggcacgctgagcttgagaccaacctgacgggtaccttctacatgtgcaaagcagtttacagctcctggatgaaagagcatggaggatctatcgtcaatatcattgtccctactaaagctggatttccattagctgtgcattctggagct

SEQ ID NO: 1717 - DNA, 300 bp, Homo sapiens
cccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcagagctgcctgcaagcc

SEQ ID NO: 1718 - DNA, 300 bp, Homo sapiens
atttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgggagaaagcaagacaacaggagaaatgaaggcatctccaggagtggaccagagagcagccaagccatagagaagcatcaggtgtgagaatggaaaacgcagaagagacgtacaacttctgaaagatctcaga

SEQ ID NO: 1719 - DNA, 300 bp, Homo sapiens
cttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccat

SEQ ID NO: 1720 - DNA, 300 bp, Homo sapiens
cttagttccacaaataattattgatttgtttaagcgtgatgtatgtgcttgctcaaggaattagaagatgagtatgacaaagctcattccctcagggagttgagtgtttcagagggatgaagtaaaagaagattttaaaactacaagtagagtgtaagaagtatcacgagaaacatcaacaaagggctgaggatagaaggtgataagtctcaagtatctcaagatattcagcagtgaatcttaacataaatttgcttttaggggaagaatttcaagcatattgataggtcttaaattttc

SEQ ID NO: 1721 - DNA, 300 bp, Homo sapiens
gcttcccgcttctgtcccccttggttccttaatgtggctgagcatagccaagtactcagctctgtctcgggatcctcaggaattccatcagcctcgtggggttcctttttccctgctcctggaggcaaattatatgcagcaaaacgtagaactagtcttgtggattttctttggtggaggagcatacaccaatggttccatgtaaaggctccagaatcagaactggcgtcacaccttggtgtcaccccttcctgctgagcctgtctccccaggagtgaaatgagggtaatattcctccta

SEQ ID NO: 1722 - DNA, 300 bp, Homo sapiens
gagaggtttgtcactgggtgcaaggctaagatgctcagttaaagcaggaaattacgttgtttggctgagaaatacgtgtaatttctaagtgtgattattgcaagtaaaaatgagtgatgtttcaacaagagggttattgtaattcagggtatagcaacaattttaatgtaagcgagaagatgtttgtaacacttccaaaaaaatagtactgtatcagtccagtgtccactttcctccaaaccttcgtgcccacgcacacacacataaatacatgcaggattcctgagcagggaaggatcc

SEQ ID NO: 1723 - DNA, 300 bp, Homo sapiens
cctagttggccatcagactttcagcaacttttatcatccagatagtcaccaaatgaaataaaatagaaaaatcccttgagcaatgaaacaattgtgaatgaacacaaagtccatgaatttaatccttatccgtttgctgagccaagcatgtgcatctgcagtgggtggcccaggctggcagcacagataccaccatttcccttttctttgctcagggcatggcctgtttatctcgttgcaccagatgagggttggaaaggatgatggtggtggttgtttcagatctactgacagcaatga

SEQ ID NO: 1724 - DNA, 300 bp, Homo sapiens
ctgacacaaaattcaggtactcatgattataacctgattacagttctacagcaggttaatgaagtttaaataattagaatctattgtcgtaaactattaaaactggttctggtcacttcctttgaggtgagtaatagtgagagtgctattctttcttacctcctgggagcctgaggcacgatgcagagaagaacctcacatatcatgcatcatcagaggactagagtgaactcaggaaatatttgctcttgtcacattttcttcaccggagctagagactttttactaggaaaaactgcg

SEQ ID NO: 1725 - DNA, 300 bp, Homo sapiens
aatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactg

SEQ ID NO: 1726 - DNA, 300 bp, Homo sapiens
tctagactctgtcctcagaagaggtcctgggggcttcctatattgagaggaagatcattcgcacaactctgccaggaaactgccagataggagtcagggatcaggcctagaacgcagactgcagaaaggagcagatgtaaaagcagaaatttaaaacttgcttttccctgtcctcagactcttgagggtggcccattgcgtaagaagcagggagccaagaacattcatactggcctcctgcttagccttaactgaaataggcccccacgtaggatgtgggcctatgtgaacttggctgtt

SEQ ID NO: 1727 - DNA, 300 bp, Homo sapiens
ggggccatagcctctattcctgcccagctgtggatcctcagcttgccatgttaggtacactggaccagcttgtggagccataacccaggagctcagggacattgagtgcaggtttcttactcctacctgctggccctgtggctgtccctggtggccagcccagctgcagcaaaacctacaaagcctccagccatggtaggcgtcttggacctgccccagtcagctggggcttgggctgctaggggttttggcacacgtccatgtttggcggagggtgtgccttcaaaccctgaagggcct

SEQ ID NO: 1728 - DNA, 300 bp, Homo sapiens
gtggtcctcactgaagaaagaaacattcttcctaaaagactttttttcctcagagttggagcccacagcgtggtcaggaaagagaagtagccactggtggctcctggcatcctcctgctgggcagccccttctcaaagtgtgaggggtccccttgtgtacaagcaggaaggctctgagaaagtcaggtttgctcctaccacaggataattccgatgaacctgaaaagcgggttttggcttgtgtgcagggactctggtggaagaaagggtgacagcacctggcctgggcatgacacaagt

SEQ ID NO: 1729 - DNA, 300 bp, Homo sapiens
ctgaaacggaaacctttcgcaaagcctgtgcaggcagaggagctcacacacatccttgacgtggcactgtgtcttcaggggtgctgccctcttacagagagacagatctggaggccatggccgttttggtgagaaatgccagaaacagcttcagtttccacctactgcttcatatttataatcacagtaatctatttctcgttttgctatttctagagcaacaaattgtgtgatgcgaaattagtaccagaggaacaatgactccacttaacaaaaaaatagcatgggatctatgaaaaa

SEQ ID NO: 1730 - DNA, 300 bp, Homo sapiens
gagaatactttatacttctcagcttcttgtgtatttgactgtgacctggttataccatttgccactgtgaggcttagctgtgcatctgtgaatgggagattgttcttagagattggtcatagttgtccacctgcctcggaaactgcaggtacaaatgcagcagcaaagtatttacattcttacttcagggctgatctcctatttctatcagtccttttgaaggcagagaatgttaatttggaacaacctgcatatttattcaaatttccagagagatgaaactttcagaatgctgtgctg

SEQ ID NO: 1731 - DNA, 206 bp, Homo sapiens
caaacctgtgtcaaattgagaattactgtttttctgaaagttgcaagaaattaccaatgaattagccatggatagaaattgaaggttagtgggtgaaagttttcagtcttaccagtaaaaacaagtgagaatgcactgacgtccagggaaaaaaaaacagatggggtcagctttcattgtttccccattttacaaaaccaaagcca

SEQ ID NO: 1732 - DNA, 300 bp, Homo sapiens
ttttgaactatcaactagatctgggaagatagaacaggcagcatcagattgccttgtttacaaagtgtcatcacgaaaagtgttcctctaggaaggcataatatgtggcctgatggatttgatgagtagattgtaaaagggttgggattctggcagaacaagaagagataactaattagtggaattaactgagaaaagagttcattagcatgttggctattagactctaataaaaatgggtgtgaaaagatgggatttggacctagaggcagtcttagagccataatcctttttttctcc

SEQ ID NO: 1733 - DNA, 300 bp, Homo sapiens
ggtgaacaaaaatggcccagattcttattcagaaaccaattcacattttaaaaatatatactgtacactaccccatcctcttcctaatagctaaagtgatctaccctaaaacaccaagcagtccttcttacagtttgttccctcctgacagttcattgattacaatgtgaaagcaccaacctgagctaaaatgaaatgagaagcctgatgtttcaggcaccaagtactttaaaaatgtctactggctgtcctgcagcattttacttaatcattttttagaggagggatgaggactggttg

SEQ ID NO: 1734 - DNA, 300 bp, Homo sapiens
caaaggccgtcacaccaaggtcaggccaggagcctaggctaaaggaaacttcaccaccggggacatcagctgctgtggccagagaagagaacatgaaagcccacatcccgtgcctgcagccacccactttgctgtcacttcccagctgaagtgaggagggactgttcagaaacatcgaactgagcaaggtctctgtctacctcatggaaaacctgatctggaaatgacacttggaataaaataagattactcttccattaaaaggaaatccacccaaaagagagaaatagtggtatattt

SEQ ID NO: 1735 - DNA, 300 bp, Homo sapiens
cggacctctagtgcctgatgttcactttcttcaggtcctcaatttcctacatttaagctgttcggttaaacttttccatattcagcttgagatcaacctcctttacataactgattatttttgccttgaggagaaaagatgacgctaaacacagcacacatgtgtttattatatgttggtaatgtggaattcaaagatgaaagagacgtgagctgcatcactaaaaaagaaacatattacataaatgcaatgctgatatcatagataataaaattaacactaattttttgatattatcaa

SEQ ID NO: 1736 - DNA, 300 bp, Homo sapiens
atagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaa

SEQ ID NO: 1737 - DNA, 300 bp, Homo sapiens
gaagttgaaatcctagttcctggagtcctctgtgatggcaaattctgccttccttgtttcttctttttttctcctctgttttcccattttagtagttcaaatggtttttgtattattgaagacaggtatgtctcaaatccatggaactcacaaaaaaggctcattttctatcctcaaggagctttacatctaatggaaaacacacagtgaagtccagaaggactcactgtggactggtagcaccatgagggctttccatgaagaaggacttaagccagacttagcagggtgggcaggtgt

SEQ ID NO: 1738 - DNA, 300 bp, Homo sapiens
atttgccttaatcttgggttactagtaatgctatctgcgctgtgcgtctaaagcctccagaaagattgctcaggcatggcctaatagcttttatcagttcactcagtggctcttacactttgatacctgaaacctagagttaactgtgtaggaccaagctcttctgaaggagtcaactgctctcctctgtcaataatggctgtttatgccaaaacagccaagagaacctccccacccccttccctctgtcaaagtgaaatggaacctaagaatggaagctagtggctattttgccatacc

SEQ ID NO: 1739 - DNA, 300 bp, Homo sapiens
ggtggctgggcgcctacagaactgctgccgagcagcagccaattactgccgaagcctccagtaccagcgccgttcctcccggggtcgggactgggggctgctccctcttctgcagcccagctcccccagctccctgctctctgctacgccgatccctttaccccttgcacccttcacccagctcactgctgccctggtgcaggtattcagggaagcactggggtgccatatagaacaggcaaccaagagaacgcggtcagaaggaggtggaactggggagtcctctcagggagggacaag

SEQ ID NO: 1740 - DNA, 300 bp, Homo sapiens
gtgatagagatcatgccgcttgggttgctgagttctccccctcgttgtaattcagcaggcttcccagtgttccctgcatcctcatctgtgaggccgacttcactatcattcccacttataggtggaggagactgaggcacagagctcccaaagccccacagctggcgagtggcagggctagcgtgcgatgtccactagactggtgtctgacgcagaagctgcgcttctcacccctgggatctggaagataattctgatgtgtgagatccaggagaatgcattgtttagccagaaaatgtt

SEQ ID NO: 1741 - DNA, 300 bp, Homo sapiens
tgtacatgttccagtgggatgggaagcagcagagaccaacagagtctgaagaagcaagcttctgagttatgaaagcctgggttcaggagactaacctatatgtaggttcctaggaaagtccagttaaagggcctactttgccactgctgcctccttcttaatgctgaacctcatctcccacaagggggcagtctcagcaggtgtcagctgagccatgtgtcatctgtccaggctaactgcccacacatccttctgcaaagggtacctcttggttatcagtgctcactgatccctatataa

SEQ ID NO: 1742 - DNA, 300 bp, Homo sapiens
gtgaggggctgtctggcccttctgattttttgttaacgagacatggattgtggcatcaagatttagattcattcctctgtttgttggagtcattgaagccagtatatcctggacattttttaaagaggtccccattctgagaaaagacaggagttgaatgtcttattgattcttacctttctgttcgttatagacgaccagaggaaacaaatgcccgacacggattcgactcagtcataagtgtgaaccaaataggccgatctgggttctctcactgactgaagaggaagagaaataaga

SEQ ID NO: 1743 - DNA, 297 bp, Homo sapiens
  misc_feature 8, 19, 21, 28, 30, 31, 33, 36, 49, 55, 61, 66, 67, 69, 73,76, 79, 84, 86, 88, 93, 97, 98, 100, 110, 112, 115, 118,121, 122: n = A,T,C or G
aattaagntttttgggttnantgccctncnntnaantttttaaagcagntttganttttgnctggnntnaaantgngtnttaangnangtgangagnncntaaaattttnanccntgnggnnccccccccttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattct

SEQ ID NO: 1744 - DNA, 300 bp, Homo sapiens
cttgttttaaagataattgctagatttatgttttagctttccataaaatggaataacataaaataaaatataaataaaatatgaaataaaataaaagccatggggaaaaggtagggtttgattgctaataagaaatttcttggaaaagagactagctctcttttggttttccaaagtccacattttataacatttttagtgcttggtgtttgcttgtggtattacattagataaaaatgtatcacagtgttggtttatactggatgtttaaataggattcattgaaaggggtgtgttttc

SEQ ID NO: 1745 - DNA, 300 bp, Homo sapiens
ctggaaggttactgcaaagacagcctggtgaaattgttgggagtacagaggctttaatgggttctttgaggtcaggtagaggttatggggggagcactacagtgagcatatacccaaaatgaagccagacttccaaggtacgttctcactggagagggagcttaatggtaaagtttaaactttaagggtttaggttttagattaaggcccaggagatccaaggggaaggaggagggtaggaaatcagagataagaggagctgttgtcatcgcaggtatagtaataattaagatatgttaa

SEQ ID NO: 1746 - DNA, 300 bp, Homo sapiens
  misc_feature 278: n = A,T,C or G
attatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgntattcttactcatgaagttaca

SEQ ID NO: 1747 - DNA, 300 bp, Homo sapiens
caaagcttgatctattaatatattgatcagagttccatgatccttttctaaaatggtggctttattttgccagaataattctgcagggtgttttttttgggacggagtctcactctgttgcccaggatagaatgcagagtggcacaatcttggctcactgcagctcttgcctcccagtttcaggagaattgtgtgaacctggaaggcggaggttgcagtgagccgagatcaatcaccactgcactccagcctgagcaacagggcaagactccatctcaaaaaaatttttttttggattta

SEQ ID NO: 1748 - DNA, 300 bp, Homo sapiens
tttctctttcctttctgcacaatttagttctaaagccaccaggcagggcagaggaaggtaaggctttccatggtgcttaggagcaggggtggggttgttatcataacctaagcaaagttacaagggtaatccatatggggtagcctggtgtagagagtcagggccccagcaacattaaggacatccctgcaggatggcagccaggcttgggggtacaagaccctaaacaggatgatgagagcctccccaaggagaggtcccaggtatagagtgtcagagcctgagcagatgaggaaggca

SEQ ID NO: 1749 - DNA, 300 bp, Homo sapiens
tttgaactcccttagcaagctacttgtctttttgcaggatcccatcggattgctgtctcctttttcagatattactggatcatcagctgtaaaggctctatgtttaattatgtctagcatttgaatggtaacagcgcagatgttacctgcctataatcctcctcctctctacagattttgctttgttcttgcttcttgtttttgagatcctgcacacaagttgaaattaattaaaaacagtagagcaacttagtctggataagccttcatctggcaaataatgttacactgccagagatt

SEQ ID NO: 1750 - DNA, 300 bp, Homo sapiens; identical to SEQ ID NO: 54

SEQ ID NO: 1751 - DNA, 300 bp, Homo sapiens
ggctattaaaaatgtaatcagtgtgaaaattcatgccatctgaatcgtacgagtatgtaagggatttgagttccttacagaattttctgtaatttagtacttcaagtgacttataaatgtatatacttctctctcacaaaagtgttaggagaaggaaaatcttaaatactagcttgatttcttaatttaataacaaaaaacaattctcataacatgtatcacctaacatgtcactttcactttaaaagtctaaagagttgaggtttatttcttttcttttaaagttgatgtttatgttgg

SEQ ID NO: 1752 - DNA, 300 bp, Homo sapiens
tcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaactagagttggggggaactggagggagcaaaacactgatttgatactagtcagttt

SEQ ID NO: 1753 - DNA, 147 bp, Homo sapiens
gtcttcctgtgcagggtgctttggtagccatcagagaggaaccaagggcaacatcttttcttcccaggcgttcttctctgggtgctttattctcttctttttctttatttcgcccccacccccatcccctgcctttttttttttttt

SEQ ID NO: 1754 - DNA, 274 bp, Homo sapiens
  misc_feature 251, 255, 256, 259, 262, 264, 270, 271, 272: n = A,T,C or G
ccaacttggatgaaggccagcgcagagcccaaactttgtgaatcagtaacacgtgtatggaacattcacttacatgcacagaggtgccaagggacagcctaatttaagattcatataaacacatttatctggcaacataagttaatattgtggtaggagtcccaccaagttaaaattctaaagtgtttgaatatgggcatttttaaagaaagaatctgcataccataaattcacgcttttaagtgtatgantcannggnaanantggatnnnca

SEQ ID NO: 1755 - DNA, 300 bp, Homo sapiens
aacagatagagacttggtcttaaaaaaaaaggaaaagaaaaggaaacaaaaaattatctgggcctaaaggtgtgtgcctgtgctcccagctacttgggaggctgaggtgggaggatggcttgagccctggaggttgaggctgcagtgagccatgattgtgccactgcgctccagcctgggtgagagagcaagactctgtctttaataataataataataataataaagtggtcaggaagggacccccagggaggagcataaacctctccagtggctgtgatttgtcagtaaggacatggg

SEQ ID NO: 1756 - DNA, 300 bp, Homo sapiens
gcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgt

SEQ ID NO: 1757 - DNA, 300 bp, Homo sapiens
cagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcgggaaataaaggcaag

SEQ ID NO: 1758 - DNA, 300 bp, Homo sapiens
  misc_feature 208: n = A,T,C or G
cctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagnactttaattttttctcttggactgcaataaagtatagctgcctaaaatacgtttcctgacacttggaggtttgtccacaatcgggaaataaa

SEQ ID NO: 1759 - DNA, 300 bp, Homo sapiens
ggcaaatagccctaggagtcccatttttttaagctgagggaaataattttcaagaagcttgtcttactagtagcatcattcttttttactggctcacagcttggaaggggtgatggtttttcctatgaaagctaacaacatttgagcagatccagtgtgctggtgagtcacagtgaaagtgtggagtgctaaggaagcctcctggtggaaatgtaagttcagagaaggtctgcagaaaatacagggtgaaatgttatcaaggagccagggtattatttaagaagaggagggaggggaaaa

SEQ ID NO: 1760 - DNA, 300 bp, Homo sapiens
tccaagaggagaagcatgttccaaaacccttaactttgggaatttagaactagcttttttactatcttctgcacagcataacttcagtctccctttactaattcaaggaaatctcagtgaacaaattgtataagggtagatgagctaaaagctcactgagtcattaatttgtcataactcatctaaatacaatgattaggcttgtgtaggtgtccctagtttctctttctaaatcatgtcttagtagggacagagcaataatggtggatcgtggcaacgggaaggaagatgatgtgtcag

SEQ ID NO: 1761 - DNA, 300 bp, Homo sapiens
tgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctccccacagccaccc

SEQ ID NO: 1762 - DNA, 300 bp, Homo sapiens
caggaacgcaacaaactcaagtcgcagctcctggtggtgcaggaagagctgcagtgctacaagagtggcctgattccaccaagagaaggcccaggaggaagaagagaaaaagatgctgtggttactagtgccaaaaatgctggcaggaacaaggaggagaagacaatcataaaaaagctgttcttttttcgatcggggaaacagacctagatccaaggccacaagtaaggctatggctctgattctagaagacaaccttccaagatgcctggcaaaaccacctccctgtgccacacagac

SEQ ID NO: 1763 - DNA, 136 bp, Homo sapiens
gtaagggagggggtagggctgggttattaagatacaggctgctgtattttacattggttgtgggggaaggggagcctggagaaaacaaagtcactattcccttttttgaaacaggaaaaaaaatattttttgttca

SEQ ID NO: 1764 - DNA, 135 bp, Homo sapiens
cagactcgcattatggacaagtcccttctccccacacaaaggaagacatacaccgcatagtccatttcatttcagctcctgatggcatctgaccgccgtggacacttcccagtggtctggcttttggagggagag

SEQ ID NO: 1765 - DNA, 300 bp, Homo sapiens
aagcagaaatgtgggtggtgtgactggggtttggtgaggggctgctgtggctggaatggagggctgccacaataatggaaatggtaaatgaggcaagtaaggttggactggtggcatagcgtcaaggttgccagctttattaaatcactcttccaatatgctagcactggcctgttgggaaaagtaatacatcatgtaatcgaacaaaagacagaggcaagctccaggaatgggcactgtaaacaggacttgtcccagagtagccagatgtaggctttaggtaagttgatgcaagctgag

SEQ ID NO: 1766 - DNA, 280 bp, Homo sapiens
  misc_feature 203, 204, 206, 208, 214, 217, 218, 223, 225, 226, 230, 234,235, 240, 241, 244, 250, 255, 257, 260, 262, 264, 265, 272,276: n = A,T,C or G
tctcgatctcctgacctcgtgatccgcccgcctcggcctcccggggtgctgggattacaggggtgagccaccgcgctgggcctggatcaaatctttatccatgcacattggaacacaggattactgggttgaaatcattctagttttgtcatttagatacttgtacgatgaatctattttagcacaagggataaataactcgnnangncatctntannttgtntnntttngtgnntttgnntanaccacnttcangntcnangnnaactttncttnggat

SEQ ID NO: 1767 - DNA, 300 bp, Homo sapiens
ggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtgagttttattgtatgttgcttgctgacaactgttttgggggcgcttcagtgatatacattcatagaaagactttgttttatggcagattagtttacaaagagtattctgcaagtgggatta

SEQ ID NO: 1768 - DNA, 300 bp, Homo sapiens
ctcaaaaccaaatctcaactcagctacagaatctactgtggtccttgtctgaaaaaattagttcactcggttggaatcttgtctcagagcatcctcatctctttctcaaaagcccctaccccaacaccggcgtgttggttgtctattgaaacttacaagtggatggaccctttctcccgaataaactggcctttgaaagctctaatcgaaatggtttggcaaaatccatactgcaggagattagggaggacaagaatgatgtgcctttttgtactgctgagcctgatggtggtgccacta

SEQ ID NO: 1769 - DNA, 300 bp, Homo sapiens
ggaaacagctggactagagatacacatttgggcatatatatatatatatatatacagtatatatatgcacgctgattttatatatatatatatatataaaataattatggaagtcagtgagattgtccagggcaagaatataatgtcatatgagaggggagtccagactctcaaggaacgcggacatttaaggggagagtataataggatgggccgtcaaagtctaagtcagagcatcctgatgttggaggcaaagcaggagagtgtggattaagcagctagacattggttactggggca

SEQ ID NO: 1770 - DNA, 295 bp, Homo sapiens
  misc_feature 254, 256, 262, 277: n = A,T,C or G
atttcagcctgggcaacatagtgagactcccgtccctaaaaaaaaaaaatcccacaatcctatcacacagagatggcaacacttaccatttgttctggtcacctttggaaggaacttttaaatcaatgtcttgcttctctgtgggttcttttgtgactcacacctgcttctgggtatagtatgactataaagttgatttcttgggtaaggtatgatctatgagaggaagcttctaatttgatgagcatcagggnanttttanctggtataccttttntttgccctctccaatcaa

SEQ ID NO: 1771 - DNA, 300 bp, Homo sapiens
gtggtagcaggcactagataagaggtgaaccagtgtggaggcaggaggggtaggaaaggagatggaggcattattaccaaggcatgatagaagccatgggatctgataagtggtgagaactggaaagagagggacaactctgaaatttgcctctgattgcagttaaatgatagcatgctaatgacagaggtagcagtaggttggggagagtgtagtagtatttctgttttcagtacactgggttttaagcattgacaagccaccaaatgcaaatatcaagcaaagagtggcacatctagg

SEQ ID NO: 1772 - DNA, 300 bp, Homo sapiens
gcgatttatttcacagagttaaggggccagtacacttcatggtataaaattatctttttcaggggatgaaggcacaaggagaaaattacttgaagcttggagatcttctctggcaagcaatttacaaattctggtgttctttgatctggctccccgcccagacaaccagggagttcttcatgttctagcctcatgtgttgcactataggcagtaatttggcatcagccatagaggagggatccgatagttgtcattgctgcccgccacatatactccacatggaatgatactcataatgc

SEQ ID NO: 1773 - DNA, 300 bp, Homo sapiens
gggacactggattctcattctactcaaactcccactaggactgttggcttgttcgcttctcaagtgtttgtatttttctgagttaatatttttgggtgtaatttacatgtaggaaaatgtacacatttttagtgtacagttcaccaagctttggcaagcatgtatagcctggtaacccacaagccaatggagacctagaacattcccgtgaccccagatgctgggttctgtgtgccttcccagggcttgtggctgggcacatcaggcatggcgggtaccatgcctgacagctctgaacca

SEQ ID NO: 1774 - DNA, 300 bp, Homo sapiens
gaatgggtaggaacaagcattagcctggtctgggttcctccagctcttaggacaagttggaacagatttgctgttctgatgattcatctttctgatcacagggatagcagaactcagctttgaagaaaggcatctgcagagatcatggcagttccattttgcgttctgagtttgctcctttaggtaagggaactagaatgcagatacagttagaatcagtctctctctctctgtttgtctgtctgtctgtcactctctctctccttattgcactgagggccgggcgcggtggttcacacc

SEQ ID NO: 1775 - DNA, 300 bp, Homo sapiens
gtcatgagaagagccccagatgggacacccgttcttccttgtgacattagggaatttggtacagctttctggatcagtttttgcctttaagatgcatctggactcatcaaacccagaaagtgtagagcaaatattcctattcccatgtccttggcagacattgctaatctatctcagggctccaacagagttgggtctcagccttaccagcctggcagccactagacttgatccctgagatgaaacctcttgaccacacaggaactccatgatcttgaagctcccttctggctctataac

SEQ ID NO: 1776 - DNA, 300 bp, Homo sapiens
ccaacatggtggtctcaaactccccacctcaggtaatccacctgcctcagcctccaaaagttctgggattgcaggagtaagccaccacacccgtcctcagtgcctggacttctgcagtggacttcctttaaaaatcctggaatatacactgcagtaaaagaacaaagcatacttcagtcgtttaaggctgaggtatgctttgttcttttactgcagtgtatattccagccttaaacgactgaagaagaatgtcaagtggggaagtggctttggttttcagtttgtgggttctgaatccac

SEQ ID NO: 1777 - DNA, 264 bp, Homo sapiens
  misc_feature 237, 238, 241, 245, 248, 252, 255, 263: n = A,T,C or G
ctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccacaaaaaaaaaaaaaaaaaaanntgngccnttnaaanttntggggggnc

SEQ ID NO: 1778 - DNA, 300 bp, Homo sapiens
gatgtcctgctatacaccatccactgccctgccccttaagcctcacatctttcatctctcctagttccaacccatggtctccagacgatgactctgcctccctgttctggtagcattcacagattgccttgtttagtagcctttcacatgagatccacttgacagcccctgtcctcacccctcctcaaactcctcaccacactgaaactcttccagctccatgagtaggttcttgggtggtttcttcacctgcaggttcaggtcaatgctcagccggggactcgacagggatgctttgca

SEQ ID NO: 1779 - DNA, 300 bp, Homo sapiens
accaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcaagtaggcccattc

SEQ ID NO: 1780 - DNA, 300 bp, Homo sapiens
gagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagcccca

SEQ ID NO: 1781 - DNA, 300 bp, Homo sapiens
tcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtctt

SEQ ID NO: 1782 - DNA, 300 bp, Homo sapiens
caaagtactgggattacaggcatgagtcactgagcccagcctaataaagaactttctgacagtgaaaatggtctgtgcatggtgtgggtggggtgagggtgaggccgggcgtggatggagcagcagggaggttgtagacaatgtccagacatcagagagagggctgggctctgatcctgtgccaccctgaaaggctttgatcctatggtttggtcagaaacagagcctgtaaaacccatgtatgcagctgttgctaagggcaaccacaagatgctcaaaggaccttaaagatgtagatgc

SEQ ID NO: 1783 - DNA, 300 bp, Homo sapiens
wcgtgtgtgtgcacaaagcccctaaggtttcatgtgtacacaccggtgctaagtgttttttacacccttgagcatctctcggcctggggctcctgtgcaggttgccctgagagttgggtttttagttcaaaaagaaggaacacagatgactactctgctggcgacacggccactctgctggcacgcacatagcatggcgcctccttttttgggggactctccttggtggcatctctggcaggctgagtcctctccagctgcagttctggaccctgtctgggttggggaggggcatttggt

SEQ ID NO: 1784 - DNA, 300 bp, Homo sapiens
gctacacccagttctcccagttcaacaaggacgactcgctactgctggcctcgggggtgttcctggggcccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctg

SEQ ID NO: 1785 - DNA, 300 bp, Homo sapiens
ggcttccaggaaaccaggcaagggtatgcccagggctttgcctcctggttttgtttcacctgtcccactctactgtgagatagagcttccagagttgttcacagggttgagatttttcgctctgaatttgagaggcaaccgtatctggccttctaaggaggcagggagctacctgggaggcaacactgacaggtcattttgcttcagtgtcaagcatttttttcctctccttttgttgtggcagctcagtgttgacagggctccacacgtcttctttgagtagtgggagtatgtgcccaa

SEQ ID NO: 1786 - DNA, 300 bp, Homo sapiens
cctcggggggaggccagcccctggctcactggctcagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttt

SEQ ID NO: 1787 - DNA, 300 bp, Homo sapiens
ggaagctccaggcctggcgtgctggagtcacgagatgagctgtccaggcagcatggcatcgtgagtgaactccgaccgtggcaggtgaggcttctgcacttagctggctgtcttcatgtgggccgattctgtggttagtgattctgatttctcatctgaaaagtggtgcatcacttagcccctcccacacttggagggttctactagtgtgcctgcgtggctgggttctgcacactcagctactttagtttctttagtctatccttaaaaagattcctaggtgtgttcctgattttgagg

SEQ ID NO: 1788 - DNA, 300 bp, Homo sapiens
cccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctc

SEQ ID NO: 1789 - DNA, 300 bp, Homo sapiens
gcttcctgctctttgtattttggctaaaggcggtgaagtgagaggcggagggggatttaaaaccagcagaaaaaggcttcttgttgggctgatggtgtttgtgcgagaagctgaggtgggcagggaggagagcctaggagagcggtagggctcatgggcaggccgttggtgtacgccttggccctgcctgtccccagtcccaccactgtggactccaggccatcctcagtccaggtggtcactgtggcctgggccacatgctggcgatgacggggatggccttccacatgcctgttctct

SEQ ID NO: 1790 - DNA, 300 bp, Homo sapiens
agtacagtgccaggcagctactctcatgtggtcagatggcacattcacaacagtcctttatcatgagcctcctacatgatgatcctgcagctgccacttgctcctgtatgcctattcaccaccacctacctgtgtttgcaagttccatgaggaagggcccatgcctcctcctgcttatcacagtgtgtccaaatcagtgcctggttcagggcctgtgtgtatgggacatctcctaggcaccacttcacaccctctcagccctaccttccactccagccaccacctcagcaaccagttctg

SEQ ID NO: 1791 - DNA, 300 bp, Homo sapiens
ctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcag

SEQ ID NO: 1792 - DNA, 300 bp, Homo sapiens
ggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggct

SEQ ID NO: 1793 - DNA, 300 bp, Homo sapiens
attcctttcatggtacagtatttaccccaagtcatgattaaatatctgtttatatatttctttattggattatttgtttatttttctctctctagactgcaagctccttgagcagaccatgtttattttgtctaccacaggtgctcaataaatatttttgactatttattacatgagaaggtttccatgcaaacacccattgaatacgattgaacttgaaccctaagagatgggctgtgacctttgttgccctcaaactaatcaaaggggagtgatattcaccatccagaatctagaata

SEQ ID NO: 1794 - DNA, 293 bp, Homo sapiens
ggagggcactgccctcctggaagagatgcattagatcggtaggcacagaatacctttacatgagaccatttagagaatgattaggggccaaaggtaaggggtggactgttaagccaacagggactcagagaaagcaagggtcagggtgaccagaaatagagaaaaaaaagccttacagaggaagaggacctggacctgagccacagaggatgggtagaacttagaaggagggaatgagcccagtctgaatgatatgtctacaaagtatacaatatgcaatgatgattaactga

SEQ ID NO: 1795 - DNA, 300 bp, Homo sapiens
gagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttct

SEQ ID NO: 1796 - DNA, 300 bp, Homo sapiens
agagctcaccccatgtatatttccacttgggagcatcatctttccaagggccactttgaggtgaaatggcttttttacatactcagcatcaatttggtcctaaaatcaggagacattcacccttctccaccccaatttccaacatcccctcctttgtagagagagcactctggaagccactgagccccatagccctagggcctagaccactattccaaaagggaagacttttccattactatgacagacacccaggctggagtcctctgcctgcactcaaagctctaaccccaacctctt

SEQ ID NO: 1797 - DNA, 300 bp, Homo sapiens
gaaaatatcttcaagcactttataaataaattatatgtctgatactagccttccattgcctggatcacatctgattgtcctggtaatttgagaaaagggtagccccttggtatggatagtagcttgatgacatggaattcagggaaaagactatgatggtgtcacttgtaactgcttttgtgctgtaaaattgtcatggattaagaagagagttggctgggtgcggtggctcacacctgtaatcctagcactttgggaggccaaagtaaggactgcttgagcccaggagttccagaccaa

SEQ ID NO: 1798 - DNA, 300 bp, Homo sapiens
agtcaatgctcactgaaagtctgtcttagctgcctgtttgaatgactgttctttttctcatttttaattcttggactcatgtcctcattgcttcactcaattaaaaaaaaattattctccagtcccctcccactttgcttcttgtatgcattgtgaccgaccccacttcctcagaatgtaacggggccagagggaaacttctcacaaacttcgtagagcctcctcaggggaagctaggaagaagacatcaaatgtttttaagtcatgaccaaacaggcttgttggggacatatcatgggg

SEQ ID NO: 1799 - DNA, 300 bp, Homo sapiens
cccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttctt

SEQ ID NO: 1800 - DNA, 300 bp, Homo sapiens
cctctgcgcctggccccgggtgggtcagccgcgtggaccacctgaccttggcctgcacccccggcagctcccccacacttttgcgctggttccacgactgcctgggcttttgccacttgccgctgagcccaggtgaggatcccgagctgggcctcgaaatgacagcagggtttgggcttgggggactgaggcttacagccctgcaggcccagccgggcagcattgtccccactcttgttctggctgagtcccttccgggggcgacgacacgacaggaccaggtggagcagttcctggccc

SEQ ID NO: 1801 - DNA, 300 bp, Homo sapiens
ggagagagccacatggaggagagccatgctaccctaactgccatagctgaggctatcctcgatcagcacacatccattcaagcaccagacactggagaaagtccacttgaggtcagtagagctgcctagcagatgcccaactgacccaaaaagcataagacataaacatttattgttgtataccctctgaagttttgcatgtgttacaccatattactatagtaatagataattgatacaaatgtcctacatggcctggaccatgcattccttgctaaatttatttcttgctactctgtc

SEQ ID NO: 1802 - DNA, 300 bp, Homo sapiens
ctgcctcctccttaggcagagagctccttggttccatttgaaaaccttccttccccttttgctggaattgagagactgaggacacaaagtggtgtgctggagaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactg

SEQ ID NO: 1803 - DNA, 273 bp, Homo sapiens
  misc_feature 4, 7, 9, 13, 22, 25, 33, 34, 35, 36, 37, 38, 265: n = A,T,C or G
cccnttngnactncccaatggnggntttattannnnnnaagaaaccaggggaaatattaattttaatattatatccacctcaaaataatggaaaagaggtttttgaatttttttttttaaataaaccccttcttaagtgcatgagatggtttgatggtttgctgcattaaaggtatttgggcaaacaaaattggagggcaagtgactgcagttttgagaatcagttttgaccttgatgattttttgtttccactgggaataaagntggattcg

SEQ ID NO: 1804 - DNA, 181 bp, Homo sapiens
gctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacaaaaaaaaaaaaaaaaaa

SEQ ID NO: 1805 - DNA, 300 bp, Homo sapiens
ggcaggcactggagagccagggtggttcagccgcagctcctctgagcagggagtcaaacagggctgaaacagacaccagctctccaggaccagctgctccaggaatcaacctctaccctgaaccaggtccctgaggaccaccacgtggctgcaacacagcaggagttcacagtccagaggagaagcccgatgctgaacagagaatcacatccgtgagcaacacaaaaggtctcaatcaaaaacctctgaaagccactggcctagagttagaggaagagttagccatgagaaatggtggtg

SEQ ID NO: 1806 - DNA, 300 bp, Homo sapiens
tgacgagcgactgtagacgttgccagcatgtattgatcaggagcagcctgtgagtcaagactgacaacagatcaataaatggcttttaaaaagcaaaacccctcaagctgtttatctaggaagcctgacaaaccctgccgcagtggtgtggccccatgtgtccccagggcctggggcccacctctgccccagaagtcctcttagtgtctgtagacaggtcccatttccaccaggtcaaccagggctgtggcagtggacctggatggcaggcagagcagaggaccgctgttctatttgttg

SEQ ID NO: 1807 - DNA, 300 bp, Homo sapiens
gttggttgtcaactttgcattataccacccacttgtaatatctctgccttgaagaggaaaaaccaggaacatttcctagaatccccttcccgttatgatcccaagttaggatatgccagtgagaggtgctgttttagtcccttttgcctgctgtgacaaaatgacacagactgggtagcttataaacaacagaaatttatttcccacacttctggaggctggaaagtccaagatcagggtattggtagattctgtgtctggtgagggctcattttctgattcatcgatggcaccttctca

SEQ ID NO: 1808 - DNA, 300 bp, Homo sapiens
aggacattctcctacatagccgtatattctcattatacccagcaaatattcaatcatattatctaaggtacactccacattcagaaaaaaaaatgccctttaccatagtttttgttttgcttttggttttgatcaaagattacaggtgtgagccaccgcaactggcccactgtgttacgatttgaaataaaaaggaacctgtcaagtacccagagaatatcagaactgctgtccgatctcctgaaattgaaattaatttcctcagtgactcaatacccactgccactcactcaagccctg

SEQ ID NO: 1809 - DNA, 300 bp, Homo sapiens
catctgtagaattggctttccgtttgcatatttaaatgaactttgtggcttttgttaagtataataaaaagcatggagtcaaatataagccaagagtattacagagacttttaggctgactcagtatctcaagttctgtgtagattcatctaaacactgctgttatccatgctatactttaccatgttatcccaaaagggaatcatcagcaaattttaccagaaactgctgaattcaagatatattcaatatatattatacttctgacatcctaggaagcctatccaaagaatacattac

SEQ ID NO: 1810 - DNA, 300 bp, Homo sapiens
ggaaggcagtggaaagccattgactttatcaaagtattagagtaacctaatctgatagatctgttaccacatcaccttgtccactgtatggacagtgaactgaatgtgaagaaacttgaggcagagagacagcacagaggctgttggaataaattcactgggctcatctcacatgtatgtcttctagtctacatgtcttctatttccttctgtcttctcctcatccccaccattaatctgtcagatgcacacatgggcaaagggtcttgtgtaccaaatgtgctcagtgataaaagcagc

SEQ ID NO: 1811 - DNA, 300 bp, Homo sapiens
ggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacct

SEQ ID NO: 1812 - DNA, 300 bp, Homo sapiens
tggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttact

SEQ ID NO: 1813 - DNA, 300 bp, Homo sapiens
gccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcggggaaggtccctcagacataaaatactcacccatttagaggaatgacaacagcaaaggaaactatattctgctaatttactggtaagagaggaaaaactct

SEQ ID NO: 1814 - DNA, 300 bp, Homo sapiens
gcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattgga

SEQ ID NO: 1815 - DNA, 300 bp, Homo sapiens
gataaaatagacaaggctcttgtccaaaagcagcagcttatgttcttgtaggagcaatatggcagacacaaagatgcagactgggttaggttttagaaaaacttgacttaaatcagtaaatacagtaacagggatggagggcataaggctccagagcaatgctggcgccgtcagtgtgtgctctagaggtgcaacccgggtggttggtggtcagcctgggtgacacagcaggtggcccatgctggctgaggcctgcttctctccttttggagctctggctttaccccagcttccatgctt

SEQ ID NO: 1816 - DNA, 300 bp, Homo sapiens
agcctgctgagggatgcccaagaagttccagggtgagaacaccatgttggcagcgtcccgggcactgaggtagaggccatggctgcctctgatgccaagaatcatagggagcttgaggatgcctactggaaggaccgacgacaaacacgtcatgaggaaggagcaacgcaaggaggataaggagaagcggcgcctcgaccagctggaacgtaggaatgagactctgcgcttactggaggaggaggactccaagctcaagggcggtaaggcgcctcgtgtggccacgtccaactcggtcac

SEQ ID NO: 1817 - DNA, 300 bp, Homo sapiens
cccaagtagctgggactacaggcgcccgccaccacacccggctaattttttgtatttttggtagagacggggtttcaccatgttggctaggctggtgaccgtgtggtcatggtggggaccagccctccggggcacccagtcggggcaggttctcacgtgggagggcacagggcttcctgcaggctcggaggcccagggcggattgtggccagtggaagggaaagatgtttctggcagggggacttgtgtgggccacggctgtgcggctgcggcgttgagcacggcctcactgtccacctg

SEQ ID NO: 1818 - DNA, 300 bp, Homo sapiens
aattactggaacccgggaggcggaggctgcacagtgagccaagattgcaccactgcactccaggctgggcaacagagtgtgactccgtctcaaaaaaacaaaaacaaaaacaacttctccctcctccacagactcctccctggtcaccactagtgatccaccttatggatctcccaaggccacctctgcctctgctctgtgttgtattatttggggacctgtggtctggcatgcattgtacttggtgccccaaagggctgtggcatctgataagtgatttatcctcaggcacagatttgc

SEQ ID NO: 1819 - DNA, 197 bp, Homo sapiens
  misc_feature 135, 136, 141, 143, 157, 162, 166, 168, 174, 179, 180, 181,185, 188: n = A,T,C or G
aattccgttgctgtcggtgatgagattctgatggaagagattaaggattacaaggcacgcttgacctgtccgtgctgtaacatgcgtaaaaaggatgctgttcttactaagtgttttcatggcttctgctttganngtgtnangacacgctatgacncccgncagngntaatgnccccnnntgtnatnctgtttttg

SEQ ID NO: 1820 - DNA, 300 bp, Homo sapiens
gcgagatcctccagttccttgtcatcccaaatagggccaagggaaaacacaaataaggcatatccctgacatttggctcgcaaggattccttctttaagatttccccatctaagtggctggtttccccagcagatatcacaaatatgactttgtttcttctcagattgggtgtacttaaaaatacattgtccagagtccactgtaaggcatgaccaataaaagcatctccatttagttgtttaactgactcgtgcacatgcctcttcatgaggcgcttacttctgtaggtggtaagattg

SEQ ID NO: 1821 - DNA, 300 bp, Homo sapiens
tgtcacaaggggtttttgtagaagctattcttcacagaggttgggggagagattaagccaaaggatctctgaggtctttttcaaatctatgattatgtggccttttgttcattgacttccatgtgttctagttgatcattacaaacctggcaggccttctcaagggttcagtaattagctgtcatttcccatttgtccagagagtgtccaacacaaaatacccctaagatcttggccaatagagaaatgtcatggaattttagaaatgacagtatctgcggagtttattccaagttatat

SEQ ID NO: 1822 - DNA, 300 bp, Homo sapiens
ctttttctcactgaaatatttaagcactgcattttaagaaaacttcctattcattcgtagacttttatctggccagatttccactctgagggcttttctttctagttatctgacaaaccataaattttatttcctttaagggcaaaaccaacctccaagcacatttatggcccatgttttaagagctggccgccctttctatcctgtatctctggttaaacgtgttttctttttcttggagcaaatttttcaaagaggggctaaagctatgtgttcctctggagagaactcctgcctacc

SEQ ID NO: 1823 - DNA, 300 bp, Homo sapiens
gctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttg

SEQ ID NO: 1824 - DNA, 300 bp, Homo sapiens
ggtaagattaggcagaggttttatctaacactaaagtttccttgccttgatgagctttcagtgttacgaaatgttattcaatagcaattatgagagattgttttagccagaaactgatcacttttaagttactggattattctgcttgagcttgtgagaacctcaatgtactccagtcctttctgaaataaggcaagatgtaaataagaattgtgtgaagtgtttaagatggacacttagaattattcagaacagaagtttaaagtgtgtggcctaagaaatgtaattcaaaatgactat

SEQ ID NO: 1825 - DNA, 300 bp, Homo sapiens
gcctcatccatggatcagggaggcacgccagggagtaacccagttctgcccagcaatctacaccccactaactctgggccctgtctgtgctatttaacatttcattcaaacaggagctcctgggaagaagcttggctcagtatccttggcagatcacccctcaaagtctccctcaggtatattctaagtgaggacggatcccatatatacctcacttaggctttactctgctctgcaagcacaggcaagaccagctacatctttgcacgccacccctggttcttagtaggccaagaacct

SEQ ID NO: 1826 - DNA, 300 bp, Homo sapiens
attaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagag

SEQ ID NO: 1827 - DNA, 300 bp, Homo sapiens
ctccagtagaacttgagcacttggaacctgaaaaatgtaaagaactggtctgtatagtgagagctgtggattgttctagacttttgcccagccccaaattttagtgatagcaaaagggcactggaactagaggccagagggaaactattaaactcacgtgctggcgtgaggaggggatggagccaggagctcagactctccctcatctcacgggcattttgtaatactgacatttccagatagaacctgctgccctagtctagctacccacagttccctccgagatgctgtatttggaac

SEQ ID NO: 1828 - DNA, 136 bp, Homo sapiens
cctgcagccactaatgcattgtgtatgataacaaaaactctggtatgacacattttctgtgatcattgttaattagtgacatagtaacatctgtagcagctggttagtaaacctcatgtgggggaggtgtgggagg

SEQ ID NO: 1829 - DNA, 300 bp, Homo sapiens
cttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactc

SEQ ID NO: 1830 - DNA, 300 bp, Homo sapiens
gtttctaagcacttcctgtattgcatatcaactcatttaatcctcacagcaatgtgagatacatactatcctccccattttataattgagggaactgaagcatagacaggttacatagctggtgactggcagatgaattgacttagccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagcttttgaatgacagacttaca

SEQ ID NO: 1831 - DNA, 300 bp, Homo sapiens
tgagtgccttccgaaattgacccacctgggagctatttacaaatgtccatgtgggagagagagagcatgagagcacagtagcccagcctgctggtcagcaggctcatctgtggttcacctgtagacagagagcagatcaatgtgtacttcagacaccagaaagtctggtggctttggtcccaagtgggtgaatcacctgaggtcaggagttcaggaccagcctgaccaacatggggataccccgtctctactaaaaatacaagccgggcgtggtggcgcatgcctgtaatcccagctact

SEQ ID NO: 1832 - DNA, 300 bp, Homo sapiens
atgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcat

SEQ ID NO: 1833 - DNA, 300 bp, Homo sapiens; identical to SEQ ID NO: 1029

SEQ ID NO: 1834 - DNA, 245 bp, Homo sapiens
cagagtcaacatggagcatctcactgtgaaatgatccatggattgaaggatatggtaaaatgtttataggttactttgaaagtaaaatatactatgtcttggttttgaggatattggatacaaaactctcttcctttagggctactgagacttgattcctgatcatcagaaatttcaccagaaacaacttgcttccaatatacccaattctatatgaagaattcatggagagtgtactggcactg

SEQ ID NO: 1835 - DNA, 300 bp, Homo sapiens
  misc_feature 208, 217, 246, 252, 258, 259, 270, 277, 282, 286, 287, 289,291: n = A,T,C or G
acccaccctctccaggcctcagtcttatctctgaaatggggtgggtgttgagaggtggcttctaagatctttctacttcccaaacttggaattctctttttaggagcatctgcgtgcccagatgtatgttggagcccatggtgtatgggggtggggtggggggaagggtggagggtacctaccccctgaggcttctccagagggtgtngggacccanatggacctgggtgaggaagggccctgganagggcnggcctnnagtctcactgntccttangtggnccgnngntncaaacctgg

SEQ ID NO: 1836 - DNA, 300 bp, Homo sapiens
gtcagcttcaggtaggaggatggcacagactcaaggtcaagcagaggtgtgagccacagaagcagagtagcaggccaagttccagcatcctggctgccaggaccaccgtgcaggcttaagaagctggagctttaggatatggagtgtccatcacttggcatctttctcatagcccaggtggcatctgagaattaggttagggttgatttggaccctatggtttggtaaatcatgtcccttgaatgtatacaaatgatgtctgttgatatttaaaatatgtttctttctgtttaattgtaa

SEQ ID NO: 1837 - DNA, 300 bp, Homo sapiens; identical to SEQ ID NO: 95

SEQ ID NO: 1838 - DNA, 300 bp, Homo sapiens
gagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggccctgatgtcaatgttta

SEQ ID NO: 1839 - DNA, 300 bp, Homo sapiens
ttttgccctgctaaaatgatgcttagcctgaaaaatcggagcaccacttctcaaatttatttttccaactcagtaattaaaaaaacatttacttcctgcctactgggttgtggaatattgtcaggatctctgggttccaggtgagggatgcagaatgcagggaaagacaggtcccctgccctccagaagtcggtggcgccttttcagagtaacacacactggagcagacccctggaaaaggacagtccactggtggaccatgaccttggtcaaaagagggaccaggtctggcttgctcac

SEQ ID NO: 1840 - DNA, 300 bp, Homo sapiens
ctaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcg

SEQ ID NO: 1841 - DNA, 300 bp, Homo sapiens
gagcggggaggcgagcatgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaa

SEQ ID NO: 1842 - DNA, 300 bp, Homo sapiens
  misc_feature 212, 213, 223, 253, 262, 268, 269, 272, 280, 292: n = A,T,C or G
aaggcctgtgccagaggggttggccagttggagcctgggtcagcctcatcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtgnngtgtggaggntggcgaggtgcggagactgcagaccagtgnttcactgtntggagnntgncatgctgngtctgtaccctngggacttg

SEQ ID NO: 1843 - DNA, 300 bp, Homo sapiens
caaagccactttgaattctggaaagttgacctgatggagaagaaccaggaaaaccaagaccagcatttgaggaaagctggttttgtcaacaacaaaatactgatggaagacagaaatagtgttttaggagaaacatttaatataaattcaaaccttgttccaatgagaaaaatacctgataaatatgacttatgtataatgaacgtgaattatatttcagaattaattgttagtaatagaaactcctttggaaggaagcttgatgagctcagtgcacatgcgaaattgctccttcatatg

SEQ ID NO: 1844 - DNA, 300 bp, Homo sapiens; identical to SEQ ID NO: 931

SEQ ID NO: 1845 - DNA, 300 bp, Homo sapiens
caaaagcagcagcctcatttctgtcctcctttgaatttcatattaaattgcttacatagaatgaaggtcgagttcactggcaggctaacaaagctccttgtaatttggccttatatgccctatgccttctgctgtagtaatactttgatgcttgtaattttcttgaacttacgtcattttgtgtctctgcttttgtcagttctcctgactcttagttttgcctgactctgtcttcatagacttgtgtgtaggcattattatctcctgtgaagtcttctctgacagttacttactccctcc

SEQ ID NO: 1846 - DNA, 206 bp, Homo sapiens
gtagtaaaaaagataagcttgtgaaatctatcagctctcaggctaagcattacaccaagagaatcttgcacgatccttcaatcataagaaatcacatgttagtgcagaaggtccagcgtgaaatcctctaagtggccaaatctaggagttcttctctggcttggttggctaaagcagtgatctgtgtcacccccagggccatcact

SEQ ID NO: 1847 - DNA, 300 bp, Homo sapiens
gttacctctcaattttaactttttttttcttttttaattaatgttttttacccatggcaagctgtaatagcttttttgaggggaggtaggtgcttgataaagaacagtaggtgctgcttatcaacagatgaaaggagggttctttttcaggcaaccatctcatttgtgagtgaatggactttctctttaaagtgctgggattgttagtgccatttttattgtaaatatcaaaattgttattttttgtcttctacctaagaattctgtctcttaggctttctcttcccagatttcccaaag

SEQ ID NO: 1848 - DNA, 300 bp, Homo sapiens
attacaggtgtggcgtgagccaccgtgcccggccaagctcctggccttcttattcacttgacagttttgagaatctttgatttcagggatgttgagagctgctcctgtcatctggagttgagtctcacccatgggctacagtgtacacaggagtgggaccttctgttcttgaacttaggctgtggtgtgatcacccttttctctgcatccacctgacaggctgggacttgggctatgctctggacaaggctggctggtgcaatgatgccctctagaggatggatcaggcccagtcaccac

SEQ ID NO: 1849 - DNA, 300 bp, Homo sapiens
gtgaaaacacctagaccaaagtcattctattctgacatattgtctttcttggatatgactttgaaagtaagaattggggaattactggttatacagattctacatttttcttcactaatagtgattccaagaaagtttagatctttccacatggaaaccgtcatgtaagaacagaaaaactctaaggtttatctgctgtgctgctcaactggatccagaccaggtattcttattttaaaagctatatttgatagatgttatattctactcttgcttcaaaacaaatcactttcgacacag

SEQ ID NO: 1850 - DNA, 300 bp, Homo sapiens
gttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctggga

SEQ ID NO: 1851 - DNA, 300 bp, Homo sapiens
gaaaggacccatgatgtaaggatgtttgttgtggggggtgcttgtggctccttaactggctctggaaagagcctacttcccatagtgaaccctgtgaggtccaattctgttcctccccttggagctccaagagaaggtcattgtccttgtagcagcaggtgcccccccaagctgggttctcactgcaggtgccagcgggctctcagtaggtatgacctggatgtgagtggtgagccaggattgaggcactcagcaccttcgaccacacttcccactctccctgggggttcaaggcaggct

SEQ ID NO: 1852 - DNA, 300 bp, Homo sapiens
aacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagc

SEQ ID NO: 1853 - DNA, 300 bp, Homo sapiens
agtcattgagagtctgtaccaaaagctacatgaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgct

SEQ ID NO: 1854 - DNA, 300 bp, Homo sapiens
tatacatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagaccttccccctaataccctggatgaacttatcgatgaacttggtggccctgagaacgttgctgagatgactggccgcaa

SEQ ID NO: 1855 - DNA, 300 bp, Homo sapiens
  misc_feature 235, 238, 240, 244, 249, 251, 253, 262, 265, 270, 291: n = A,T,C or G
atcacctgatgtcaggagttcgagaccagcctggtcagcaaggtgaaaccctgtctctactaaaaatacaaaaattagccaggcgtggtggcgtgtgcctgtagtcccagctacttggggaggctgaggcaggagaatcacttgaacccggaggcagaggttgcagtgagctgagatcttgccactgcactccagcctgggtgacagagcaagactccatctcaaaaaaaaaaanaanangganttacntnantttaatggntgnttggnaggttttttgcaaacaaaaantcctttttt

SEQ ID NO: 1856 - DNA, 300 bp, Homo sapiens
cctctgcaaaagtgaaaaggcaacgaaaggcaggagaggagataatcaagcatggctggtcccctcaatgtgtagagtaggggagcttgagctgagggtacagttggtgcccagatgctcagctgcccacctggcttggcctggcttcctccacagtccataccctacctccaggtgcttcagggtccacagccaccccagtgggtgtttgggctgaagtagatcatgtcatgtggatgggcctgtttacgtgatgtgccatggaagggagtggcaggtgggcagcttggagtgaaaagc

SEQ ID NO: 1857 - DNA, 300 bp, Homo sapiens
ctgtgaagtatatgtaacatgagcgagcgctaggggaacgcttcaaagcagtaggcagacatcattgtggagctaaactaagcacagtgcctatagaccagggtgctatgaacaggcggaaagagtgttgacaatcagaaattgtcaatggtaattgcaaataggaagacgcaagggcagaatggcagctgcaagcactgatttgcaattatgccactttcactgggaactctgagtactccagggtgggtagctgctgcagcttgctttcttctaatgaggattaatgattactttgag

SEQ ID NO: 1858 - DNA, 300 bp, Homo sapiens
cagctgtggagctactggcagtcttgatagaacagcagtttctaggtagtgaccagattgcctggaattagtacagtcgaagcggcacgtacaggacaagaattcaagatgcttgacagtggagcacaagggcattagcttgagggacagccagaataaatggaaacttcattatccatggattatgcacttggaacttaggtcctaggcaactctgatattagtaatttggccagcaggctcattaagctcttaagaaaagtgggcctagttaatgaattaacacaagatgacatttta

SEQ ID NO: 1859 - DNA, 300 bp, Homo sapiens
gcgaaacaccactgcaaggtgaacagcctgggttactagcagaaaaacatcattcagtctgtaaatatttatgaagatctgtgagaggcactacccttaccctggagctaacctgtgacccagagagcaagactcttgcttttacagaacacatattcttgtggaatgagaggggctatcatcaagtaagcaaatcattccatggagtgtgttagtctattttcccattgctttaaagaaatgccttttactgggtaacttataaagaaaagaggattaattggcttatggctccacagg

SEQ ID NO: 1860 - DNA, 300 bp, Homo sapiens
aagagcctgtctccacctttcagagaggactgaggcctgtccccagccccacccagggtctcctgggaagaccagcccttccaactaccaacccgttccttttcccagtctgagccacaggaagagcctagcggggaatgtcatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgg

SEQ ID NO: 1861 - DNA, 300 bp, Homo sapiens
gctgactgttggtcatcttgccagatcttgagtgatgtcttttgcttcatcctgctgtgcatcttgcaggaaagtagatgctcttggtcatttgagtaatccgaatcttgttatttccagtcaactcagttggatttctgggatgagaattagaggagtcccattgaaaaactggaatgagagatgagaagtttgctgaaaacagaacatttttttgtgtgtggattgatttgcctcgtatacctgccttgtactttaaccacatctttgcagtttaaaatagaacacattatttcttca

SEQ ID NO: 1862 - DNA, 300 bp, Homo sapiens
gataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgtt

SEQ ID NO: 1863 - DNA, 300 bp, Homo sapiens; identical to SEQ ID NO: 100

SEQ ID NO: 1864 - DNA, 300 bp, Homo sapiens
atggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtac

SEQ ID NO: 1865 - DNA, 300 bp, Homo sapiens
gagaatcatgactgctggctgaagcctgcatctttgggtaaacagggcaattaattcccagagaacaaggacatcatggatagttaaggcaaccagataggtgcttatcctctaggtctccatccaaaatggagtaatgacacctactttcgtgttttaagatttaaacgcagtaacatatgtaaagtgcagagtctgatgttcgagtccacaacgatgtaaataatgcaaaaccagtggattactcatgcttaatttatattttacttggaaatttatttcctttttcttggttatctc

SEQ ID NO: 1866 - DNA, 300 bp, Homo sapiens
gcataggcagggctagaatgttggacttcagatctcttacttctgtgtgctagtgcaccattcttagtccagcacagacaattctcaaacagattagcaaaccaccctcttgaaattgcaagaattgttaccatgtgatcaaggcatcataattaatgcaaaccctagtttctagttgggaaagagattaagatggagactttgtagtaaaagatggacatatattttattcacatagcttattttattttgaatgaaagagccaagcaaactctagccttggcctgttcctgaggaggt

SEQ ID NO: 1867 - DNA, 300 bp, Homo sapiens
cagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatga

SEQ ID NO: 1868 - DNA, 300 bp, Homo sapiens
gcttagaaaattaacctttttctattaggctggtgcaaaagtaattgcggtttttttgccattaaaagtaatggcataaaccattacttctattaataaaaccctcaattttcattttcatagcctttcagaatgggagtaagctttgcaatcaacctgctccttcatcttatctgtacacttgataaatctgattcagtggttggaacggaatctgcttttcctgtattggttacaagcaagcactttgcctgggtgagtgtagctgcagtatagcatagaattaagactacagtttca

SEQ ID NO: 1869 - DNA, 300 bp, Homo sapiens
gttagagtaagtaaagatatggttaagaaaagtacttaaatccaagaaagagagtcaacaaatatttataccattctctcattaagtgacactggttccataaatttaaagacagcggttcacccatatctatggttttgcattccatggtttcagttaccacagtcagcctctgtctgaaaatattacatggaaaattccagaaataaacaattcataagttttaagttgcatgccgttctgagtagcttgatgaaatcttacaccatccccctccatccaggctagtacatgactcat

SEQ ID NO: 1870 - DNA, 300 bp, Homo sapiens
gagcagagatggccacagaaagccagagaagctggacgaggcctccttggcaacaaaagagtgacttaacgcagttctaatgtcctacatttttatgctcttatcctgcagttacaggataagtcaagatacacggtctacaaagaaattttgttctaattttataatagtagagatggggtctcactatgttgcccaggctggtcttgaactccagggctcaagcaatccgcctgcctaggcctccctaagtgctggattacaggcatgagccactgaacctggctgtacaaagaaatt

SEQ ID NO: 1871 - DNA, 300 bp, Homo sapiens
cagatatcagggaccgggactaggtgtgatggctcagctccccactacccagacctgggtgagattttaaaatgtattgctcaaacatttatatggtgtttactatgtgccctgcactactctgttttataaatgttacttaatccctatgatagcgctataaggtacttactataattatccccagttttacagaggaggaaactgaggcatggagagattaagtcatttgtcaaaaatcagatctgggaatcctgcctctggggtccatgctttaaaccaccataccatggtcccttg

SEQ ID NO: 1872 - DNA, 300 bp, Homo sapiens
aaaccatccaagcagtttttattcattaatattcataaatacacacagcagcttcattagagatttcaattttcctcttcagtttgaatgtggagtattaggagagccttttgcatgtcaaggtacaggaagcagagatcacccctgcactgctacctacatttacctgctagaagtaaaaattagttaagtggaaatgattatcatatatattttctctcttccttttgaatgtacacaatgtaacaagagtgacagacctgaaattacaatcaccaaacaaacccaagatagttgttg

SEQ ID NO: 1873 - DNA, 300 bp, Homo sapiens
gaaaatataggcctttattgtctttaacattgaagtaactttgtagttttattcaattatgagccagcagatccttagtttaggcccttatattgcatacctaattagaactttccccaaagttcaactgcatgaccttaatgtattggagcacgtcttacaggtggacttaaaactctagaatttcctgagtcgttgttattttccactgaaggtctttccactgtacagcatttcaggcatcatcactatgattcttttttcttgactgttgcttgttttcccactgctcttttcccc

SEQ ID NO: 1874 - DNA, 300 bp, Homo sapiens
tacaagttggattactatgatgtgtctcaagaagttttggctgtttaccttcagcaaattcctgatagtaccatcgcactcaatcttaaagcctgtaaccattttcgcctttacaatggcagagcagctgaggtattgatggaagtgtgtttttaatgtacttcattccaatttgaattactttatactttccaagttattcatgaaactctgttatctgtaactcttgattaatatccctttatcattgccactgtgattctataagaacctaattatatgtttatcaggtattctaaa

SEQ ID NO: 1875 - DNA, 300 bp, Homo sapiens
aagaggtctgctcacctactgctgcccaccctgggctgggcagcaagaggtctgctcagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcg

SEQ ID NO: 1876 - DNA, 300 bp, Homo sapiens
atctagttgaggcaaagctcatttggctatagagtaaatgtaagacttgttacaacagaaatttaagtggccagttcaatgtcctttggctatatttgacctacctttaaaacctagcccatttcatatcagcctcttctgtgcctgggcttgaaatgtctaaagctgccttcgtgtctgggattacaccatgtaggtcagtataaagagggcagtcactcctccatttctcccagcgtgtccagttcagcagatttctaaagctgttaagcagcctctctttttgaccgtcctaaactt

SEQ ID NO: 1877 - DNA, 300 bp, Homo sapiens
tttaaagtcttccccatcatatcactgatctcaaaagctagatttgtcttcattttagtcgtatccctaaaaccatgcattggtctggacaggagttgtcccatattcccttgcagactggtcactccatgttctctgttacagtaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattata

SEQ ID NO: 1878 - DNA, 300 bp, Homo sapiens
gtgaggaacgcctagaagtgtgcttgttttcagcctcttatcatctgccggcctgcaccctggtcagaggatcagattctttcaagaggcagtttctttcattcagccttttacttgagtgaagcaggcttgttgggcatcagtgaatatcatgctaagagttccgtagttcaaggagacctagaataagggggaaagcactttgtgaattgcccaagttattgcctagggatatgcatattgggagccctgaggagtggccaaggcaccacagaacagagactcacactcagtacctga

SEQ ID NO: 1879 - DNA, 300 bp, Homo sapiens
gtcggctgccagcaacaatcaccaggtacgtctcacttcctccttctggatgtggctggctttacggaaaacagagcgtatttgtgaaggcttgtgatgcattatagctattgccattccccaaaagcaaaaacaaagttgcttttaggttgttctgtggcatttctgttgggtactaacaaagaaatcacctgttaagcctgataatgactgtttgcaaaatttattataagagaaaaggcagggtattgagggttgcttttagaagtctgtcatgatatgaacacagaccccagaaac

SEQ ID NO: 1880 - DNA, 300 bp, Homo sapiens
aacgcttcaattgttttgtagaaattttaataggaacttcaagaagtaaacctttataacattgtaaattcttacgtacagcatcacaaaagacaaggaatactgtcatatccttttagcaaaatgatattgcctaggttcttgttgcaaaataccacataatgaaatccttcctgttgcatgattaactgggtgagaatatcatctttccttttggtccgtagaaatgtattattcactactccattcttgaggtttgttttttaatttttttggagacagtctcactctgttgcccag

SEQ ID NO: 1881 - DNA, 300 bp, Homo sapiens
gctgggtgtggtggattacacgcgtgagccattgcacccagccttaagggaccaggactttatctttctaccctgctgtaccatctttagctttttatctttttattctcatgcttttgtttcttcatgatgttaggatggctgccataactccagggtatacaccaatcctctaaacaagaaacaaggggttgagacaaaacactctgagaaggttttctgggaacaaaagacctccaagctgactttgcttcataactcattggctcaaactgagctatatgcccatacttagagcaa

SEQ ID NO: 1882 - DNA, 300 bp, Homo sapiens
gtgtttcttctacctcccctgcacaacattgtttatatgccccctaaaatgtaacttctttagattctgttgttacgtgcaacactgtatatctctccatagcacttaatcagagtttgtaattaggcatctttttgtgtgattatttggtaaatgtccatatcccctactagcctataagctccatgacttctaggtaccctgtctgactacgtgtatcactgtttctaccgcctaacattgcctagcacattcattgcttcacaggcatctgaatatggttttataaaatacattgct

SEQ ID NO: 1883 - DNA, 300 bp, Homo sapiens
gccatgttggccaggttggtcttgaacttctgacctcaagtgatctgcctgcttcggcctcccagagtgctgggattacaggtgtaaactactgctcctggcctggaatccatttttaatgggaagcacaatttcatagttaatagttgggggcaggagcttaagttataattgcagctccactaattcttagaatgaatatagattgaagtcttggggtttttggcatgatttgtgagatgaaattatgtgatagcagaaggaaggcctcctgcacttcatgtttacagtagagtccta

SEQ ID NO: 1884 - DNA, 134 bp, Homo sapiens
gtaaaagtcactctgaggaaggccagaacagtgcagtggctgctgggtttgatgaaccgtactcctcagagcatctaggcccgtggtttttcagctggagctcatctgagcccctgtggggggctgtttaggac

SEQ ID NO: 1885 - DNA, 300 bp, Homo sapiens
gtggaatcagaggtttctggctgactcggtgggtgctttgaaccaggaaaggacaagaaagaggtgagttgcacttggcagttatagtacagctgcctgcctgtggctcttcttgctttgaggtttgctccttcttcagtgcaaccctttgcccagacatccctaatgcccccagctcagagcagcagttggcaggcaggagctttgcagttagccatcggagagccccacagacaggggttaataagtacaaacagtcatcacaattaattcaggccaggctgtgtgctcctggctttt

SEQ ID NO: 1886 - DNA, 300 bp, Homo sapiens
ggaaagccctgcatgacagcctgcatgactgttcacattggttttacacacgctggaaagattgggaatcatggtattctcagagctttggtttacatttttccttgagagaagaacagtggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatc

SEQ ID NO: 1887 - DNA, 300 bp, Homo sapiens
ggtagaagaagaaatgattacgaaaatcctggataagccagctccctttcaaggggatcagtgtcctcagtcccccacccccacctaaaaagcaggtcccattcagcccagccagctcatccctgcagttccatccaggacctacaggtgtcgccctccgcatggcgaggcccggaagggcagctggctgcaggaggcagaggagtctggaccgcctaacctgagcatgtggaaataatatatgtcttcaagtgaactgtctggtcctggagaaataaaataggacattcataagcagtt

SEQ ID NO: 1888 - DNA, 300 bp, Homo sapiens
cccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacatt

SEQ ID NO: 1889 - DNA, 300 bp, Homo sapiens
aaaaggtgaatgcagaggcctggcccagaccccagccctgtgtgtcaatacaacttttcacgttgttacatacacattttccagtctgtgtctccctctgaaagaaaccctgaaattcaggttgctaatagattgttggttgcaagtatgaaggacagaggaggtaagagaggaggcaacttgctaatgcaaaagcagtgtactgaaagtcacttttatttcttatttataatctacatgcacactctggataatagatgacactgctcattcagtactttaacttcaaagcagagagaa

SEQ ID NO: 1890 - DNA, 300 bp, Homo sapiens
gactgacagaggtgccaacatggcattctgtttttgaaaagttacatgacactattaagtattgaaaatgttctaactagaaaaacgattttcttaatcatagtttttattgtggggtgtgtatgtaagttttaacgtgcaaattaacatatagaagtcactttgtgaggtttcatttaaatgtatttctcagattttgctgaatctgtaatagccattgaaatatttaagtaccttggctgttcctggcatcaataaacagatttttctttccctcctcatgccatacaaaagttgaca

SEQ ID NO: 1891 - DNA, 300 bp, Homo sapiens
cactcttttatattagggacttgagcatctggagagtgtggtatctgagggagttcctggaactaatgtgcagatgccaagggacaactgtactattgtacttggaagtactcatggggtcatattgcattgtttctttgagtcctaattctgccaacatggcctggtgcttgcattaatcagctttctaatctctgagtaacaaggcacagtaacaaggagcagtaacaaggcacaaggcttggcacctgagagtggaggtacccaggaggcagacaccataaggcgggaaatggacat

SEQ ID NO: 1892 - DNA, 229 bp, Homo sapiens
  misc_feature 176, 181, 195, 196, 198, 207, 209, 214, 215, 219: n = A,T,C or G
ccctcacactctgccaggctgccgggagcttgggccaggtctaaggtaatgaggtgctcctctatcctgctggaaaaaccggacagactcagaaccacaaaggcaggtgctgccagcctggcgccttcctctctgcttaggctggaatgagcttgtacaggcctgtgcctcacccnttctntcttctaggctcanngnatgcttaancngggcnnggtncacggcacct

SEQ ID NO: 1893 - DNA, 272 bp, Homo sapiens
  misc_feature 211, 214, 222, 231, 240, 241, 242, 259, 263, 270: n = A,T,C or G
cccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgcnganattggacnttgggcatntcagttctnnnagatgttggtttggcgntatntcttttntt

SEQ ID NO: 1894 - DNA, 300 bp, Homo sapiens
ctgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctct

SEQ ID NO: 1895 - DNA, 300 bp, Homo sapiens
atccttcccactttgtatcgacaacccggttggtcccggcgtctgagttcttggtgtccgagtcgactcgaggcacaactagggtttggggttccggatatcgcctaggcccaacatcggaccgcgctctcgatttctgccgcgtcccgcctctaggacgcggagtccgtgtgcggttccgtgaggctggagggtagatcttaaggatcaacaaacagtaataatgactgaatgtacaagtcttcagtttgtcagcccttttgcttttgaggcaatgcagaaggtggatgttgtttgcct

SEQ ID NO: 1896 - DNA, 300 bp, Homo sapiens
attagtgataagtatatatggacatctaagggaacaaagaaactaacaaaagacaagaattttcaagaaggaaaacaaagaaaaaaaggtaatcagggtatgttacatagtttagctgcttatagtttttctttggttctgctcatggaaacacaatgactatcaatctaagtaagactataatatattagaaggatgggtgatgagaagtgtgaagtgttgcaaaggtaaatccttatcttccgctatgaagtatcaataagcaatgcccaaaaaaatgaactattaagaagtaactgt

SEQ ID NO: 1897 - DNA, 300 bp, Homo sapiens
acatctccaagcagggacttagtagttataggtgggtcttaaggattctccagtcagtctttaaactgctggcaccgaagcctccagtgcctttctcctctatatcccatagagagttactgaagtagttctttttggatttcagttggccttttagtagagcctttctcctaaaggattaaaacgtgagactgcgggcttgagccaaaaagcagtcagagggacaaatactgggttttacttagaataacccacctgcctagtgccagcctaccactcttgaacaaaacttgtatgatt

SEQ ID NO: 1898 - DNA, 271 bp, Homo sapiens
  misc_feature 176, 191, 195, 213, 214, 216, 227, 228, 230, 234, 242, 252,259, 261, 262, 263: n = A,T,C or G
gcagaaacaatagtcaggagtttgagaacaggctgattaacatggtgaaaccccgtctctactaaaaatacaaaaattagctgggtgtggtggcgggtgcttgtaatcccagttactcaggaggctgaggctgcattatcgctttaacctggggggcggaggttgcagtgagcctngatgggggcaataanagcnaaactttggctcaaaaannanaaaataaatanncnatanaatatgcnaagccccttntcttccngnnncctctcgg

SEQ ID NO: 1899 - DNA, 300 bp, Homo sapiens
gacacccagtttaagggacattctgtacggtgcctgaatggcgctcctgaaaactgtgcaggtcctcaaggctgaggaaagcgtaaactgtcccagaccagggaggccaaggaggcgcgatgactcaatgtcatgtggtgccctggatgggatccagggacgggaaaaggacacttgggaaaaactggtgaagttcacgcaaagtgtccgggttagttcagcatcagaagaccaatgatggtttcttggttgtgacgaaaatgttccatggtctgaaaggtgtcaacaccaagggaagct

SEQ ID NO: 1900 - DNA, 300 bp, Homo sapiens
gctacgtgggaggctgaggcaggagaatctcttgaacctaggaggcagaggttgcagtgagccaagattgtgccagcctgggcgacagggtgaggctcttgtctcaaaaaaaaagtccacatcttcatgaaccctcagactctggagttgggtgtcggcttttttagccagcttttgttccgtttagtgagaacctattaaagaaggaaagtgggtaatggagtcccagccactcaagagactggatatcccccgagaatggcttgggttaccagctatggacccttggaagatgaatct

SEQ ID NO: 1901 - DNA, 300 bp, Homo sapiens
tcccgggttcatggcattctcctgcctcagcctccagagcaactgggacaacaggcgcccgtcaccacgcccagctaattttttgtatttttagtagagacggggtttcaccgtgttagccaggatggtctcgatctcctgaccttgaatcacaagagtcttaacagggaatgtttcaggaaacaaataggataagacaatgccagaggaaggatagaaacatgggaagtttctatcatttcattttctgcgtttccagcatgcccttggaaaagactccctttagtccctttttcaatt

SEQ ID NO: 1902 - DNA, 300 bp, Homo sapiens
gagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccaggga

SEQ ID NO: 1903 - DNA, 300 bp, Homo sapiens
ctgaaattgaagatgttggttctgatgaggaagaagaaaagaaggatggtgacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagt

SEQ ID NO: 1904 - DNA, 300 bp, Homo sapiens
cccggaagcatccaggatgtgggaacattgtgacatttgcacaatttttatttattgctgtggaaggcttcctctttgaagctgatttgggaaggaagccaccagctatcccaataagggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtg

SEQ ID NO: 1905 - DNA, 300 bp, Homo sapiens
cctgtgtccagcgtcctcggttcaggggaaatgttttggtgttcatgagtagtatgtcccccagtgccccattgtgtgggcgtcctcatggggtatccattcttctaggaagatcctggggctgtttccagttcgaagccattattaataaagctgcaaggaagaaatatttttatggatgtgtgtttttatatctctgataaatatattcaactggaatcattgggtgtattgggccattctcccattgccaaaaagaaatacctggccaggcgcagtggctcacacctgcaatctcag

SEQ ID NO: 1906 - DNA, 300 bp, Homo sapiens
gcatagttggaagttaaggttgaaaagagagataggggaaaacaggtggaataatattgaaaattggatcaagaatataggtgtaggcgttagccattttatcctgggagaagggaggaaatgaaataaaaacaggaatagatagacgttttgaggcgaaaggaatgaatccagcatgctctgtttagtgatgtagatgagatcacctgggaaggcatgaatgggcgggctgagtggggtagtgacttcagaacagtaataagggttgaaaagcactgctgtgtgagggggaaggaatgt

SEQ ID NO: 1907 - DNA, 300 bp, Homo sapiens
atccgcctcccgggttcatggcattctcctgcctcagcctccagagcaactgggacaacaggcgcccgtcaccacgcccagctaattttttgtatttttagtagagacggggtttcaccgtgttagccaggatggtctcgatctcctgaccttgaatcacaagagtcttaacagggaatgtttcaggaaacaaataggataagacaatgccagaggaaggatagaaacatgggaagtttctatcatttcattttctgcgtttccagcatgcccttggaaaagactccctttagtcccttt

SEQ ID NO: 1908 - DNA, 300 bp, Homo sapiens
gatgcatgaattactgcattaaaattgatttatgggaattattgttgtttcagtagcatttcaattcagttgccaaatagagcagtgggcaatgttaacggaaacaactgcaattggcgcagtatggagtgcctatcgcactaggaaatctgagggtcacaaaagaaaggagatgtgaggataagaaactttgtttttcccttgttgggaactctttaggcctcggtttctggtgacagccccagggatcatcaggcccggaggaaatgtgactattggggtggagcttctggaacactg

SEQ ID NO: 1909 - DNA, 300 bp, Homo sapiens
ccttgttaaaaacatatgtgcttttccactgctaacttcagacccacactttgcccgcatttctgcagatcatacccctagcccaggagcctcccgcagacttcagagcctgctgtcctcaccagcgcccccacatggccggtctgagagcaagtggagagtcacagtcacagtcacagtgcccaacgcctccacctggtcctgacgggtccccaggggacaccatataaccttagtcatgtctcattgcccggaggaatcttcccccagataggaataaccttgtaaaaaagatttgtg

SEQ ID NO: 1910 - DNA, 300 bp, Homo sapiens
cagagctggggcatggcatgtctcaggaagccatgcttgtcacagaggaatcactccgaggctaaaggaacatctgggcaatcctacttgtgtactcattggattcattcagtgaccttgttattatccttctagctaaatgctctgggtcttaattcacgactccaaggttgctcttgattttaaggaacattttggcagaatagagagaagttgagcaaatattaacagatgtccaaaggggcagtgtgatttattatgtcaagagaatcagttttatgtcgagggaagaattttggt

SEQ ID NO: 1911 - DNA, 300 bp, Homo sapiens
aagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtg

SEQ ID NO: 1912 - DNA, 300 bp, Homo sapiens
aaaacatcagggaagctgtttgatagcagtgatgatgacgaatctgattctgaagatgacagtaataggttcaaaattaaacctcagtttgagggcagagctggacagaaggttagtgaagactgaaaataattagacttgcagcatgtccttattttttgacatagtccttaaatctgggtaaatgcaggcagaccttaacctacattatagcatcggggtgtttatttggagagtgagtcttctgtgatcctctctgattggttcataagtagatggaggtaggcaaacatcttaatg

SEQ ID NO: 1913 - DNA, 300 bp, Homo sapiens
ctcctatattcctgtcctgtagtggccttaagaaatgttcacatttgcaagctgcaccagacaccatcagatctggttctctccctggggcccaaggatgctcttctttttcatcttttattttgatcatggaggtgttttcacagagtttatccccagtagtaaattacattccaattctgtgagtcagaacaacgttttaacatgcacaccaacgtccgggttgctgttttgctaccagttttgcctggggtgcaggtatttttggagatgggtctaaaacatctcaaaaccacatga

SEQ ID NO: 1914 - DNA, 300 bp, Homo sapiens
gtttcactgtgcggtgcagtgcggcggcagctcgtgaggaggacccgtacattgacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctgtaagcatccccttgccccaggcattcctgccagtttctggaatgagttgtaactggtatattttgtgtttatcttt

SEQ ID NO: 1915 - DNA, 198 bp, Homo sapiens
ggaaaactgctaaattaaaatactacattttacggaaactgtggagctgcctccttgatagaatgttaggtctgtttttgttgtcttctgcctatgtctcttgacttgcagtttcttttgtttcaaatcactctgccctcgtatatactttggttagactacttttggtgaagcactctccaatagaagaacataatg

SEQ ID NO: 1916 - DNA, 300 bp, Homo sapiens; identical to SEQ ID NO: 1446

SEQ ID NO: 1917 - DNA, 300 bp, Homo sapiens
ccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaacatgcccagggattgtctatttccctcctctcaacaa

SEQ ID NO: 1918 - DNA, 300 bp, Homo sapiens
gttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagg

SEQ ID NO: 1919 - DNA, 300 bp, Homo sapiens
ggcacccccaagatgttttcttcttaattattcctaaatacttttatgtgttggcattaaattgtaactttataggctcccctattctttttgcttttttttccccctgaaattactgagcaacaagattcctgttctctccccttcaaggctttgttttctggaacttgacattctcaaatcattgccagttatttttagtacgtgattagtctcccttcctcaggtatgttttccccaatttggattgaatctactgtttgcatcttgtttcccatcccaccttcatacagattgtat

SEQ ID NO: 1920 - DNA, 300 bp, Homo sapiens
tgctaattcagccctaaaccccatcctctacaacatgacactgtgcaggaatgagtggaagaaaattttttgctgcttctggttcccagaaaagggagccattttaacagacacatctgtcaaaagaaatgacttgtcgattatttctggctaatttttctttatagccgagtttctcacacctggcgagctgtggcatgcttttaaacagagttcatttccagtaccctccatcagtgcaccctgctttaagaaaatgaacctatgcaaatagacatccacagcgtcggtaaattaagg

SEQ ID NO: 1921 - DNA, 300 bp, Homo sapiens
taagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactg

SEQ ID NO: 1922 - DNA, 300 bp, Homo sapiens
gtcagatgtttctggggacgttgagctgcagtgaagtgagaggggcagagggggcttttgaagtcacaaggtcagggagaggagaagaagcgtgctggatgagtcacactgtaggactcaagccagtaggttcttgttagcccggctactgacctggagccaggcactgatagcaacgtgtcctctgagggaaggcaaatgggaaatccaagcaggcactgggatctgcctgtgacactcttgtggggcctggtccctcgacctaagtgagcttgggccactcagagccaccccaggtgc

SEQ ID NO: 1923 - DNA, 300 bp, Homo sapiens
gggcgaagaaggctggttgggaaggagaccagcataaacactttggggactgagaggataagccatatcattagtgaccctcggcagaaagaaaagaataaagcgttggcttctgattttcctcacatttctgcttgtgcacatgagacaggcaaatgtacactggggaccaccatgttcacgtgacatcaagaggaagcggaaaccagtggccacagcatctttgtctagccccagtgcaggtggtagaaggacagcccccctgccctgagacaacactcggaggcctgtattccagcg

SEQ ID NO: 1924 - DNA, 300 bp, Homo sapiens
atagttttatgggttctgagttggtgaccagtaagttgcatgtagtgctggcacttacttaataactattcatgatattgttaataacttgttataggattgtattcccaattacagtctctaagattgtaattgatattatctgagaggtagtgtgacaactttcttttgttgttacattaagccgaaaacataatactaatagacaactaacagtttgcttatcaggcacatcaactaaggcacctccccccatgctaagtttctcctggatataatgaagttgattgtttcccagtt

SEQ ID NO: 1925 - DNA, 241 bp, Homo sapiens
ctttgcagccttttcctgcccttaaatttgatacctttggtgtaggagctgcataagtaacagttgctgcttttacgtttccacgcgtgatcttgaccctgctagcctgaagtgtatggtttctcttagccagttctaatttttgttcaggtggaagatggatgcctgaagtgtagactgctgctagctgaataccatctgggagcataaaggtgacctgaaggtagggtgatatgtctta

SEQ ID NO: 1926 - DNA, 300 bp, Homo sapiens
aggatgttgctgctgtgggccgcaagggtcttggtagcttcctctagggcaggcttgtgttcctgattggggttgggatgggtgggggcatcccctgtggcctcagcaatccagccctgcgcatctgggtcccattacacagacgtagacattgaggtctagttagaaggacttgccaggagtcctgtaatagagcttggcacttgggtctcttgactctcagggactgggtgtgagggaagtgggctccttttgctccctacctgcagtgcctttgaggggatgagggtcttccatcag

SEQ ID NO: 1927 - DNA, 240 bp, Homo sapiens
gcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacactcccagacatgcc

SEQ ID NO: 1928 - DNA, 300 bp, Homo sapiens
cttggaggctgtttccagctagagaaagacctgcttatttctcactgaataaggttccaacaggctgccaaatcctgtgtatgcctgtacccaaatggaaggagtgcctttcctcaattcataaaaaagacaaagacagtggtaggatcagctattatgtcagtacatgaaaggaaccccctatctcaatcaaaatggtaaaggaagcttgtctcaaataacagcagagaaactcagtttaccagactataaaagttctttggtcaagaagataaagagctctccagaataagaatacct

SEQ ID NO: 1929 - DNA, 300 bp, Homo sapiens
gcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctg

SEQ ID NO: 1930 - DNA, 208 bp, Homo sapiens
aagagagacagggagaatccgaggtaaaactgttaggaaaacttaggagtccagatgctgtccagttatatgctaccctgtacaggttgataggttgcaaatgctttctgtccagtgtatcgctttgtagctcactaagcagttttgtatccaactttgtgcttttatttcagtgtttttctttttctttctttcttttttttttttt

SEQ ID NO: 1931 - DNA, 205 bp, Homo sapiens
tagggtcttagtactggtttgggcataattatactcagtgtttgggcctctgctaaaattctaagacgataagaatatcagtttaagttctgttacagttgttttcatgaagcttgtaagattgatatttaagtggacaaagtgggaagtagtcagttttcagggctacaggggtcatcactttgtgctcagagtacagctggca

SEQ ID NO: 1932 - DNA, 300 bp, Homo sapiens
tgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccat

SEQ ID NO: 1933 - DNA, 300 bp, Homo sapiens
tgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgaga

SEQ ID NO: 1934 - DNA, 300 bp, Homo sapiens
ataaaggcctagtttttgtatcccaatagatttttaccaagcttcccctgaagaaagtttagaatgagcatgatgggaaaagggagaaattgtatgctgcagatagagggaggaaaggccaactaggtccaacaagtaaaaagaggactagtctcaaactattaaatatatgatttacctagcaaaagctttaagtcacagctgaattacactggggaaacaattacagactttacaatggaaagaagcatcttcaatgttggctgcaatcactgacagcaggaatactcacttttgaaa

SEQ ID NO: 1935 - DNA, 300 bp, Homo sapiens
gcctggggcccttctagcctgagctggtgacctgggcatctgcaccctaaccccagctgaccgagtcagatctttgtccagtgttctgaagatcaaatgccgtgcccttttgcaatataacaccagctgcttttagtccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgcca

SEQ ID NO: 1936 - DNA, 300 bp, Homo sapiens
gttgccaaggattctattgccatgtgttgaggagtaggagcaaggagatagagcaggaccaatgttacaataagaacccactattaacccccaagaatctgtcttgtgagggagataaatagttatcatacatgcgataagtcccacaccagcacatgaaaagattagaagaacaagagaagggaagaaacctactgacctgtttcagggtgggatgcttcataaagaggataacagttaagccactaacagtaatgcctctaatcttgaatctgttacctactagttttgtgtccctgg

SEQ ID NO: 1937 - DNA, 300 bp, Homo sapiens
agaacctttattttaacgtttcccagttgcgactatctctttggaaatgtgcataaataaaagccaagtcctaacagctgcagcgggcattgattggaacactgactcctaaaaattttatgcgtatattctctcatttatttccatagaaggtgaggttaaattactcgctgaagttcgcacatttagtaaatggagatctgggatgcaaatccgctatgcctgaccgtaaagcctagttttaccctttacattttgcctattcagctctctctactccttggttttgctgataaagag

SEQ ID NO: 1938 - DNA, 300 bp, Homo sapiens
actcaaaagcctggaaaagcaagggcagccctgtccagctaagctccccaccctctaccctgggagtgtttgtccgtgggccctcaggtgccgctgtgacctcttccccctagaagctgacacactgagtcctcttagcgctctcctgtgatggggaagccgggagagaatgggccctgaaaatcagaactagaacatagaatcctctctatcttcttcaacagaacccgcaaagctatcaagaaaatgcatcccaccatattgcacatctgaaaattgtctttcttgctttctgatagt

SEQ ID NO: 1939 - DNA, 300 bp, Homo sapiens
ggtgctcggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgat

SEQ ID NO: 1940 - DNA, 300 bp, Homo sapiens
atttagtgagatttgtattctaggaagtgtgtgccgtcacttgttcatttacaactgcaaagattgtatgtctcctatgttttcctttcatgccaaagaaactcaccctttttaaaagccagcaggttgcacaaaccaaaaacaaaatattttgccccttaaataggcattttaagaagttttatttcctggtacttaaatattgtgtagagggaaagctagttgtaataatttgtaaaaatgcgtgtatttttaggaatgcgctatttccagtaagggaagtattgacatttttaagga

SEQ ID NO: 1941 - DNA, 300 bp, Homo sapiens
cccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatgg

SEQ ID NO: 1942 - DNA, 300 bp, Homo sapiens
gtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccc

SEQ ID NO: 1943 - DNA, 300 bp, Homo sapiens
gcaacacaaactgaatttccttattgctgatagctgcctgtagaggggtggtcaaagagactctacctggaaaactcttacagaaaaacattattgaataccctcttagtttcagagtttccagtctcatttctccttaaatctattcaccaaaacaccaccagtttcccctaccacaaacacacacataagtacacactcacctattttcaccttctcttccacttccacctttgtgttgaacctgattaaactctgatacttttaactccaaaatatgctatgctcttattaacaact

SEQ ID NO: 1944 - DNA, 300 bp, Homo sapiens
gtctcgagtttgttgttttttgtaatccgttttagagtgaattaaactcagacatccctggattgtatgctgtctgtagaatgttgattttcaggcacggggatgtagctgtagaatgtggcttgttcattcttcctgataagaaattgatctcctgaatggattggccatttggtaatttcttagtgaaaggctgactcttgaatatggctgttataatataaattcttaccaacataaagtaagggcttatttggggcttggtaaaactgtcatgccttgaagtatatatagcttata

SEQ ID NO: 1945 - DNA, 300 bp, Homo sapiens
attgaattttctgataattgaagcttattaattgtctaaaattatcttaagatattctctgatgtacatcattttaaaatgagttgcacacatttctattctgtttcaacatattcaatataatcttcgctcttgttcatctgttggtattcattatataattcagacgtggtctcaggtctggagacatgtgaagttattgctcctacactgagtgtttccatgtcattatgccttaatccttatttagacacagctatgataccctctttacaacataaaggataagcagaaggatgt

SEQ ID NO: 1946 - DNA, 300 bp, Homo sapiens
cacaagaaatgaaattaaaaaataaatcaagcagccatatgctcaacttcattggaccactgcaatcctggtgacatattgagggctgaagaaacccattgcatatagtcctcctgtcactggagatatgtgtggtaagaaagagaaatggccacgttgcaatagcagtgggaagcaaatgcagaaagcacccaggaaaggggaagatctaggtgacagaggccatctagtcttttggattcatctggttctggcacacagagaatggagcttttgtggcaataatttctctactgatgt

SEQ ID NO: 1947 - DNA, 300 bp, Homo sapiens
aggtgttgaaattacagaagggaccatttctggcaacacagcagaccagatatcctataaaagtcttccattacagaacacctacacatcaggagctcaaaaacagatatattctttaaatgtctagccaacattttggaaaagtgtgggaaatccctcagggccaaaaccagagggagttggacaccagagtgataagcagacactgaaggcaaggccaacctcagggcttggctcaatattctagaactttacccttgttctcaagtctccgtgtggacaggggatgagggttacctg

SEQ ID NO: 1948 - DNA, 300 bp, Homo sapiens
cttggccctgctctgtttaaagtcacaggaccataatcttctgaataccaaatctaagactgcctggtacaccccagaggtatgcatgtgcctaggagacggttagttactctgagttatgaggagctggggtgatgattttaagtattcttgttctgggaatggagggtatattctccattttgtgaaattcttggactataggttacattccattttaagctatcacccctcagcatcaccaccatacttgactaaggtgggactgtttgcatagggtaattttgggatgggggaaag

SEQ ID NO: 1949 - DNA, 300 bp, Homo sapiens
tgggttgactcgctacatcagctcagacttggctgtgggtaaccccttgtgaattgttgtttccacatgtgtgttgcttcatttttggctctccgttgtccccatcaccttcccgtctcaccatagggtttagggtattttgctgtgtgttcaaatagaacatgaaagaagccttttaaaagtatttctgtgcctattcacagtcccctaaattttattacagtttttacgttggtttaaagagtattttggtttgatttatatggaaaacttcttttttaacattatagtaacatagat

SEQ ID NO: 1950 - DNA, 300 bp, Homo sapiens
ggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgtcatgaatcgacctccatcctgagctctccaggcctgggacaatggaaagtggatagggggctgtcttccca

SEQ ID NO: 1951 - DNA, 300 bp, Homo sapiens
gagccggcgtggacccagggctgagctgtgaccacgagggccatcccgacgagccgccatggacccagggctgagctgtgaccatgagggctatcccgacgagctgccgtggacccagggctgagccgtgaccatgagggccatcccgaaactgtgattgttttctgatgaagaaaccaaggctttgtgactaactcaacccctcaagaaggacaaaactagcatcagagccccttgcttctgggtctggcaagaatgcctcttgtttgctgagaggtccacagatttacccggctcaag

SEQ ID NO: 1952 - DNA, 299 bp, Homo sapiens
  misc_feature 194, 196, 202, 206, 218, 221, 223, 245, 255, 256, 271, 278,280, 286, 292: n = A,T,C or G
caaagacccttccccagaggcctaccccccatatgtcctcagagaggctgagtgtcccctccaggcagtcatgggccctgaggcccctcctgcctggccctgctccccagtggggaggtgactgcgtttcccagagtgtgagccgctctcctccccctaaaaagctgactcactgtgagtgaccttgggcaagntnccaaancttnttgagccttagnttncncatctggaaaaaatggggccanctcttgccannagtacagggctgccnatgcccntntctctncatgcnccatcca

SEQ ID NO: 1953 - DNA, 300 bp, Homo sapiens
  misc_feature 279, 289, 292: n = A,T,C or G
ggcagtgctgcgcggggctcccagccctgctgggaaggaccagggaaccactcagcaattagaccctcttggccctgcccccaccatgcacccagcagccgggagtgcagcggtcagcctggcagtgagtgaaacccaggccttcagccctccaaagcctggggccaccccctgtagcaggcgatgctagaataaggaggagagccagagctgaggctccttgccccttggccccttcaggggccatgggatctctgtctcccacacccctgtcacggnccgcctggancancccatagg

SEQ ID NO: 1954 - DNA, 300 bp, Homo sapiens
ccaagttccgcggccaccagaagagcaaggggaactcgtacgacgtagaggtggtgctgcagcacgtggacacgggaaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctga

SEQ ID NO: 1955 - DNA, 300 bp, Homo sapiens
attctcttagtgatgggctggaggaagtccaaaatgcagacatgaaagcttacatggaattagtcaactatatgctgttgactgcagagctgtatcttcagaggagtgatgaagctacagtaggggagatcactcatgctaggtatggatctccttacccttggcctctgaatcatatttatggcctatcagaggcagggggaagtcaaacgtaagattaaagctattggatggggaaagaagactctggaccaagtcttagaggatgtagaccagcgctgtctagctctctctcagaga

SEQ ID NO: 1956 - DNA, 300 bp, Homo sapiens
gactagcacatggcaaggtcaggattcaagctaggtagtcagtatctcagccaggctgtctcctggctccctgaacattatggtgctgaccacaaactttcctgtccacttatacaaacttctagtgagtgtgtgtgattactagcttcatgaatacctgacccctccactctgaaggaggaacaggcctgtctggatcacttctctgtccctaactgagcccatctcatttagggaaactacagagcactgttgctttttttttagatggagtctcgttctgtcgtccaggctggagtg

SEQ ID NO: 1957 - DNA, 282 bp, Homo sapiens
acctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaatgtcacagttcagttgccttattcctagttcaggcttactatctagaacctcatgctagcttaggttgcatgtttacattgctgcatgagtctttactggaagcttagttggatcgaaatggac

SEQ ID NO: 1958 - DNA, 300 bp, Homo sapiens
ttggtgtgtaaataaaactttagaaagggtctattgaactttggacaggcaagctccatgagctctccctcactctttgaggcaggttaaagggtacggccatgaccaccaccttaatccttcagggactatttacaaaagattgaaaaatgtgcccagggcccgtacctgcccctctgtggaactagcccaactcaagtgggctggcaggcaagcctggctttcatggggacagaagagagagtttgcggggagcttggcatttttcaacacatgctttttggcttctcctactgaatt

SEQ ID NO: 1959 - DNA, 150 bp, Homo sapiens
gaagatgaggaagccagcactggatctcatctcaagctcatagtagatgctttcctacagcagttacccaactgtgtcaaccgagatctgatagacaaggcagcaatggatttttgcatgaacatgaacacaaaagcaaacaggaagaag

SEQ ID NO: 1960 - DNA, 300 bp, Homo sapiens
gtaccacatctagatacgaggtcagagttcagatgcctaaatattgtagcttgtgttttgtccactgttgggggaagagtgaagagatttgacataccataatgttgattagcttgtgatggtttggcggcagcttaggccagagcataaagtaaaaaggaaaagtgttcacagacaatgaaaactgggaccaagtggtgaatactcaaggcacacagaccaggcaaggatcccagtggccgtggatgagtctcaggctggctctgggccagtggaacacacctcagtgtgggtgaaggc

SEQ ID NO: 1961 - DNA, 300 bp, Homo sapiens
tctagatctcatcggagatttggacgggaaaggggttgaaagagttccccaaagccccggctaggcatccagcctcagccatgggacccatggcctctctttagtgaatgatgcgccacaccagctgtatcacccccaggtgtacctgccatccttccattgcgcaaatgtggaaactgagcctgggggtaggggtgagcccttttgagcagcaggtggtgtctggggcctgggacctgtaaacaaatcctcattactcccagcctggtctctgtgcttgatgtttagtactagaagtca

SEQ ID NO: 1962 - DNA, 300 bp, Homo sapiens
ctcaccaagaacacaaataaacagttgatgaatccatcacatcagtgatgaatccagaatgtgtccatcattttcgtaagtcttagtatgcagagaatctcagatagcaaagcagaaaggatgatgtcacagacgccttgggtacccagcacctggatgcagctgtttgtacacacatactttctgatattatgttgacagtgacttacaccacttcaacctcaggcaggattctatcagtttctttactacagattgatttgtttctttaataattattgtaattactgtcagtaaaaa

SEQ ID NO: 1963 - DNA, 300 bp, Homo sapiens
gatagctatctgacttctcaactatgtaataagcagatgttgtaaatcctatgctgtagttcatgaatctatatgacatgtggggtcgggaacatagtaccctaccataagtcaggttattcctactattctgcaacatgtaaataacactttgaacagagcaagtggtaaagattgcttaatttttgcatgactattttgataaatatgttgagaaggaccagctcaaaggaaaacctcttggtaacttggcataagttaaatgtttcccaagaaagtgcactcttcccaaataaagct

SEQ ID NO: 1964 - DNA, 300 bp, Homo sapiens
tggaaaatataaaaagtgacactttaggcaaatgtgatggcctccgagctgaaatgaaggaactggcaatctttccaaagtggcagccaaggccccactccctgtcctactcaatctctgcagggaaaaactgtgggataggatagcagccagctggggacacacagaggaacattcaacaggaaggtcccgcctagggaaaaggccacagagcccaggcctcttgccgattcagggatccttggatataagtggattagaggagagggaggaaagctatcatttcagtggtctccaaat

SEQ ID NO: 1965 - DNA, 290 bp, Homo sapiens
gcaagactgagggaggagggaggtttgagcagctgtaatgggtgagggaagagagtgggtgggagaaaggagatttgagaagcatcgctatgatccatgaatctttgtagtcaagtttaagaaattcaagtaaacagagttattgtgaaattattattttttggttgctattctctctctcctctcccactctgtctctttttttttctttgagatgggatcttgctctgtcgcctaggctggagtgacgcagtggtgagatcatagctcactgcagccaattttttttt

SEQ ID NO: 1966 - DNA, 300 bp, Homo sapiens
agggagggagggggcaggacagtgtggaatctctagggtgtatgggtaggtagggggcacagttagttctaagtgggcttttatgctaaaagcctctggggatatctgttttgaaaataaagataggtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtg

SEQ ID NO: 1967 - DNA, 300 bp, Homo sapiens
  misc_feature 209: n = A,T,C or G
cctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggagnggcagagcctggagcctgcagctagcagtgggcccctgcctacagactgaccacgctggctattctccacatgagaccacaggcccagcca

SEQ ID NO: 1968 - DNA, 300 bp, Homo sapiens
gggtgacttcctgtgacctccaaaggaagtctcagctctgctagaatgggaccaaagcccagctccaccttgaacttgtgtcatagccttgcttcttgttccctctccttagccgggcagatgccttgtcctttgataaaggcttcctgtcacctcctgagggctcttgtgctttttgcaggtggatgccattacctttaccgctgtgcctcccgcaattgctctgttcacacgctgtccgccatctgcctgcaagggcccaggcagggtcttactcatcattatgtcattgcttcaata

SEQ ID NO: 1969 - DNA, 287 bp, Homo sapiens
  misc_feature 154, 156, 162, 163, 169, 170, 171, 174, 190, 192, 195, 198,206, 209, 211, 213, 215, 218, 221, 235, 236, 238, 241, 242,243, 245, 246, 249, 256, 258, 260, 261, 263, 271, 273, 277,278: n = A,T,C or G
ggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgttctgcctgccntnttccanncctgannnacntacatggaatccctananttnttnattttttntgnananantgnggngttttatttttttnntntannngnnttnttaatgntntnnantattatcntntatnnctttttttt

SEQ ID NO: 1970 - DNA, 300 bp, Homo sapiens
ccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccatt

SEQ ID NO: 1971 - DNA, 300 bp, Homo sapiens
tataggcatgagccattgcacccagcccaggtttttaataagatgaaaaaaatgctgttataaaaagtgaaaagaggccaggtgtggtggctcctgcctgtggtcccagctactccggaggctgaggcaggaggatcatttgagcccaggctgcagtgcagtggcacgatcacggctttctgcagccttgacttcctgggcggcagacggagaccctgttttttaaagaaaagaacagagtacaaaattgtatatgctatataatcacaactataataaatgatctgtagataaaatgag

SEQ ID NO: 1972 - DNA, 300 bp, Homo sapiens
tgtggccccaagagtgggaggagtgggctgtcagtaggccaccaataaatatctgtgttttggctgacccccatatgctaggatactggagatgaggaactggagaaggtgcttaaagagcacatctgtctggtagaggacacagagctgtccttcaagcatttgaacgatgttctcatttccctggaatcttctcctctccaggctcacatctctagctccttcaatgattcctcttgcgacatcattttagttctcttccccaacctagtctttttgcttttaatgaatgatcactga

SEQ ID NO: 1973 - DNA, 300 bp, Homo sapiens
catccctgacagttggataataggttccaggaagttcagtggaaaattaaaacaaagcaacatttatagctgattgaacttgaaaagccattttggtgttgaatggcaaatatgtggacttcagcattcctggagcctgatgcatcccgctggatggccctgttcctgtgtacatgatggcctggggactcagcagtgtgcagggtactctcctttagagggtgctttgaggaaagaagtttgctgccacttacagaagtccccttcccatacagtgatataacacaagtaccccatgtc

SEQ ID NO: 1974 - DNA, 250 bp, Homo sapiens
  misc_feature 140, 148, 158, 169, 175, 184, 185, 188, 197, 204, 208, 210,213, 214, 218, 222, 233, 235, 236, 237, 239, 241, 244, 245,246: n = A,T,C or G
gagatgctgaaggaaattatagccagaggaaattttagactgcagaatataattggcagaaaaatgggcctagaatgtgtagatattctcagcgatctctttcgaaggggactcatacatgtcttagcaactattttagnccatctcngtgacatggncttaattcacncgtgtntaaagtgannacntcttggaanatggatnctanangannatanggcngctttctactntnnnantnttnnngcta

SEQ ID NO: 1975 - DNA, 300 bp, Homo sapiens
attttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctgga

SEQ ID NO: 1976 - DNA, 300 bp, Homo sapiens
gttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagg

SEQ ID NO: 1977 - DNA, 300 bp, Homo sapiens
ctccagcctggggcgacagagcaagactctgtctcaaatagataaataaataaaaatacaaaaaaaagaaactcaaggtacagtggtgggagtcaaaaaagcataaggagaaaaccaagactgaaaactgttattgagcttagtctgtgcctagttcagtccctagcattttacaagttttctctgagttaacaaacttgtgggggaaactgaggctttcagatgttgaataacttgtgtaagttgtagagcaggttcttttccatagttccgcattttttacctgcaatacagcaatgc

SEQ ID NO: 1978 - DNA, 300 bp, Homo sapiens
gtgctgtcttgcgcttgcgcgtggcctcccaaacccctagggatacctggggccagctggggcagtctctgtctcgacctccttttccatttctggctagtttaccgatctgtttcatccttaggccagctgatgaccttggccctctcctcccgagatccctgcagcttccaacagtgaggccctccagcagtgaggctgctgattttcatggcctggctggagctgggggcccaggccaggagcagccccaggcaaaaatcacctcccgctgctcttccctgccactcagtacttttt

SEQ ID NO: 1979 - DNA, 300 bp, Homo sapiens
gtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttg

SEQ ID NO: 1980 - DNA, 300 bp, Homo sapiens
gtctcgctttgtgacgtagcctggtcttgagcgatccttttgccttggccttgccaaagtgctgggattggaggcatgagccactgcacccacccctgttttttatttaagtaaaccattataataactcatttataaaaaggttacttcaagagggctttcaacttaagaattattttcattttgaacatgaaaagttaaatagtaactaagaaactgagaactctgacagtgacctctaataggtaactttaggcaaaagtagacaagtttgtgggtattttgttgttcatgttaaaa

SEQ ID NO: 1981 - DNA, 300 bp, Homo sapiens
gtttatgaagaagctgtttcgtgtgtacagttgctgctgtaatttagccagcagtgccctgccctgccctgcagtgtctgcacagctcccactgcttctctttgctgttgggcacgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttg

SEQ ID NO: 1982 - DNA, 297 bp, Homo sapiens
  misc_feature 67, 78, 82, 86, 93, 101, 102, 104, 110, 119, 124, 126, 147,154, 166, 167, 171, 176, 181, 184, 202, 206, 207, 208, 212,222, 229, 232, 234, 238, 249, 278, 291: n = A,T,C or G
ctgagatcggccactgcactccagcctgggtgacagagtgagactccgtgtcaaaaaaaaaagtccnaaactgtttgncttnattnaggcagnaaatattnnanttcggnatgacctgncatgnanccagtaaggcctttacaaatnacatccnaaacaaatacanntcanatgancaaantanggcccaaatgaaatgacntctnnntctntgctatggcngaaactnatnangacntatggaatcanagatagctaaagttcattatttaaagctntactcccatgagnattatg

SEQ ID NO: 1983 - DNA, 289 bp, Homo sapiens
  misc_feature 48, 51, 54, 73, 75, 82, 84, 92, 102, 106, 119, 121, 124,128, 130, 132, 133, 136, 142, 147, 151, 156, 157, 161, 164,166, 171, 183, 184, 194, 207, 211, 214, 216, 221, 231, 249,252, 254, 260, 266, 269, 281: n = A,T,C or G
atccagtaggtcttggggaacatgggaatctgcatttttttttttttnacngcnttgctgttcatcatcaagnanttcaggncnctaggggnaaaaaacttntttnaaaatgagggagngnttngcancntnngtnatttcnttttnaatngaatnngttnttntnaaatnccaggaccaagnnccaaagtcancagtaaaattcanctgngtncnttttnaacgacctgnaaaataagtttatgaccnctntncggatncaaatngtncaaaacccaaanggccatat

SEQ ID NO: 1984 - DNA, 300 bp, Homo sapiens
gtatagcgcctcatatgaacatgaattcatatgtattatttcatttatcttcacaaccatccagagatgaggagatgaaaactctaagacctcccagcttccaaatagcagagccagtcctcaaatttattgcctagcccaaattctgtgcttcttcacccaggccacattgcttccacatagtttcccttcagttgtaagtagtagaaaagtaggactccagaatcagtatccttacataaacagctcagtacatgagaggcagttgtgagactggaaaatggatgggactagactgtg

SEQ ID NO: 1985 - DNA, 300 bp, Homo sapiens
attatttaaaagtcttattgaaactgaattcaaagggaatgtactatgctcccaggaaaaagacataattgagagcctcttcctcttggtttttcacttatcatgagttctggtctttccttagcactgctggttctggttatcccccaggcttctcagctcagctgagggtgtgagccatcgtatgttggggactagctaccagctaaaggccacgttctctgtgctgtctagtacatgagcaacagagggaagaagttgtgtaattgtaagaacttgtcacctttcatctcttttagt

SEQ ID NO: 1986 - DNA, 300 bp, Homo sapiens
ctgatctccagacccataagggagatgctgagtagacaactggggcttatgggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaagacagaagagaagccatgggacagctgagcccgggcaccctcaagccttggaggcatgaagtttggtggggatctggcaaagaacacctgggagcagcc

SEQ ID NO: 1987 - DNA, 189 bp, Homo sapiens
  misc_feature 135, 137, 142, 143, 145, 160, 162, 165, 175, 181, 182: n = A,T,C or G
gaaacagacaaatctgtaataacggcctaattctgtgtctgtgataagtttcattactgcccaataataaaaaatgtgtaataattatttaagccaatttgttcatttccaacaatttcttttttttttttcccnanacccnnantttaaaaaccctggntnaanggttgaaaangggganngggtccg

SEQ ID NO: 1988 - DNA, 300 bp, Homo sapiens
agcagctgcatctaggggcccttggtgagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggc

SEQ ID NO: 1989 - DNA, 300 bp, Homo sapiens
gaatattaagggtattcatgagaggcaagtgataggttactagggatggattgtgtgggagaaataatgcagaggaaatgatgatcatctccattgaatgacagctgttatatagcaaagataaatgtaaaattagtcttattcttggaagtggaagacagcagttatcagagaggagaatttaatcaaaagaatcagaatagcatggtcacaggccagattcacattgaagtatttactctatattttactgctgttacattcaaaatgtatcagaagtctcatggttcaattaataga

SEQ ID NO: 1990 - DNA, 300 bp, Homo sapiens
gaacaaatcacttaaggagaaagtagaaaaaaagctgtattttaacaaagaggtattctaatcggcaagacaatgaccaaccattacgaccaaccattatgagaatatagcttagggacgtttgtgctcagctcctcttttacccaatgtcaatgcctgcctcagtgtattttcttctggaggagagttttgtggatgccatctttccgttacggaaaaccagtggaggaatgggcagtttcttgccatgacccaccatcatttaaacaattggtgtttgagttcagaaataagctcata

SEQ ID NO: 1991 - DNA, 300 bp, Homo sapiens
cctgcctcagcttttcaagtagctaggactacaggtatactctaccacatgtaggctagattattttctgtagagaagaggtcttggtaagttgcctaggctggtctcaaactcctggcctcaagtgatcctcctgccttggccacccaaagtgctgggattttaggtgtgagctacagtgcttggcctgcataattttataacttatatattcaccattttacacattcagagaaaggagttgtaacaagacactttataatatagactaagtcattttattgacagtgtcatgaaagc

SEQ ID NO: 1992 - DNA, 300 bp, Homo sapiens
ctttgggatctttagatgaatggtatcatacagatgtgtattattgctaattctttgttctcaatcacttgttttcaaggacactaaaatccatgtagcccctaaaaaagataaataagggcaagtcacttttcttcctccagtcacagactaaagaaattatttcagataatatatagcccttcagccatgggagcaggaagtgtttactgctcaagtcagggtctcagttggtaaaataaacggaaacttctggtttagttttagggccttctttcaaataaaaacttcattttctct

SEQ ID NO: 1993 - DNA, 300 bp, Homo sapiens
  misc_feature 231: n = A,T,C or G
gagaggaagaagcagctgacataaacatgctaagagggaaacgtctaaaatgttaatgaatttatgaagattaaatttgggaaatcatgagaatttagaatttctcgaaacttcaaacatgaggtacctcagcactttcttaccagccttttaacatgggcctccactgggtgcatgtgagaaagactgggatcagagaaaagaacctgacaagctccaccccctgtgtcngaggtgcaggaatgcaaatgagactacagtattcaaatggtgctgctggagaacagacatgaaatccag

SEQ ID NO: 1994 - DNA, 300 bp, Homo sapiens
agagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttcatacagtc

SEQ ID NO: 1995 - DNA, 300 bp, Homo sapiens
ggttactcccaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtca

SEQ ID NO: 1996 - DNA, 104 bp, Homo sapiens
agtgcatccatgcgttttcacttgttcttaggctacttcatccaataatatatttgagtagttctgaacaggaacacaagtaaggagaattttttttttttttt

SEQ ID NO: 1997 - DNA, 300 bp, Homo sapiens
aaaaaaaggcggtggggggaaattatctccacaaaacaaaaagtccgacaataagcaataagctgtccagggctgatacagggcatgatgaggtcatcacagatccaggttctttctgtcttctgctctgcattcgtagcctgtggctttgtcattccctcatctggaaatggcggctgcagccccaggcacaatggcccgttgaggaagaagggggacgatgtgcagtgtcaggttattttatcaggaaagttcaaagcttctcagaaatcttctgttggaattctacctgggtgtcat

SEQ ID NO: 1998 - DNA, 300 bp, Homo sapiens
gacaaaagaaaagtatcatgtagatttcaactggagacagtgactttaatcttctaagttcagagacaaatttcactgcacttccttcagtgtttctgaagcgtgagcatatttgctaaacagttgcctatctcatcattgtgttaggctcctcatattttccttagggaaatgctatggagagttcaggtcagaatattgtgttgtaaatgttgccacagtaaatgcaaccccggcctttactgttggttcatctcagatgaatatgtttctaaagtcatgataaaccaacctcatgca

SEQ ID NO: 1999 - DNA, 300 bp, Homo sapiens
cccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccg

SEQ ID NO: 2000 - DNA, 300 bp, Homo sapiens
aagaggaaggtaagtagataaatagggaagtaaaccaggtttctaattcatgggtgaatccgatagaataggtatcagattagggattacaaaatgtatcatgggtactaaatatcagtacaaagcagccacaataatattgatttatggatttaagtaacccgaccaaaccttgatgtatctcatcatgttgaatttctgctccagataataaagtattgttcgatcttgtgcattggccttttatttttcagaatgattcaaaggatggctttggggattcactgtaagattttttgt

SEQ ID NO: 2001 - DNA, 300 bp, Homo sapiens
gtaccataagaaactttttctgaaaagtgtattagcaaaaagaggactcttcagctttctacttgtccgcgaactttgatgttctcctgaaacctccatgtgtgtcaagattgggaaatgggagaatcaagaatcagtaggtgttaggccaccgggattgcctgtatcaaaggaggagcacaaaaccaagctgttctcaatcaaaagtagatccaaaacaacgttttcacaaaagtccaaagaaaagtatcatttttcaggttttgcgaagaggaaattgtggcgaacagaaaattggag

SEQ ID NO: 2002 - DNA, 300 bp, Homo sapiens
ttcatttttaaaaagcttctccttattatgttgttgtttaacaacttaaacgctatctctagaccaggaataattatttgctatatattacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggcatagtttaaaagactgaaaa

SEQ ID NO: 2003 - DNA, 300 bp, Homo sapiens
acaaagcatatgtaccaacaatgcatgtttatattctgtgccatgccaggggcaaattcatagttggcctgtttccataagtgtggggatggaaccttgaaacacaggacatctcataatgctgtaagcagggaccattgaaattgattcctagagtcttgttctacaacttctttaaaaattactgatttgacagcagtatgtattcaacatttaagactttctgtctaattttgagcatacattcttgactaaggctagcaattagagattctttctttaatttatcagatatctatt

SEQ ID NO: 2004 - DNA, 300 bp, Homo sapiens
ctcttttcttgcttagtgatggcatccattttaaggaacaaacctggaaatgctgagcgaagaacacatacccttcatttccaaaggttcatttcccactcttactttagattgacaatgagttgtagttcaaaggctgccctgcagggaagctcatataccctataatttaaagggcctcagacgactcttgggaaacttggtaaaacattctatttagagacatgcctgctgatatgacatatatttttatagttatacccctttattgctgggacataaaacctgttttcactcaaa

SEQ ID NO: 2005 - DNA, 300 bp, Homo sapiens
gttgtaggcctccttcatctgttcattggctgtggcattaggccagctactctttgcacttctgtaaagtgagacggtcgatcttgtctgcctctctagaggatggctgcaggtgtcaaatggggtagttaggtgggagggcatttcacaaagttaaaaaatatgactttggaggcttgttatattgatgaggattataatccctgagaattcctggtatgaaaaagggaaaagaagataatttgtgaaagaaataagtgtccagttactagtctttgaaaagggtcagtctgtagctct

SEQ ID NO: 2006 - DNA, 300 bp, Homo sapiens
cgttcctcaaaggggccctggttgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggcccaggtgctatggttccactggggagagaccatttaattctccagatgctttactccctgattgtcttttagccattattcttttcgttttaagagacatggtct

SEQ ID NO: 2007 - DNA, 300 bp, Homo sapiens
atttgatttaaaaaaggagaaatgttcacactcagtctagaccacttaggtatgcagagttgcatcctgaaagcaattgctcacactttccttaatatactccctctccacctttgcaaaaccttgattggcatggagcctcgactgcttgcattgtatacacatgtaataagaaagcattaaatctcttggaaattaggaattgacaagataaatagataaggcataaagccaatttttcacacatgtccttaggctcttgtaaatgtgtgcctggtgctgctttgacttcccaggtcc

SEQ ID NO: 2008 - DNA, 300 bp, Homo sapiens
aacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagta

SEQ ID NO: 2009 - DNA, 300 bp, Homo sapiens
gctgtttgtgcaaataccttgaaaactttgaaacttgaccccggacaggcctggtgccaggtcctttccgacttttgtgttttctttccacctttcactactgactttgcctctttcctaccaggaatggacagggccgatggaggtgaagcggacagcagctgcactgccctgtagagattcccaggccctgcccacttcaaagcacacaagcccaccttttcctcatcacatttccctttgcaacccagggaggcactcaccaggatgctgccaagaaggaaacattttattaacatg

SEQ ID NO: 2010 - DNA, 300 bp, Homo sapiens
ataggataacaggaaaaccagggctgtagccacagcctccatattttcctaaaaattttagagtgtccctgctacttgacaaattgaaatactaagatttatacatttccatggaaaaagcaacagtgggaaagagagggcttcccagatttgtcttatagatctcatccttcagagactagccttctgttagaaatgctgtctccaagcacaagacagaataatcatataataccaatacacaccagttgctaaggtctccatccttttaagtatttgttactgagtgttttgcctgta

SEQ ID NO: 2011 - DNA, 300 bp, Homo sapiens
ctgccatgtctagtgggctcttctgggctccgtcctgagtttgtcacacctcctagggcccagaggagatgatgtggtatttctatcactaaaaggagttcaagaccagcttgagtaacatggtgaaaccctgtctccactaaaaatacaaaatttagccaggcatgatggcgcatgcctgtaatcccagctactcgggaggccgaggcaggagaatcatttcaacccaggaggtggaggttgcagtgacccgagatcgcgctactgcactccggcctgcgtgacagagcaagactccgt

SEQ ID NO: 2012 - DNA, 290 bp, Homo sapiens
ctgaagtgttcctcagatcttagtatttacatctaaactcatctggaaaaaaatcataggagggtaaagaatatgaacaaccttcactgaatttccatatcttatataataggaatgaatttaacatggacacaagtcccagtgatataaggaataggcaagagtagtaattcttcacatcttataaagtgtaagaactcacctttgggagaaaaatctggttctaaggcatgtggtaaagcctttgtttcttccactattggttatttttcttttttttttttgaaaca

SEQ ID NO: 2013 - DNA, 300 bp, Homo sapiens
accagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaact

SEQ ID NO: 2014 - DNA, 273 bp, Homo sapiens
  misc_feature 257, 260: n = A,T,C or G
ccttttttttttttttaaaaaaaaactatttaattttttaatttatttttggttgttttttgctcaatgaagtttcagcttctcaaccttctccccttcccagggctgtggacccagactggccttgagccacagtccctctttccctcctccccctcttccccctgcgggctcccgggtctgtccatttgttactgtgctgtgctggggattggcgccgaggtggcgtgagattccgcttgtgtagaccttgtgantangaagggcttccaa

SEQ ID NO: 2015 - DNA, 300 bp, Homo sapiens
gttcactgaggacagcaccacctcgggcctcactgaagaatctacagccttccccggcagcccagcctccacccaaacagggttacctgccacactcacaaccgcagacctcggtgaggaatcaactacctttcccagcagctcaggctcaactggaacaaaactctcacctgcccgctccaccacctctggcctcgttggagaatccacaccctcacgcctcagtccaagctcaaccgaaacaacaactttacccggcagtcccacaacaccaagcctcagtgagaaatcaaccacctt

SEQ ID NO: 2016 - DNA, 300 bp, Homo sapiens
gctggtttttctccttaagtgacaggccaggaaattttattagtcccttatgagtgtaaattagtacttaatcctttagtcttaataggcagtgatgggatattacctgagagaaactttccaaaatgagagtgctctgccatttcgttcattttgtgtgtggttcatcatgtccccaaagttcctgcatccactctatcaggaggcagaaagggagcatctgagacctaatactgcctgcatgcagaagtggtcctgctgggtttgtttctgtagtgatgacactttgaatgttttttc

SEQ ID NO: 2017 - DNA, 300 bp, Homo sapiens
cccaggctggtctcaaactcctgggcttaagcagtcttcccaccttggcctcccaaagtgctaggattacagacatgagctgttgcgcctggcctgaacatattatcttcttttgcttttcttctctactctccaaccctccctctgtcctgttgggctgggaggcaggacattggtggtttaatcatggactctgaagagtcactgctagctgagtttgaatcccagcaccctaattacataggtgcccttgggcaagatattttacttctctgagcttcagctttcttacctataaag

SEQ ID NO: 2018 - DNA, 300 bp, Homo sapiens
atgcagtgtaactggcaggaggggagtgagaactacttgggtagatgatcaggagatactctgcaagaggaaacatacagaaggagcctgacatgagaaaactggggcagcagttttccaggaagagggaccagcacaggtccaagttgaaactcagaatggaattttaggaaattatattcttcatgatggttagatcctgtgggctatcatcactgcagttcaacaatgtggtgcctagtaggaagagttctcccaggaaccctccacgtgtgctatgggatttctgagaaaaccagt

SEQ ID NO: 2019 - DNA, 300 bp, Homo sapiens
gcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggagggtgaggaacctggggtaagccacaggggtgtggaggggctgtccccgcgtccgctgagccctgctctgccccagccatcgagactttgctgtgctacctggactgcacccacac

SEQ ID NO: 2020 - DNA, 300 bp, Homo sapiens
cttgaagtagaattttttttcattccttacacttctcagtgagtggtaactgtagtttttgctatcatttttcattttcgtttttgcagttgaacatacttttttcactcagagagttggagggacttgcccaagactgcccaatggcaatgagatttcaacctcaaatcaatgttctttttaatgcaagatgataaagagtaggatttagcctaatttaggatagaataaagccaaataatttaggataggttctttggtgttcatgggtgtaatctaatgcccatgatgcaagtggca

SEQ ID NO: 2021 - DNA, 300 bp, Homo sapiens
taaagttacacttaaacagtgatacatagattgccagataaattttggaagggctttgattaattaggcttcagggaaattgtgaataaaaacataaatcttgcaatagggtaggggaaagaaaataatcccactcctgaagtgatgaaatgaagagtggctagagaggagaaaagaaccaggacaggtgatatattagcaactgtcagtgtgaataatccagggtatgacatttctaatttagcctcacatttaaggtcatttctgattcaacctcaaatgatccttctagcctactgc

SEQ ID NO: 2022 - DNA, 300 bp, Homo sapiens
cttaggggaaggaaatgaaggtcagctttgggtatactagtgtaaggtgcccatgagacattcagataaaaaccagccaccaggcatatggagataacagggctgaacttaggagaaaagcctgggttgaaacagagattcggatatcctcagtatgaaggtgatagttgaaactggggactggatgaccgaaagagatcacccagaacaccagtacagagaggagagagctgaggatggaattttgggacataggtgcttctacagcacatggcaccaacctctaataatcacaccact

SEQ ID NO: 2023 - DNA, 300 bp, Homo sapiens
ggagaccaggtgggagccactcacagaaatcagtaacatgaaaaccacagccacaaaaccaccactggcactcaacgcccatcatcacgggcaggacagttctacatcatctccctccggcctgaggcttcccaggcagtgtgggaaggggggctgcatctcctggctggggttcacacctaagtttcctgaggtccaagctgacctggaaagtttctagtgagtggcacatcctgtcccaacaaggggaacacgggcaggatgtgcctgcaccctgggaaaagtgttgtctccgcacac

SEQ ID NO: 2024 - DNA, 300 bp, Homo sapiens
ggagaccaggtgggagccactcacagaaatcagtaacatgaaaaccacagccacaaaaccaccactgtcactcaacgcccatcatcacgggcaggacagttctacatcatctccctccggcctgaggcttcccaggcagtgtgggaaggggggctgcatctcctggctggggttcacacctaagtttcctgaggtccaagctgacctggaaagtttctagtgagtggcacatcctgtcccaacaaggggaacacgggcaggatgtgcctgcaccctgggaaaagtgttgtctccgcacac

SEQ ID NO: 2025 - DNA, 300 bp, Homo sapiens
caaaggtgatctcaggaaaggtctaagctagtttacagtatgcccatttcctgtgtaaaccatttaatttaaatgactctgcttgtctcactgttatgataaatttgtgtggtagatcgcagcctgttagctattactggaagttttctgcttttattacaggcctctcaaataggtaggttttaacattttattggaccccctgccccttcccaatttcaactattaaatccttaaatttgttgttttggttatgcagaagttagttatcaggttatatggttcccaatgagtgaggaa

SEQ ID NO: 2026 - DNA, 300 bp, Homo sapiens
gagatccaagtggtttagaaggggatgattgctggtgaaggttctgaacatggtgacaggtgggaggctgagcacacactcgtacaccgctggcaggaagagaaatgacttttctggactacaatttggagataacacaaacattaaaaagaagaaaaaattgtatccctttttgactaagcaattctaggattgttatttttttctcctgaggaaactagcatggatgttcacattcaggtgtggggatgtttatcaatttgctattttagaaaagagaaaaaaagtttagcatgtcac

SEQ ID NO: 2027 - DNA, 300 bp, Homo sapiens
ctctgcccaatctatttccggctggatgtggagtctgaaggcctggcacccactctggctctgtgatttaccagctgtgagccttggggttgctgcttactctcttggtgattctttactcatttctatgatggggtagaggataatgcctatgcttacaaagtggctgtgggaagtaaaccggatgggataagaatggcttgctgtggaccacaggcaccgcaggataaccattcctcagaactcctcgtactgctctagtgcttggaggtccgtgtattacctcagctattccaaccg

SEQ ID NO: 2028 - DNA, 300 bp, Homo sapiens
atacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggc

SEQ ID NO: 2029 - DNA, 300 bp, Homo sapiens
ctttaggttcttgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcc

SEQ ID NO: 2030 - DNA, 300 bp, Homo sapiens
ctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcat

SEQ ID NO: 2031 - DNA, 300 bp, Homo sapiens
aatatatcacatcatgtaataagcctctcagagatgtagcattgagcagattaaggcctgatttatagaaaaattccaccctggccatgtgggcctgaaactctggagggctttaacaatgtcttgaggtcattgtcatttaaagagatgactcattggttttatttagtagaaataaatactaaataaataatctccacagattatccagaggggtaagttgaaggatgttgacagataactcagtaaattgcgtctcaaatattaataagtttattctatgccagcaccaaaaatatt

SEQ ID NO: 2032 - DNA, 300 bp, Homo sapiens
agtgattaagtctcactagaataggcttttctaaattgttttatctcatcctcattagaacttcaccacatgtgggaaatcatgtggcaaaactgtctctcttaaaaaaaaagtcaccaaggaaacctccttctgcaatttaagaaataaaatcccagtgacattgatttggatgctccaaacatgtccataatggaagagcttttccaggttttggtttgggccccccagaccaaagctttgacacataatacaagctctgtaagtctgttttcctgtctgtaatttgggattgtcatc

SEQ ID NO: 2033 - DNA, 300 bp, Homo sapiens
gttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctata

SEQ ID NO: 2034 - DNA, 300 bp, Homo sapiens; identical to SEQ ID NO: 146

SEQ ID NO: 2035 - DNA, 300 bp, Homo sapiens
ggccaagcatcactgcacgtgccagctccccaaacggctggtaagggggcctggatacttaactgtaacttgcaaatcgtatccctagcgggcccaacacaaatcctggagaatcagagctggggtggccttggaaactggcaagtccagcttcatcttcacagggctagggaaacagggcccagggaggtcgccctgccagggccacacagggaggaggtgtgtggctccatgtggcctcaggcctgaattctattattattattattattatttttgagatggagtcttgctctgtca

SEQ ID NO: 2036 - DNA, 300 bp, Homo sapiens
gggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacat

SEQ ID NO: 2037 - DNA, 300 bp, Homo sapiens
tgtaggggtgtgtagggtgctggggattaagatctgctgagtaggtgcttaccagagttatactgaaggacctgaagacagatcatcttcacataatcagcatgacccataatctgtgatgtcactgagcttcttttatttctgtagtcaaggaatgtgcacaagtaatgcaaatataattacttttagtcctgaggattagggaacttgggggatgttcacattacctgatgatgtcaatattgtgttatgtttaattttttttaaaaaagatgcttatttattactgaaataatctaa

SEQ ID NO: 2038 - DNA, 300 bp, Homo sapiens
aattgataataattagacaaactgaactaaatttttttaacagatacctgagtgccaagcttaacagatacctgagtgccaagcataataaacaggaaatatacacttcaaaaaagaaaaagaaaaatgaatgcatacttatcaaatacttgctgtaagagcattaagtactttacataagtcaaatcatttaatcctcatgaccctaagaagttattttaagatcttttgagaatgagaaaaaaggatgagtaagggtaggtgatctatgtaaaacaaataaattctagtaactggcaa

SEQ ID NO: 2039 - DNA, 300 bp, Homo sapiens
gccacggcgctcggcctgaattttttttaatacttaatttagatcaataacttcgactggtactgaaatttgcactcactttcagcttacagtttgggtaggactgctagacccagttcttttgtcatctcattcttagagagctcttgaaaaccaaagtatttaaaaccctgcaagtttctgtgcagatgagtgcaaatttccacccagcattggttcctgagtaattagaggaaggaagccatgcaaaagctgctattgcccaggctccagaaaaacatcatgtaaggtttgattcca

SEQ ID NO: 2040 - DNA, 300 bp, Homo sapiens
ttatgcttcatgttcattgttttaccaattttagaataccccaatggggtaggtacttttatctctctttttacaattggggagctcgaggctcagtttggtcatgttgtaagtccctgtggagttgggctccaacccaggtcagtctgtttcccaaaacccttctgtttgactttgccgctgaagaagatacaatgagatgaagagtcttgggcatgatggcacacaggtcatcaggaagaaggccatcaggaagttggactagaggtgggaggggagaaggaattaggggatttggaa

SEQ ID NO: 2041 - DNA, 289 bp, Homo sapiens
  misc_feature 232, 255, 278, 280: n = A,T,C or G
agtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttangacttggtgttaaaggagccagnggtctctctgggtgggtactatncngagttattg

SEQ ID NO: 2042 - DNA, 300 bp, Homo sapiens
cccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgt

SEQ ID NO: 2043 - DNA, 300 bp, Homo sapiens
aagtcgcaaggcataatttgttgcctaatggatttgcggctgctgatgatgattgctgtagttgttgagcaattttgtttttttttaaagcagggtgacctgaaaatgctttgtagaggacatgggtttgggccgccccttgaaatgctggggaggatttgactcctttactgtcgaggagggggaagggcattgccacagttgggacagtggcacaaactcaaaaggaaggaagaactaggtaatttgaaaaacagaataaaccaatttggctggaaagtgaggtcttgtgagaaagca

SEQ ID NO: 2044 - DNA, 300 bp, Homo sapiens
gacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgg

SEQ ID NO: 2045 - DNA, 300 bp, Homo sapiens
gtgtgtgtgtgtgtgtgtgtagaggagagaaagagaccattatcatatgagtgtgttggggctgctgagagggtttcgtttacaagtgaccttgagtgtatttcatctctggaatgcatggtccctgcgctcaagctacacaatctgattagtgaagtattactaatacactagaaaaatatacatagtaattaccaaatgactgacacaattttatagggggttcagagaaacatctgtgaatgggtaataatgaaaaaagaaaagtttttctctttgttttagtctgacccttttaac

SEQ ID NO: 2046 - DNA, 148 bp, Homo sapiens
cttcctgtgccaggggaccgtggagaaagtgtcaggggccgctcactgcagcagcctgctctgctgccttccctggcagtgttctgggggtggattccctacacctagatgttcaaggccttacttttcctcccacaaaggattcgca

SEQ ID NO: 2047 - DNA, 300 bp, Homo sapiens
cagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgatgcttcct

SEQ ID NO: 2048 - DNA, 300 bp, Homo sapiens
gttgcaggatccgttacaagaattcagagttttggcatctcccctttgtatgttgtaggagaaggtttggcattgaaaatgtgctgttgttccaaagaaaaattagcagaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaa

SEQ ID NO: 2049 - DNA, 300 bp, Homo sapiens
ccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttaca

SEQ ID NO: 2050 - DNA, 300 bp, Homo sapiens
cagagtcaacatggagcatctcactgtgaaatgatccatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatg

SEQ ID NO: 2051 - DNA, 300 bp, Homo sapiens
gtcggtgttacacacattcacacttgcaggcgtgcaggtcggtggtgttacacacattcacactgttgcaggcgtgcaggtccgtggtgttacacacatgctgttgcaggcgtgcaggtcggtggtgttacattcacactgttgcaggtgtgcaggttggtgttacacacattcacactgttgcaggcttgcaggtcggtggtgttacacacattcacacttgcaggcgtgcaggtcagtggtgttacacacattcatgctgttgcaggcatgcaggtcggtagtgttacacattcatgc

SEQ ID NO: 2052 - DNA, 300 bp, Homo sapiens
attttttttgttcgaatgagccttaatctcctactagtgattttttgtttgaaggagccttgatcttggaccaccgaaaaggtaaaaccagtggcaagcttgaatgcttgttttatggtagacttagatacgagaacgggtaaagggtactggataaacttgggatataagattgtcttcttttatgcataccactcataccactggtgggaaatttcatttggaattactccctagggccatggagtcttcctgcatatgctaataatgtaagttcccattacctttggtaataagaaa

SEQ ID NO: 2053 - DNA, 215 bp, Homo sapiens
acctggtgtcctcgtgcttcttgggcaggccagctccatgcagtgcagtgcccctgaagggaatggggccaggagaagacataacagggcatgaggatcttctctgtgccaagaatcatgctaggtaacccccctgagatttctcatcctcttgagaatcctgtgagatgatcctgctgcccttatttttccagatggaaaaacggattacccag

SEQ ID NO: 2054 - DNA, 300 bp, Homo sapiens
cacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccc

SEQ ID NO: 2055 - DNA, 300 bp, Homo sapiens
ttgcacaggaggagaattagcacgatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaacaaaaactggtcatccgtccaattgttgtttcacttattttgaattatagtgcaattttgtggagggtgaaat

SEQ ID NO: 2056 - DNA, 300 bp, Homo sapiens
agggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaat

SEQ ID NO: 2057 - DNA, 300 bp, Homo sapiens
ctctcactagccctgggcacttcccactgcctttgtggacttctgtttgctcttctgtagaatgggataacagtgccagtcctgcttactatttagggttatgtgatgcttgcagatgtacagggaaagcaccgctgatgggagctgctgaagtttctaggggaggtgaaggtggcgcctcctcccctggtctaagtggtagatggtgcagggagaggagaatttcattctgtggcagcagctgatagattccaggtctttaatactacctgggaaaccttaacaaagcagtcagtcacc

SEQ ID NO: 2058 - DNA, 299 bp, Homo sapiens
  misc_feature 157, 161, 176, 186, 191, 193, 197, 200, 202, 207, 210, 211,213, 216, 222, 224, 228, 231, 239, 240, 243, 246, 250, 254,258, 265, 269, 272, 274, 276, 279, 280, 286, 287: n = A,T,C or G
aaacagtctatacatgttcagtacagatgcagccatccattttcttgtccaaatattttttatctccagttggttgaatccattgatgcagaaaccacggatacggagagctgactctgtgtgtgtgtgtgtatactcaccaattctttatttattnaacngatatttattgaatntttactatgngggangnatanttnangagcntgnntntancttagncntcanccntggcttanngcnccnggantctnatgnagatccnagancgntngnccnnatcacnntgctttgcgcct

SEQ ID NO: 2059 - DNA, 300 bp, Homo sapiens
tttttagttttccaaatctgaattgactctttttttctttcttctagagccagaaacttttgataccatttttcatgctgttgaacttcatcttgtgtttttccaggaaggtgttctagaacttcttccataaatgttggcttccctttatgtttgtttctcacctttacaaagttctggtgatcataatcatcccaggcaccttgtcgccctcctgtttgctgaaggaatttttcaaaatctagtacctcttctggaagagtacttggtgttactttgtctacaggaactttgcttgag

SEQ ID NO: 2060 - DNA, 300 bp, Homo sapiens
tggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagc

SEQ ID NO: 2061 - DNA, 300 bp, Homo sapiens
ggaaggaaggggcaggaccctccgacggggcagcagtgggccaggtgtcccccctgcacagtgtttacaccctgggacctgccgcaaggcatggctttcagaagagcctccccccaagaaatgctgcagacaggacggggcttctagagaccttggcttctacccaggaaggctgatctattcttcgactgttgcatcagcttcctcaacctctgcaggttcaggctgcgagccctagggagcatcactcaaagcaccctgttggccacttaggatcaggagggcctcggctcacccaag

SEQ ID NO: 2062 - DNA, 290 bp, Homo sapiens
  misc_feature 106, 110, 111, 113, 128, 135, 142, 149, 151, 152, 158, 161,163, 164, 175, 179, 180, 188, 190, 196, 199, 200, 202, 204,209, 214, 215, 218, 242, 243, 247, 248, 249, 253, 254, 268,274, 275, 276, 282: n = A,T,C or G
gagaccaacctagcctacatggtgaaaccccgtctctactaaaaataaggatattagccggttgtgttggcacgcacctgtagtcccagctacttgggagcctgangcannanaatcgcttgaacctntgaagtngaggttnatagagncnnaaccgngcnanngtactccagcntttnngacattancnagattncgnntnanaaatnaaaannccnccctttaaattctgtttttttttnncttnnnggtnntttttgtggagtanattttnnnttttgnttctatta

SEQ ID NO: 2063 - DNA, 300 bp, Homo sapiens; identical to SEQ ID NO: 1144

SEQ ID NO: 2064 - DNA, 300 bp, Homo sapiens
  misc_feature 267, 276, 281, 286, 296, 299, 300: n = A,T,C or G
tgtagagacgaggttttgccatgtttcccaggctggtctcgaacttctgggctcaagcaatccacccaccttggtctcccaaaatgctggcattataggtgtgagttaccactctgggccaggattagaattcttggtctcttaacctctcgttcagttttttcctcgtcgactcacatgccctccaaatgaataccgaagttagattttgcatattaaattgaaagaaagttaaaagccttactactttctacttcagtgtagggnggatatgcnaaggnttccnagtccaaatngann

SEQ ID NO: 2065 - DNA, 300 bp, Homo sapiens
caaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctg

SEQ ID NO: 2066 - DNA, 300 bp, Homo sapiens
agatttcagtaaagctcgttcgttttgtttggttttctttttacctagttgctatagtggctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttcct

SEQ ID NO: 2067 - DNA, 300 bp, Homo sapiens
ctggcctctctgaagactaagggcctggtgctgttttggttgtaaactgtgttccattaagtggtacctcaaatgaaccggacactaaatactcctccattattatagattctgcattggatgtcacagacattgatctgtgggaaatactgtgtgctactcctgagaaaaccctatgagaaattttaaacttttttgctgacaactatttatgactttattcaacaaagtgaaacaacatttggacgactgttgcctgttcttgaatgtcattcatggtcagccacacaaaaacactgc

SEQ ID NO: 2068 - DNA, 300 bp, Homo sapiens
tgcttgttcgtttctgtgtacttgcttagtggactgtagcaacacactcagcttctccagtgtcaacccagattggctttcccactctacagtttctgtaggatgcatgttttcaccattatcaggcttctgcagtgctcagagggcagcaatacccagcaaccagtgacccgaggccagcaacttcttttacttccccctcagttggatttgtaacagagtatctttggtgggacacttctgtgtgaagagattttactagcaccctaaagaatggatttctggcaagttccacaaggt

SEQ ID NO: 2069 - DNA, 300 bp, Homo sapiens
gctgctgggcctggaagtccaggtggggccactcgctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccggggaac

SEQ ID NO: 2070 - DNA, 300 bp, Homo sapiens
attctcccaaaaaggttcatcccgagaacactgaagaataatttttgggaatgttaatgatgtgccacaaaaattagtattttatgatcaaatgaatttgctttataatattttatctaaatattcatgctcctgaagactcacaaaataaaggaaactttatccagctttttccagaatttacttgcacatagactccatttatatagcatgcctattgaactctgtaaatagtgcagttcaggaaagatagcagtgtgggaaatgtcactctaatggtcatatacgtttatcccatgg

SEQ ID NO: 2071 - DNA, 300 bp, Homo sapiens
gaatcttccttaaagtccagagtctcccggaacatggagactgtccttcccaagccttctcgcggggagggaattccttctttctgccgcctgttacatccctgtgtgagaaggtctgtgagctgagcccacatcactcgttctgctgcccaggtgtgcttccatcttcactgtggaaaagtcattttgaactccccggagactgcaaattaagtaatcaaggacagatgggactgggttgaccattccaaggagtacagttacttgaagaatctggaagcaataccgagcacatttgtt

SEQ ID NO: 2072 - DNA, 300 bp, Homo sapiens
ctgaataacaacctaactactacccctcaacctcacccccaccccaggaaaagtaagtctttttctaacgatccaccagattagggttacatttaacagtaactagaaaggttaattttaaccttaatcagaaagattaatttctgtcctttcagtcttctttctgtgctcataaataagcattgtttcttttaatcaacctgggcagtatctttctcattttaacagttgtctagagctcagttgtcccagcatttatttcactggtccctgatggatggagggtggtgttgcttcagt

SEQ ID NO: 2073 - DNA, 300 bp, Homo sapiens
gtcatgcaggaaaacatggagagagtttttattccagcttcaaataaggaatcacttagtaaagttcattctttctagtacctacattctccaagtaatctgctcttttcagtgcctgaagtaaatcttggttaacagctgaggagtagtattactgcaagtgttcgtcacttgttgctgtatacatctgtcagtcttatcaaggaaatgtggaatggtgaatctgctttacaatgagtatgcctagaactcagaatcttattttatttaaaacattgatctcgttttattttattgaga

SEQ ID NO: 2074 - DNA, 300 bp, Homo sapiens
gcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaatgcagagtcagagctatttgtacttcattactattcgccttggaaataataatgaagtacaaatagttggctttctttttgcaaaaataattaaagtttttgtatgttgca

SEQ ID NO: 2075 - DNA, 300 bp, Homo sapiens
ctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatct

SEQ ID NO: 2076 - DNA, 300 bp, Homo sapiens
atcccttcaagacaatgacttgtcttcatagctcatcagtgagttcacagtctattgttcctttttatttggccagtgtaaaatagcagttattgcaagaacaaagggattaaagcatctgaagacctttgtttgagttctgccactttagtagtgatacatctcagagatcaacctctttaatgcctgtctttgttccctggaacagagtttgtgtttccttttgtgttacaacagaactctggtcattcctaccatagcacttttgcacactatagattgcaacccacagtattttac

SEQ ID NO: 2077 - DNA, 300 bp, Homo sapiens
aggtaatgaggacccctgctagcgaagcagtggcagaaatggagaaaagagttgggtgcagggaatgtcagtgatgtaaaagtcaaagacttgactgctgaaggaatgtagggaatcagtgcccttggaatgtcaatggcctggtctacattgagaatgaagactgagaaagggcttcctgagggacagagagctgcaggtgatcaaggacactcaatgggtctctgagggaaaagaagaccaaagaattagggagtagctagcagaaaatggaggcatgacactaaacacagactgaaa

SEQ ID NO: 2078 - DNA, 300 bp, Homo sapiens
aatggggggtgttcttcatagtggatttctttttttaaacataccatctttgtgtatatacatttctctggaaatgtttgtgaaaaggtaaagataacttccttagtgtaattgtgttgaagtggaatgtttctagtgtttgtgaagatatcaattgctggctgatattttaagctggatgaaaaatgtgggtgaagtaatcttaaagggtgatagatttgatatgagaaatttaaagtaatgtgctcagtgcgtagtggtgataaaagaatgtagcctacttgttttccatagactata

SEQ ID NO: 2079 - DNA, 300 bp, Homo sapiens
gggaagaggtggttctatctgaggacagtgtgtgacttccctattgatgggctccctgccatcagcacagatgggcatgttgtgtgcccccaggcgactatctgtgcatcagatatggttgctgaagtcacaattcactgatggaaaagttgaaacagctggctgtcctgaaacaggagatgtgccattgatagatctactggatccagagtgatttggccaaagttaatcatttctttcctgacttgaaaaattgttcattatgtatgtgaagttgccttagaatagagcatcatctta

SEQ ID NO: 2080 - DNA, 300 bp, Homo sapiens
tatcacagtttgtaaacgggtgtttttgtccttgttattgaagtatacaactctgcttagccaaacataccaagcaacagacagaagcgtcacttggagagaagaagaaagggttaactggcagagctactgtaaaagaaggatagaggagggtaagtttgaaagtggccatgggcaagaattttctccagatagctcttgattataatctctctcacctggattatttcccatctcctgacagtttgttctcacataactatcagcagtcctctcaacacagaatcagaccatgtctct

SEQ ID NO: 2081 - DNA, 300 bp, Homo sapiens
tgaaaatacttatctatagaaacagtgttgtaaataagagagtctcagattatcaaatgaaacttatttaaatccatgtaactgaactaataataccagctgcagttttatcctggctgtaaggactaccatgatgggaaaaaataagaggaaaccttaccctcccccacattcccacatgaccagcagcataagggctccaggttaccacagtatccatcatttgtcttatggccacccaagtacacctgtttacatgacttactgggcctgtgtagaaattgcagtttgtgataggat

SEQ ID NO: 2082 - DNA, 300 bp, Homo sapiens
cagttttgatgagcatgatgaaggcagtatcatttttgtgcttgatacagtggccggaaagttcaggtctgggtggcatcctgagaaagggagcaaggcagtgtggtgatgccaggtgcaagaagttgggggtgtccagagggaagtgagatgctctgcaaaaaagtcagagggcatctcagaaaatagagccacttttcttgatttcccagaaatagtcactcactcaaagcccttgtatgtgcagcagatttcactgatgctttaaggaggagtttatgctgcaaaaaagcaagctat

SEQ ID NO: 2083 - DNA, 230 bp, Homo sapiens
  misc_feature 86: n = A,T,C or G
ctcagattaagggtttgaaaaacaaaccgaaaaagatgggccacataaagccagacttgattgacgttgacttaatcagagggtcnacatttgccaaagcaaaacctgaaattccatggacatctctgactcggaaggggcttgttcgagttgtattttttccattgttcagcaattggtggattcaggttacctctttaagaatctttgtttggctgttactactttat

SEQ ID NO: 2084 - DNA, 300 bp, Homo sapiens
gaattgttagagaaggggattctgattatttaacaacagagaaaggcttctgggttatctattagagatgaaaggattaaagagaaactatagatcagctagtccttatggagagaggaatataaaggaaagagaaaaaataggactgtggcttagtttgggctctgttgactgactataaaagtgagccaatcacatagtaattttctgacaaaatagagtttaggttaaggcttaggtcaaggctgtactttgtgttaatagtattataatgagcaaattaatagaaacaagaaaaca

SEQ ID NO: 2085 - DNA, 300 bp, Homo sapiens
gggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacag

SEQ ID NO: 2086 - DNA, 300 bp, Homo sapiens
gctgggtgtggtggcttatgcctgtaatccaaacactttgggaggccaagaagggaggatcacttgagcccaagaatttgagaccagcctgggtaacttagtgagaccctgtttctaaaaataaatagacagatgatagatagtcagatagagagagagagagagatgatatagatatagatagatagatagaatgttctctaccccaagggtggagaaagacttgagcaaagacacagaggccacatggattaaaaggaggaggagaagccctgtgtttgcagggatgaatggcctatg

SEQ ID NO: 2087 - DNA, 300 bp, Homo sapiens
cggcggccgggggtaacgcacagagagccagccgggcgcctatctgggccgtaccgtgctggtggctggtgcaccggcctgcgccatggccaggcctttttctctagtcaggaccgtccggatggggccttagggccccgccccgtctagcctggcccggcctgcgcgagccccgcaagctctgcaggctggctagcgggcagaccccagccccacgtcctgctacccacctacgaaggatccggggatgggcagcgccacccggcccgctccagagtcagcatgggtctccgtgaggcc

SEQ ID NO: 2088 - DNA, 300 bp, Homo sapiens
cgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggct

SEQ ID NO: 2089 - DNA, 300 bp, Homo sapiens
aatcgggcacgaggccagcttgacctggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgaggtgcgtgaagtgggcaggccctgtcagtctcgcgttcttcttggaagccgagacgcgggccaccctcggtc

SEQ ID NO: 2090 - DNA, 300 bp, Homo sapiens
cagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaag

SEQ ID NO: 2091 - DNA, 300 bp, Homo sapiens
ggccgttgggcgagatgaagctacactgtgaggtggaggtgatcagccggcacttgcccgctttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggatt

SEQ ID NO: 2092 - DNA, 300 bp, Homo sapiens
aaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatata

SEQ ID NO: 2093 - DNA, 300 bp, Homo sapiens
atcacatctctcaagttttaaaatgggtttttttgttgttgttgatgggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggagggcggagtctgcttagttctgaggactgcgtgggtccgcgcagagagctcctgctag

SEQ ID NO: 2094 - DNA, 300 bp, Homo sapiens
gagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggag

SEQ ID NO: 2095 - DNA, 300 bp, Homo sapiens
ggagcgtggagacagggtaggggcagatggctctggactctggacctaatcctgagggccaatgaagggggttaagcctgggagtgagcagatcagacgtgcttttttagcaagatcattctggatctctgtggaaactgccttgtggtgatgagagcaaaccctgagaccactggggtccctgagctgataagcaccaaggcagtgggccggagagaggagagatgtttaagaggtgtcctgggttgggtgcggtggctcacgcctgtgatcccagcactttgggaggccgaggcaggt

SEQ ID NO: 2096 - DNA, 300 bp, Homo sapiens
cttctgtgtgtgttccctcaccttccatttaagtttcagcctttatctatgtccttttgggtgtctgccatgctgatgatagagctcatcagtctttgataaatactgttaggtccttaagtgattttctgtgaaatcttacgcataggatttctgtggtcagggtttgacgtctgatcttgttcgtcagctccccttgctcaagaatgcaagtgcattacctcttaaattttaaaagctggtaaacttaataggaagtgcttctttatattgcaggtgctaaacttaaggagcccatta

SEQ ID NO: 2097 - DNA, 300 bp, Homo sapiens
gtcatgcccggctaatttttgtatttttgtagatacagggtttcaccatgttggccaggctggtcttgaactcctgacctcaggtgatcacccgcctcggcctcccaaagtgctgggattacaggcgtgagccactgtgacgggccttacatgcaatttttatttatagccagtattagagaattactaggaaatttcatttttatatttagtgggagaaagccatctacagcatgtcttcaagcatggactatctgtaacatacagtgtgcttgcttttgaattgttttagtgttaaat

SEQ ID NO: 2098 - DNA, 300 bp, Homo sapiens
aggagatagggacagagcatcctaagattcaggagagcattctagtcacagggagcagtgaattcagaggccccaaggtaggagggagtttggtctgtccaaggaaagcaagaaggtcagtgcagctgaggcagagtaagtaggaaggagagaggtcagggctgagatcagggaggtagtctgaggcccctctgtgggggacctgataaatgtgtttgaattcattttgaagtgtaataggtccatattagaagcagaaactagaaaaggagttaggctgataaacatagggatcataac

SEQ ID NO: 2099 - DNA, 300 bp, Homo sapiens
cctagttatgctataatcaagcaggaaatgtttatggaatggaaagattaaggaggggggtatgttcttattttagcaataaaacgaataccagaagctttaacattcaccagtacaaataaatagtttcaatggaataggtcgaaagtaaagggacatcactagagtaaatgctagaccttccctctccttttatttttagcaacagcaaagcagaaactaagatctacaagtgatcaaagagggtgatccattcagtttctgtgtagacaggaataataataataccttttacatatt

SEQ ID NO: 2100 - DNA, 300 bp, Homo sapiens
gtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaat

SEQ ID NO: 2101 - DNA, 300 bp, Homo sapiens
gctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttcc

SEQ ID NO: 2102 - DNA, 300 bp, Homo sapiens
  misc_feature 142, 246, 252, 259: n = A,T,C or G
gagccaccatgcctggcccatcgtttcatttgatccttgcaacaccctatgagaatatttagatagaacgatttcacagataatccatagtgatactcagctaacgggtggtactgccaagacttgaacccaccattcttgnaacttccttgatatctctaattatggtttaggtctgccagtttggtatggagcagaaaagaagatgtaagctttctggaggtagtagctgctacaggcatacantatatnatctcangcaatagcaagtccaagtaggactgatacagtatacacaaa

SEQ ID NO: 2103 - DNA, 300 bp, Homo sapiens
cactacatgaagtccggggtttggttaaaatatctgtcttatttatgaaaggctgaaaagagaaaagagctattcactacccgagactataagttttagctgataaaaacacagcctcatcaatagctattgaatgaagccacttgctgagtcagtaactgaatgtctatgtatgatatttccagtatcatgattaaaatggagccccgaaatgtcattataaggcctagttgtggactgggggcccagatggccaagtgggagcaactctgaaaccattaaataggaggagagagagaa

SEQ ID NO: 2104 - DNA, 300 bp, Homo sapiens
catagacaaactacgtatcaagcactgtgccagacactgagtacactatggtgaataataaaagtctaggggtctcagccagtataattcataatccagtgagagacaaaaacatgtacacaggctgtgatgagtactgtacattggcaaatgtgccatgctactaggggatggatgagatcacagtttaagcttgggaagaatgagtgagacttggcaaagaaggggggacaagaatattatcataagagtgaagaaagttgggggacctcaagtgtaagagaagagaagaacttgctg

SEQ ID NO: 2105 - DNA, 300 bp, Homo sapiens
atgactaccattatttttcttccttctattggtttaaaatatacttatctcttccactgtatgttcctgtgttttattgcatgggaaaaggtaataagtgtcatcaataacagccatcttaacatgctgcaggaactgtcaagtaacagtgattattgtaaaaaacgagctttctaatttccttgtcgcttacagagtaatctaagtgaaaatttccaacgtcctatctttacaaagaaacaaatacatttattttttcctctaatggaagaacttatgtacatgattcctacttgatgg

SEQ ID NO: 2106 - DNA, 300 bp, Homo sapiens
cccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcgccctgaaaggcaagctaacgctaacttcccaggtgacagtagcaggaacaaggaagggtaatgtttccatgacagacacttgcttcccttgggacaagtcccagaagaactacctgaagcaccaaagctccccaccccagcctggtggca

SEQ ID NO: 2107 - DNA, 300 bp, Homo sapiens
acttttttaacgaatgggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtgatccttag

SEQ ID NO: 2108 - DNA, 298 bp, Homo sapiens
  misc_feature 10, 28: n = A,T,C or G
ttggaaatgnttctagctccggacattngacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttctttccgtcaaaattggatttgtaattaaattgtaagcctcgtaggatgtatgttggagattttaagtctttccttcggttctatgcaaaaaa

SEQ ID NO: 2109 - DNA, 300 bp, Homo sapiens; identical to SEQ ID NO: 178

SEQ ID NO: 2110 - DNA, 300 bp, Homo sapiens
ttttagtagagccaccacacccaggatctttctttttaaagaaagattcttctgttggagcttgtgagctgaaggacttcaggaaaacccacggaatcccctcaaattgtatacagatttttgtgatgtttgtgtctcacgtgtccgtgtgaagagaccaccaaacaggctttgtgtgacagggcaagggtagaaatcatgttccagaactcagtgagagttgtaggcatgaaagaggagccttctcaacaggagctgtggccaaacaagaaacaaggcaggtaagaagtttgatagctg

SEQ ID NO: 2111 - DNA, 300 bp, Homo sapiens
cagcatccacatgacaggcggcgccgaagggatcctgcccctgagctttcatgagctgttgaaccatctggaattcacaggcctgtcatgagagacacgatgagaagtccttaaaggtagatcactgattcacaggggagcaggcggaggcaagggtgagtcagtgcttggaactcagtcatccagatttggctctggaaacttctgaagctgtagcctttggggatccctgactgcgagtacaggaagccaacgctatgtggtcttctggaaactcattatctttttcactggtgctat

SEQ ID NO: 2112 - DNA, 300 bp, Homo sapiens
cagcggcgaggtctgcgggaggcatggcgggagctccggacgagcgccggcggggccccgcggcaggggagcagctgcagcagcaacacgtctcttgccaggtcttccccgagcgtctggcccaggggaatccccagcaagggttcttctccagcttcttcaccagcaaccagaagtgccagcttaggctcctgaagacgctggagacaaatccatatgtcaaacttctgcttgatgctatgaaacactcaggttgtgctgttaacaaagatagacacttttcttgcgaagactgtaatg

SEQ ID NO: 2113 - DNA, 300 bp, Homo sapiens
  misc_feature 61: n = A,T,C or G
gagggcaggtggatcacgaggtcaggagatcgagaccatggtgaaaccccgtctctactanaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaacaaaccaaaaccaagttcccactggtgatgcctgtctgacacgttttggtatttagtaggaaatgaagtgtttcg

SEQ ID NO: 2114 - DNA, 300 bp, Homo sapiens
ccgactacttgtgcagtttgccctgctgagccctcctcgccccgggaggcagaaggggaggggtcctcagcaatatgctgagcacctcctaaacaacatcacctgaaaaaggaacctagaggagagccattctcaaatctgatcctggactgagctcgagagctgggttgagagctgggttgatcaaagttgggattttgctattattgtgacaaagggtccagccttgcagtccagatcctgaaaggcctgggacaaggccaggtaatttggggagtccgtcctgcattgtgcaggatg

SEQ ID NO: 2115 - DNA, 300 bp, Homo sapiens
cttgtccccatggtcagaggagacccagctgtcctgcacccccttgcagatgagtatcaccccatcttttctttccacttgttttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgaatttttagtagagacagggtttcaccatgttggccaggctggtct

SEQ ID NO: 2116 - DNA, 300 bp, Homo sapiens
aacatctcctcttgtcattcctaggacatagacggttagggaaactctcatctttccttcaccacctcatgagtctaaaaacaatgataaacccagggaagcttgctgaagagcatcctccatttggttattgctctttgtctaggaaaatcagactcagctgtgaattgtggaccaagtggtgcagaactcattactttgaacaatgcctcctcggcctgggaagcatgttctctcttctcactagcaggggcttattccaggctggctttggtcacaaggaaaatcatttagacacag

SEQ ID NO: 2117 - DNA, 300 bp, Homo sapiens
ggaacctttcaatcactttaactagtcacttaaggactctaggcccagaagcctggtttctgggtgaatgtttttatacatcactcaacttccctcgtcctaaaaggacacctaattttgttactattgaaaatttttattttggtggccagaatacgaaatcgggagaggtaacccaaacagttgtcttaggaaaaggcagattctcagaggcaatgggctatcaacaaaataggtgctaagcacatttgtttgtaatgatcattcatataatttagaagatttatggtaacagtttat

SEQ ID NO: 2118 - DNA, 300 bp, Homo sapiens
ctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttgga

SEQ ID NO: 2119 - DNA, 300 bp, Homo sapiens
actgtggagagatctcagtttttctatctgtaattgctcatattttgaatgctaagttttcatcaaccataatttttacgtgctctaatatgtttcttcacagattcatgccatgttcagtttaaaagagtcctgttcttttaatacattatctttgaaatgcctcttactgaggaatgactaaacttcttctgaaatgtgctctctggattgaagtcaagagtacatgttgcaacaaagataatcatgacttttagtattaagagacaattaccagattgagtgctacttagaaaagtt

SEQ ID NO: 2120 - DNA, 300 bp, Homo sapiens
aaatgctgaatattggtaacaagcaacaggggaaacaaggcagtctgagcacacagaactcaagtcctcctaatgggatcccagaatgcccatggaggaagcagcatgtgcactgtgctgagtgctgagcaggatttcaagagagcaaaggcagagatgctggacagggcagcacaggaggacgagtgtgcatggtcactctgagcagggctggttcctgggctggttggagcacagcatggggaactgaaaggcagacactggccaagaaagtccttgtgcagggcttcagaagtgagc

SEQ ID NO: 2121 - DNA, 300 bp, Homo sapiens
gttactttctttctcacacaaaggaaaaaagagactatctttaggaaacactgctttaaatcatcttccttgaatattaattctctgttgcttcctccaaaaatggagaaaataatccctaccctcataggcttattataaggctcaattatgataatggtgtgaaaactttgaaaattagacttcagagaaattgagttaatctgggattatttatcaatgtcttagtaaccaaaagtttaaaatgtgttttgtctaccaactggttgcatgtacatggttaatccaaaaggctcagct

SEQ ID NO: 2122 - DNA, 300 bp, Homo sapiens
agacaacgggaggggtcaggtgtagtgagcaggagatgaccatcctcaacctcgccaggccaaatctcaacccaaacaacaattgttatttttgtacattcccttccagaccccatttgcgagctctactgcattgcctatttgcaaatcctagtagcacaagaggacaaccacaaacaacctgacattcgaagtcacacaagcgcaagtttttcccatcatgcctagttggcaatcatcggctgagcagtaaatcagaattttgtcccgaatgttactcacctgttagtcgcagccctc

SEQ ID NO: 2123 - DNA, 280 bp, Homo sapiens
gaggagttaaattttgaagctctttgagaaaggtaccttttcttaacatgttttataaataaaaatacaatggcttatttaaaatgtccctatgcatggtgaaatgttaaataccaagtggatgaatggttctcaaatatattgtaatggagaattattcacatgcatctattgtttaaactaataagtaaaatagacttcctttttctgttctgttttaaatgtgcactaaaattacctgcttgtggttaagcatgggctggacagtttattgattttt

SEQ ID NO: 2124 - DNA, 300 bp, Homo sapiens
ccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggacaat

SEQ ID NO: 2125 - DNA, 300 bp, Homo sapiens
cagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcaga

SEQ ID NO: 2126 - DNA, 300 bp, Homo sapiens
acacagccctgggcaggaagggaggcaggaagagagatcctcaggggctgggctggaggagcaaagccagccaaaggggagtgagagggcagtcaagcgcctagaagccaaggaaccccaggaggatggcatcgggcaggtgcctcctggtgcccagagacaaaaagatgtgtgggaaggtgacagaatcaagcggtaaggtcagtgctttgagggagcaggcaaccaccagcctccagtgacacttgcctttcacagggatcctggaggtccccatttgggaaggtggaaaatctcagt

SEQ ID NO: 2127 - DNA, 296 bp, Homo sapiens
gtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataaactggtg

SEQ ID NO: 2128 - DNA, 300 bp, Homo sapiens
cgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagc

SEQ ID NO: 2129 - DNA, 300 bp, Homo sapiens
atcaccttggagctccttgagtgagttctgatcaagccattacactcttttcatgtagacctgcctgtaagtgtagacatgcacactcagctgaccttactgttcaaaagctggagaaaaagaaacagctttcatacagtgcaaactgtctacgtctatgtaaaagaatttgagaaacatggcagtagccattgctaattaatctgggtatgtgtaaatagtttaacttgatttttgactctggtgtttggatctattttaagatcgatggagttaattgcttcatgacagttcttatga

SEQ ID NO: 2130 - DNA, 300 bp, Homo sapiens; identical to SEQ ID NO: 183

SEQ ID NO: 2131 - DNA, 300 bp, Homo sapiens
ggccatttccccagcaattacttagataatagggggactgggttgggtgggaggaggtgttcattctctctaaaccatcctgccctgaaccgccattccttcttccatctccagagctgggctccggatggggaaggaaaaggtctggttgcctaaccacctccttcctcatccaaccctgaaacccccaggatgtggaagaaaaacaggtagcattttgctttcataatgcaaagacctaaagatgcatctgtgtttgtcaggcatgtatgcatgtgtgcctgggtgtgcacatgtgcg

SEQ ID NO: 2132 - DNA, 300 bp, Homo sapiens
aacatgagggccctctatgccagaagtgaattcatctcacaaaacatgttgactctagactggtgcctcctccagctactactacccccattagtcacctagtaaaaaatgacgacatttcatcacctgcacatgaaccgctttccccccatttcttaatcatgaatttctgtgtcttaaattattaatggctaagactaggtctggcagttaatttctctctcctggatttttggcccaactcgagtatttttgaaaaaccgacacagtattttaggggagcccaaaaaccatgatggg

SEQ ID NO: 2133 - DNA, 300 bp, Homo sapiens
atggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctc

SEQ ID NO: 2134 - DNA, 300 bp, Homo sapiens
ctggtcagggtttgactcaggaagctgagttccagcttgtttccttggcagcactgccaaagagttagaccaagctgcagcttttgaggtgaaaggggatggaagaaagtactgttacttttccacttagaatttttggactttgttcttaatgaataggttcattttcaatttcaaagcaaagtgttaacatttttgaaatttgtctcaattctaaaggccaaacttaaatatgtctcctcctactggggcatggagcaagttattcatcaaatacagattctcgcatggaaaagaaag

SEQ ID NO: 2135 - DNA, 300 bp, Homo sapiens
gttttatacattttatgttctttgcaaaactggagccccagaaagaatacaaagtgagcttctgttcccacttctcccagaatagcctaggatgggcaaccatgtaaaattcaataaaaatccaaccttctaactaactcgtggtgttggagagtattaagcatttgaaaagttcaggtagaattttcatcctttttgagctctttcctagctgctttgctgtgatatatctgtcactccagatgagggagtagtggtggaaaaggaatgcattctcagattcattgttggtagttcaaa

SEQ ID NO: 2136 - DNA, 300 bp, Homo sapiens
aggtaggcacctggcatgtcagttgcctgaatttgaaagttttcacctgtatgttttggtacgataaaaataaaaatgtaatttatatatctgaatcaggtctgtatgttatgatcaattgctcagcaatttcgggcagttggtttgatggttatgtagtaatgtagcctgagagcagaaatacagagcctctgggctagagaaagtataaatggcatcctaggctatgtagggttacagctcttcagaaggaactttcattttcattgtgacacatcgtctacatgttgtagaagaaca

SEQ ID NO: 2137 - DNA, 300 bp, Homo sapiens
gttgtaccaataaagtttgcaacctacagcaatagccagtcaataaaggaaatgatgctgatgtagcatttatgagccttaaaaaacaaacaaaaaaccttaagatgttaaatttattccaaggattctttttttttgttgtacatgaatgttcatatcaggtttatttgtaatagccaaaacagtatacacctgaatgcccaccaacaagtgactagataagcaaagtacggtacatggatatgatggactacctcagagcaataaaaaagaatggactattgatacatgctacaacat

SEQ ID NO: 2138 - DNA, 300 bp, Homo sapiens
gtttccttctgttgtcctgtgcattataatatacaaaataacttattttgatgatcagaggtcttgaggtcttgacctcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttatacccctt

SEQ ID NO: 2139 - DNA, 300 bp, Homo sapiens
acggagttgagttgctaacttttttccttttcctcagtttccagatgagtttagcagtaaagatgcttttcccaggcacaaattgggaatggaaatcacctagttccgttccctctgacagctgtaatccagagagctaagctgcttacttcattagcttggtataagctgacgacagcagtgcccttgctttatatttgtcagagctaggaaataagccttctttttttctgctgtaatcatagttacccttgaactgaaatatcttacatttattctcaagcaggtagggagaggaga

SEQ ID NO: 2140 - DNA, 300 bp, Homo sapiens
ggttcataaacacatggctaacaaagtaaagccttcaagtctggcacagactcttgactacacgatgggaaaagggattccaattacgatttaacttgtattttaaagatgagaaaagaaatgaataagaaaatttgttgctatttttcttcttccaaattagaatctatatctctaaaaatactttgcatgtttagtaaacatccatcttgaacagaagataccttgacatcagttctatttaatacttatggcaattaagagatttagaaagcagaggaaaagaccaaaaaaaagtat

SEQ ID NO: 2141 - DNA, 289 bp, Homo sapiens
  misc_feature 146, 151, 152, 159, 169, 175, 178, 179, 185, 192, 201, 204,210, 220, 266: n = A,T,C or G
gagacatggctgtctcaagactgttttgtttcccttcctggtggaattttgcacttttatgtcctgtgtagcagcaggtagtgtggctttgagaaaataaaatggccaccttgctccgctgttctttctttgtaaaaaaaaaaaancggcnnaacaatnttggcctttntagctnggnnaccccnggccggncaatccctnctnctctcnaagcctcggnttcctcccctgaaaagtaaagaaaataactcctaaactgcctcccnaggcttgctggcaggatccaagg

SEQ ID NO: 2142 - DNA, 300 bp, Homo sapiens
ttttcttgcagttactatgctgtccttcctatcactacctgttggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagtttagcacaaattgcagccca

SEQ ID NO: 2143 - DNA, 300 bp, Homo sapiens
gctgcttcctcaagaaaatgaagagggaaggatggctcagggaaagtaaatcagagggaaaatgtcactctgtaaagagtaaaaaatttaggatgatgatacgatctgggaaaaaaaggcatattgaagaccacttaaaaacaaacaaaaaaacctatgaaggtgcatgctatttccccagagctaaaaagataagtgaaattgtgtttgaactcttaagtggaggtgaagcagaatttattagccaccaaccacataagtgattatgaagtaactgagaaacaggtaacattttttccc

SEQ ID NO: 2144 - DNA, 300 bp, Homo sapiens
cttggggtgagtctcatcttcaccctttcaccaactgtcctggtaacaatctcccttccatttccttgttcttacagcataccccatagaatcaagcctcgttattgccagggctgaactgacttttttgtttttgtttttgttttaagcagtaccattgtgcaccttgggaaaattcctgtgttgatctaattttaccatattcttcactccactgaccactccaattaggatactcctggcactcttggttttagagaggcttagatatgtggctatttatcctttggtcttcagcac

SEQ ID NO: 2145 - DNA, 300 bp, Homo sapiens
aggaagctggttgagaagaagaaggaaaaagtcgattctactgactgacgtttccccctgctgttaagaatcccaaccacacactttcacacactattccaggttctggctactgaatgatcccacagctgaggtctattgtcatcgctccacttctatttttagcagcactaaaaacattcccaaaaaaaatgttttttagctttttaactgcgattcaccactaagaaattggcattggaacagtccacagagcttattcaaatttcacccattttacatgcactcatttgtgttgca

SEQ ID NO: 2146 - DNA, 300 bp, Homo sapiens
ggtacacgaagaggtgataatgacagccaccaaggagatttggagcccattttagaggcatctgttctatcttcccatcataaaaaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcct

SEQ ID NO: 2147 - DNA, 299 bp, Homo sapiens
  misc_feature 269, 282: n = A,T,C or G
gtgctgtctttcctgagccgctacagtaaaagtgaagacatggaaaattatcccagatgggacgaatcgctcattctctgttctttttttaaaaagaaaagatttcagaaaaaaaaaaagtcgtctttttctttaaaacagtatgaataaaatctggacagctgtcgaaaaagatatgccgtctgcatttttttttaatttctagccaccaccataactaaatagcttgaatagaacctcttttcttttttttccccttcatacataangatctctacttcnttaaaagcgtattaatc

SEQ ID NO: 2148 - DNA, 300 bp, Homo sapiens
gattcatttttgtactagttaatatcaactctttctcagaagtagtcaaaatataaataggaagttcttcaaaagtaacccaggagcaacagctgagcagtgccagagttgtgaggtaaacatcaatcatttcacaaatgttctgacttgttgagcagtgttcatttccaggtttcaaacttaaagtatctattaagcaatcttaaaagaaagaacaccgccttaggaaaaaagagatttgccaaactcttcatacttccttcaataactgcttagcaaacactcttgagtgtcttctat

SEQ ID NO: 2149 - DNA, 298 bp, Homo sapiens
  misc_feature 230, 235, 236, 246, 248, 249, 251, 254, 266, 274, 280, 284: n = A,T,C or G
ttgctctatgtgatgtttattatcaaatacatataattttgaagattttaatgaatggcttaagattttatctttgtgtagaatgtggctaaagaaaccttagttgagattcaagaagttggtgtctgtttctgattcttatcacaacttgctacttagtgtctaccaagtcctccacctctttgctcctcaaagagctgtgaacactgatggcaggagccggcaccacnccacnnacttagagancnncncanagctgccatacnggcgatcnctgacntcanacttccccctctaa

SEQ ID NO: 2150 - DNA, 300 bp, Homo sapiens
gcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtct

SEQ ID NO: 2151 - DNA, 300 bp, Homo sapiens
gtttgtttttcctgagacaagaaaatcgcattcttgtttatatttgaagatagcaacttttagccatcatgtgaaatatggttattgtttctgtacacctggaacgttgtagtgcctgatactgagattttggaaacactgaagaattatagcattataagaattttaaatttatgagaaaatctgagacaggggcagagatggctgattttgatcttgctggatcttagaccatgagaatgacaggcctgaagccctgaaatctcacctcagggtggagtgtcagacttggcaactttg

SEQ ID NO: 2152 - DNA, 300 bp, Homo sapiens
gcattttaaatttttgtcagtgtccttcatgtctcagctcctgtcttccaataattttctgaaaaaggtaatgtgttctttaaatgtgtttataaaaaggtattctgctgtctccaaggaactgttctcaaccagtagaagtagcttggtaaatggctcatgaaaatgggaggcacgcctttaaagataatagaacaagaaagtacgtttcaccatgaaaagccgttcgtcatgatctactgagatggaacataatgtaaactctgtgactcagtggtttcattcttaagtgttgtgtac

SEQ ID NO: 2153 - DNA, 300 bp, Homo sapiens
ttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatg

SEQ ID NO: 2154 - DNA, 300 bp, Homo sapiens
ggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccac

SEQ ID NO: 2155 - DNA, 300 bp, Homo sapiens
cctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaa

SEQ ID NO: 2156 - DNA, 132 bp, Homo sapiens
gatcagtgaaaaacattagtatacgtttttaaataggctaatttttcaacttggatcattaggcttacgtactacttgtttcaaatgtgtcaaatacaaaaatggtaactaggttgacagatactttgtatt

SEQ ID NO: 2157 - DNA, 300 bp, Homo sapiens
aatgaaggttggggagaaaagaaagcaatttaggagactctatagggaggaaaggatgagatgcatttcagaaacaaaatattaacgtaaacagaaaaaagagaaagcaatcatgacaaagcctaagagggctagtggaatgctagaatgaactcatttaccttcctttgatatttaggggctctattgcctgctaatttcatcactgttatttttcttacctcttatctttttccctgtagttattatcagcctaatattcattcattcattcatttacctgagttttcaggcttgtgc

SEQ ID NO: 2158 - DNA, 300 bp, Homo sapiens
gtgatatgaaaagcgaatgcaccatttcttggtgatgattcaggtcagcgttgggacccaggaatctcctgttaatcagtaccctggtgattttgatccaggtcatcaagaccatggcttccatcgtaggcagtcacactctttctctcttggatcatttgctgtggggaagcaaactgtcatatgagaggacactcaaacagcctctggagtctcatttgctaaggaactgaggactccagcctgagaactcaggcaagtaactgaggcctgccaacaaccatggagaaagcctggaag

SEQ ID NO: 2159 - DNA, 300 bp, Homo sapiens
gctaaggttaaatagtatgtattcctttcttacagtttttactctaagatagctatttcctcagtgttaactcattaaattacttgataagaaccagctttatattgtaagatgtgtaagcagtgggagcaatggtggaaatagcctttctattttatttacccaagtctgtgtactcctcatccttaccagggcccctaactgatctttccactaaattatgtgtgtcacagcgaaattaaaattactcttccaaagtgcaactctaatcatggcacttaagggattttcctttactta

SEQ ID NO: 2160 - DNA, 300 bp, Homo sapiens
ggtagcacaggcctgcccttgcacccatgctgtacagtgcggttactagacttgtggccgttgttgtgctgtcttctcattagcatgcaatattcacttgactgaattcctttttagctaagagaaatattacagggcatgatcattttaggttattaaggtgtctaactcaatatgtaaactgctgaaaagaattatatgtttttatcagataatctcaacatttcaaaagacaacacattcagactactcccctttccccccaacttttatctagtgtctgaaaccacatgactagtg

SEQ ID NO: 2161 - DNA, 55 bp, Homo sapiens
gcatcctgtccttgggaaccaatttctcattattgtcagccggtcagctgcctgc

SEQ ID NO: 2162 - DNA, 300 bp, Homo sapiens
  misc_feature 217, 231, 239, 257: n = A,T,C or G
gaggaagtgagattgtgcatgacatacttctcctttgtattctctcagtgccttacagcaggttactccattctgctatgacaacttgtttcaaatgttaatttacataggattttttataagccattaaggcatatgtatagtatatcagtaaagatggatggtgcatatataaatagtcttctgtaatagtgattggatttacttctggattatnagagactcaaaatnttccccancctgtctctatcctttcncaggttgatcccttgtcatgatttttcattacggtggttcagg

SEQ ID NO: 2163 - DNA, 300 bp, Homo sapiens
  misc_feature 47: n = A,T,C or G
cctcatcagcaagccagtgagagggtgcctatccgaggatgatattncatcacctctggcagattctgcttactagtcagtccccaggcccaggccactcgcaaggggaggacattacaggaggcgtgagtataggtggtgtgatctgtggggaccgtcgcagaggctgcccaccacaaggggttaaaacctataaaacttcgaagttggatttaataattttcaattactaggaaatagataaaaacaaattttctgtccttcacagaacactaaagtatgtattggattttttatccc

SEQ ID NO: 2164 - DNA, 300 bp, Homo sapiens
gtacaactcttaaagctttctacattttacatatacagtcatctctcagcatccgaggaagattggttccaggatggctcaaggtcctgatataaaattgcgtagtatttgtatataacctatgtacatcttctcgtattctttaatctctagattacttataatacctgatactatgtagatgctatgtaaataattgttatactgtattattttcaaattgttttattgctatttttattgcttttccctgaaatatttttaatccacagtaggcggatgcagaacctctttatacgg

SEQ ID NO: 2165 - DNA, 300 bp, Homo sapiens
gtgaattcctcagcaccaagttgtttaacacagaagagaggtggaaacaaaaaatgcttggattttactggctttcttttagcatttctgtctagtcgaaatgggggccaggcttgcacacatagacaactgaatgaatgtaaccggacctattccatctaggctgacctcttgaaagataggaggggaagtctaaaacaggagaaaagttttagaaatcctttggattaggcttacccagattagtggtatgtaaaatattatgatattcttagtgtttcaggattatggattttaagt

SEQ ID NO: 2166 - DNA, 300 bp, Homo sapiens
taaacatccagatgtgttttgatagcctggggtaattaaggttgaggacaagtgtaccagatcaaggagaggaacccgtcccatgcctgccgtgtgttcaggtggctagacttgttgttgcatctgttagttccactcttagtacatcattgtgctgtgaggtgtcattagccgccgtttaatttttcttttgtttttagagacagtgtcttgctctcaccccggcttaagtacagtgacatgatcatagctgactgcaacctcaaactcctgtactcaagtgatcctcctgtcttagtg

SEQ ID NO: 2167 - DNA, 300 bp, Homo sapiens
ctcgagttttcttatccagttgaggccgccttcgctgtactcactctctgcctcccaccccatcttctgccacccgacctccatctttgatggttagcgccttcagccctcaacagcttcgcacaaccaacccctagaagccgtggagtcagaccggccagggtgggacctaggttttaactcgggttctggctacacacgctgcgcctccatacagtttgtcccaggtttggcagcaggccggctaccttcaggaattctttgctttggcttctgtctgttcctgtctgttgggcaagt

SEQ ID NO: 2168 - DNA, 300 bp, Homo sapiens
cgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtgga

SEQ ID NO: 2169 - DNA, 300 bp, Homo sapiens
ccttgggccagaccctttcccctggggtgctgatttcacacctgtaaaatgaagaagtttgacttgcacagtgcttttcttagactgtggtaaggggtggatgtgggggtagtgccaagaccaagtgaaagaggcttctggacctccatccttgcttcagccagagcagcgtgggttcatttcatttttggattttggtttgtgggaagaaagggttctcttgccggtgtgtgtgtttctgataaacaaagaagtgtggaagtggctgaatgagatgacccaaggactctttctgggaag

SEQ ID NO: 2170 - DNA, 300 bp, Homo sapiens
tttagagaaagctggtagctaggctgttcaaggaagggcctctgtgagaaaggggatggttggctgggtgtggtggttcacgcctataatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgtagtgagccgaaatcatgccactgcactccagccgggcaatg

SEQ ID NO: 2171 - DNA, 300 bp, Homo sapiens
cagctactcgggaggctgagggcacaagaattgcttgaacccgggaggcagaggttgcagtgagccgagattgtgccaccgcactccagcctgaatgacagagcgagactccacctaaaaaaagtaaaagaaaaaaaagaggaagaattagcacatttctattacagaattggacttgaacatgcaaaatcatgtctggatttctcagtgaaaagctgttttacgttagtggactcttctaacattttgaaatggtgatctggatttgggatctggctatcactgacccaccttgggtct

SEQ ID NO: 2172 - DNA, 300 bp, Homo sapiens
ggcaaggagtttgaattttattcaagaattttattcaagaattttatttattttattcttgaattttattcaagaataatggctagccattgaagagtttaaagtagggaaacagtgctttcttattcacattttgcaaagttctccatgggctactatgtgaataatcagtccaagggggaggtaagagtagaagttgggagactagttacaaagtcattgcagtttggagattatggcaccttggactgtaggtgatagggatggagatgacgataagtgaatatatccagaaaatat

SEQ ID NO: 2173 - DNA, 294 bp, Homo sapiens
gtcagaatggggaaagtggcaggatgcaggcaaacatgttcttaatttagagacacgatgaaggctcaggactttcctaggcagataaaagaagaaagaagctgctttttgaaaagagggatcaagattatgacaaaaagggagattcagccatcagcagaacccaaatgagagcctacaaagagacactgtctactcagagtacatcttcagacatccagggtcccaagctactgtgtttactgttagcccttatccattgttatgtcttactgctttataactcttctttaa

SEQ ID NO: 2174 - DNA, 300 bp, Homo sapiens
gtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaa

SEQ ID NO: 2175 - DNA, 298 bp, Homo sapiens
  misc_feature 206, 217, 226, 232, 255, 258, 259, 267, 282, 283: n = A,T,C or G
actttcaacatttcatggatagaataagtaatggtgggttagaagaaggaaaacctggggatctagttcttagctggggtggacaattttgaagctcgaatgacaataaataccagcttggaatgaacttggaacaaacatggatggaaatctggggtcaagggaaaatggcagtttcaggggaatataccaggttaataaatccnggaaaaactgnttggtttgngggggnctccaccacttggaagttgctgnaannattgatgnaaagaactctgaaannaaaaggtgttgggca

SEQ ID NO: 2176 - DNA, 300 bp, Homo sapiens
aggatatgttgcactagttgttccttgtgactggaatattctctgcccaaactttgaaaggctagttagttacttctcatcattcgggcttaggttaagtgtttcctccttagagttcttccttgatttatcttccccccagtctaaagtgccagtcacattaatctgttttatttctccatacagcactcatcactgattttttaaaaatctattttgccatctttctctctcactggaatattatgtgctcatgaagaagctccttggctattttgttcctgatcgtctgcgctgcat

SEQ ID NO: 2177 - DNA, 300 bp, Homo sapiens
aaaaattttatggacttctatggatatttcttgatgcttagagatttgtttttttaattgcaaatgtgaatagtctatttacaaatgctattacatatggagcgggcctgtggtgtatggcactattccttggactaatggtacccaggttccattctctgctcagctcggaggctctagacaaagcccctaaaatgctgtctgcttcagtctccttaatggtgaagtggaaatgaatacctactgtcacttaactcatggagatgctggactgataattagatcatgtaagagcacttt

SEQ ID NO: 2178 - DNA, 300 bp, Homo sapiens
ggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtaggcagtgaggaggcggacagcatcaccttgggccggtatctccggcagctggcacgccatcggaacttcctgtggttcgtgagcatggacctggtgcaggtgcagtggctcacgcctgtaatcccagcact

SEQ ID NO: 2179 - DNA, 300 bp, Homo sapiens
caagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatac

SEQ ID NO: 2180 - DNA, 300 bp, Homo sapiens
aaagcctaactagttatgataaatgtatccgtaagtaaagtaattaagccagtttggggttggcagaggaattgtgccagacatctgtggattttgctacccagcagcattcgctcttctcctggttgtggggccccagccctgttgctattacctggaactaaaggttaagatgatggttcaaagatgaagccaccatggaagagagcatagcggacagatggagagaaactgcatccaggtgaccccatttgtactaaacctggttacctggtttttctttagtacatatgccagttt

SEQ ID NO: 2181 - DNA, 292 bp, Homo sapiens
  misc_feature 221, 231, 233, 240, 243, 256, 260, 264, 266, 283, 286: n = A,T,C or G
ccctcttaaaaatacaaaaatcaaaaagaggaaaataagttaaattaagcccaagtaacaaaaatactggaattattaaaacgtatagtatgctagctatccttttaaattatgctaattctcttcttctgaaattatggtcacactatatactatagcatttcggttttatcctttgataaaacttttcttttttctttttttttttgaaacagggtctnaccccgtcgnanaggctgnagngcaggggcaaagnctcnactnantgcagccttgacctccnggncccagg

SEQ ID NO: 2182 - DNA, 300 bp, Homo sapiens
caaagtcataccaaaacttcacttaagagtccctacccctactccagtgcttatttcattatctagcagaatgtacctttatttgattcactatttaccactgattaaagtggagcgtctgtggagttatacgttactttgtagacttttgtctagtgaaatacaaaagacaaccccaaaggttataatttttttgcctatagaacatttcaggaaacaggagtaggatttttgtctataatatagcaaacttgcttcaacataccttccacaacttacaaatgctctttgaaccagcct

SEQ ID NO: 2183 - DNA, 300 bp, Homo sapiens
gcatttggcccattggccgcattctgctgacccatcaccttggtgctttttctgctttttctctgttgtcctctgtgtgtgttcctttgtcctgatccttgtcaccttgtgggtccaaaatggttccactagcctcatggagcctggccttacattgcagagtccaaagcaggagctgagggaaaatgaaaaacaacttcttcatcaccggaagcccagcaaacttctccttaaaaatcactggtcagggctgggtgcagtggctcacacttgtaatgccagcactttgggaggctgaga

SEQ ID NO: 2184 - DNA, 300 bp, Homo sapiens
ccctcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacaatactgtgactctgagtaac

SEQ ID NO: 2185 - DNA, 300 bp, Homo sapiens
ggccttccagatcgtgctgtcccacctacctgcaccgccgaggccttccagatcgtgctgtcccacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctcccttggggctgcccctgtggagggggatcccgcctctagaactatagtgagtcgtattacgtag

SEQ ID NO: 2186 - DNA, 300 bp, Homo sapiens
aactgacctaagcctcagtttttcagatctgtagtacttactttacatgattgctctttgaattgaataacataatttatgtgaaaacacttaattatgaatgctgtaaaactatcaaagccattaatatgtgttatagtagcatcatacattttgcagcataatccagagaacaaggagttgttaacaagggagaggaagataatctggttgggctagtattatactctcaggtgctactgacttcttagatgaccttcaagatgttagtacaactctctacttggagatgctattttc

SEQ ID NO: 2187 - DNA, 300 bp, Homo sapiens
atgttttgggaaatagcttgcgagaggtaagaaggattgcaaagtttttccaaaatattttatgaagttagtgaagtcagttgaaatgtgtatttaaacatttgaagggatacagttaacatttttttaatgagaggaaaccattgtctgtagttcagaaataagatggagtgttttacttatttaaggggtaatttaaaaagtaaacaaaagcattggcctacaagagaaaggtgatgttggattataagtgctttttctaatcgttaatattaatcaacaggtgagtatattttccgt

SEQ ID NO: 2188 - DNA, 300 bp, Homo sapiens
tcttgactgaggttcccatctttcttagttctcttaaggatgtgctattctattctagatgcataggagggaagttaatccagtcttagatcagcagggctgagttctttctcagaaccatagttgaaaaagcctaaatagaattttaggaaagttctatttagaaagaaactaagaattatgattaagttttggcctaagcaacttaataggcagtggtatcatttattgagaagcaaatcagataagaagcaggttatggggcttgggaggaggtaagggcagaaagttgggtattct

SEQ ID NO: 2189 - DNA, 300 bp, Homo sapiens
ccgatttacagattgaagcggtaaattagtggttttatggtatttctgtaaacagggataaagtggaccctgacaaattcaatattgtctgaagagacaatctattctggttctgttggacttcagggtatttttctttttttgtaaaatgaaaactacaaagaaacctgacttttcaattttttatacatgtaattttctagaaatctaggaagtcatttacacatccttatataccatgaggggcaaaagtaagctttcttcctcccaaagcaaaactctttttccttaaggagctgg

SEQ ID NO: 2190 - DNA, 300 bp, Homo sapiens
ctgaaatgtcaaacacggccacctaggcagcatttacaagcaagagtccactgcttttttgatgtatatcttaagcgcccccagtgaatgaacagcatataactccacataaaaatcattaaatgtaattgacttccagagcaggcagttctgttgtatgcctctggagaaggctggctgaattggaattggtctgtaccttctgcctatcatgtacatgaggtttttgggcaaagagaactttccacaaaataagtccaaaaattatagatcatcagacaaccaataacatattgatga

SEQ ID NO: 2191 - DNA, 300 bp, Homo sapiens
cttgctcatcctcatttggtaaactgctacgttaaatgtttcaggtatgtctgattgacctgtcctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtgg

SEQ ID NO: 2192 - DNA, 300 bp, Homo sapiens
gggatccctccctccacccgccccccagccccgggaccccgagtgccactccagcctcaccccctgccagtgccactcctagccagcgccagtgcgtctccgcagccaccagcaccaacgactccttcgagatacggccggcccccaagccagttatggagaccatccccttgggggacctccaggcccgggcgctggccagcctccgcgcaaactctcgaaattctttcatggtcatccccaagagcaaggcctccggggctcctcctcctgaggggaggcagtccgtggagctgccaa

SEQ ID NO: 2193 - DNA, 300 bp, Homo sapiens
  misc_feature 9: n = A,T,C or G
aagaattgnacgactcttattgatgagtgcaaaatttttctatagatttgaaagtcactactaatcatgactagctgattataataattgagagtaaacttttaaaattattaaatatcctgtgaaagttggagcacagtaaccattaaccctaaatttgatactatgtccatatgaattcagatcataatagtgctctatcatgtgaaactactaaaggatgtatagagttaaatattacgtatccactttaatgaagaataggtattacacagtaatggttgtttaaaaaaatttttt

SEQ ID NO: 2194 - DNA, 300 bp, Homo sapiens
  misc_feature 199, 201, 220, 222, 224, 226, 236, 238, 248, 259: n = A,T,C or G
gccctgtgttaatccaggtgagaacaggtagtacccaaattagggcatggtagcagggatgcagaggaaagaagaggagtaggaactatttgggaggtagtattactaggattttagctttgaagggttgagagaaatgtcaagcctaactacaagcaaggtttctagtatcagtaacttcatatcatttgaaatacananattagcaatcaatgtatanancntnctgggctaancntagcatgaantctgacttcantgtagcattgaggagggtcctggcctcagatactgcaccag

SEQ ID NO: 2195 - DNA, 300 bp, Homo sapiens
  misc_feature 264, 269, 273, 276, 278, 279, 291, 292, 297: n = A,T,C or G
agatactgtatatttgaacaagatttttttttatcatttctatagtcttggagttcatttgtaaggcagtgtcttgacttggaaaggatgtgttaatggggtgactttgtagcatggtatgttgtcttgagttaactgtagtgggtggggaggtccaatgccctccgcaatgcccttcatctcctgtgttgtcctgtaccctgctcagctccatcctggggttcagggaaggcacacttcccagcccagctgtgttttatgtanccganatanagngnngtccgattcaanntcatncac

SEQ ID NO: 2196 - DNA, 300 bp, Homo sapiens
gctattccgaatagccccaggtgatccagctcacaccaacgtagcaatggaagtcagcacctctgctgggccaaggccatgcttccccagcctgtggctgcgcctctgctgtctctccgggtctcacctgggcgggaggctcctctggaggccaggacctgccttgtgagggtgcccttgtgggagaggcgcttgcccaaacctgctgttccccgggggctccttggtggcccccaggactggagctctctgccagagtgcccctccccagaggttaggactcccatgaccctgtcccct

SEQ ID NO: 2197 - DNA, 300 bp, Homo sapiens
gctgagtatttttttcaagtgtatcatttgcctgttaacttaaaattctattttccccctaattctatgtcccagttttggttagtgtgctctgggatttttgacccattccatagtaatagttattactactaccactacagtaaattcttacaagaactttccatgttttttgggaggaggaggaggagtagttacattcaggatcatatacataattgtttagcttcagttctgtatttatatatgtcacttgtaactgactgggatacgttctgagaaatacattctcaggtaatt

SEQ ID NO: 2198 - DNA, 300 bp, Homo sapiens
acatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctggga

SEQ ID NO: 2199 - DNA, 300 bp, Homo sapiens
gattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattc

SEQ ID NO: 2200 - DNA, 300 bp, Homo sapiens
  misc_feature 92, 96, 113, 119, 121, 127, 142, 148, 162, 169, 170, 179,182, 189, 195, 219, 233, 239, 258, 264, 265, 276, 291, 292,293: n = A,T,C or G
ggcatctggactaatagtgaacgagtggaatagtgtgaaactgcatgctacagctatgaatacacgtattcaggaaagaccccaatgatgcntganaacttctactttggctncctaangntgaatncaattcacatctctnagaggntcaccgtaaacagntttggannctacccttnatntggacanattganttctcctgaggtggatcttgtatngctctagaaactangcatcntcaccatgtgctgaataanagtgtnntcggtgtaatngccgcgcacgtatgnnnacatttg

SEQ ID NO: 2201 - DNA, 300 bp, Homo sapiens
ccataagtgacttgcaaagggcctcccccataggaaggcctcagcaaattttcagtgaactcaagttcattgatttccaatttgtgaaataaactagagggcctctctgaactacctgcctcatgagaatgactgtgaagtgtagtcagtttaaaacaaacagacaaaaacaaagctagacagcattacaggtttctcagaaagaaggaaggttcaagttcacattggtactggtaccacgttgccattgccctcctagactgttctctgcaagctttctatttactggaggctggaata

SEQ ID NO: 2202 - DNA, 86 bp, Homo sapiens
  misc_feature 59, 69, 71: n = A,T,C or G
ccattgtgaagggttatgcccctgagagcgtgctggagcgcaactggtgcacagagaangtggacgtgncnggggacggggggact

SEQ ID NO: 2203 - DNA, 300 bp, Homo sapiens
ggctgtgttgtgtgtcttgtttgatgtaaagatagtttctgtaatagttttgcagtttgattgttcatctttaggtcttcaattacaacctgcacatccatcccctctatcctctttcttactctgtttttctccatagcacttatcatccaataatatgtcatgcactttatttatctgttttgcatatatattttgtctgttacctgtttccttccactagaatgtaagtcccatgagggcagggacttgcatctattttgtttgtggttgtatctctaacacctgggatagtcactg

SEQ ID NO: 2204 - DNA, 300 bp, Homo sapiens
gctgcttcattaaactcttcttgagtgaggggaatgaggattgtcctaatcccttggcacgaggtgttcctgggccttggggagctgcttctgtcctgcaactgggcagtggttgccgacatcctgctgatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcaca

SEQ ID NO: 2205 - DNA, 300 bp, Homo sapiens
gttacagggatcttgccacttaaagattcaatcttttagactggcaatgaggattcagacaactcaatctttgtgtaaatacttggtaaagcaacaggacacagaagaggaatgctggaaaaatctggtttatgaaaacagaaatcaaaccaagttactaaccaacctccccgtcccctccaggcacacaaaaacatttgcctttgtactctgccaatgcttgatttaattataatacacactcaagtggctgtaaaaaaacccaacagaacagaaaccatttaacatctgaatagtgat

SEQ ID NO: 2206 - DNA, 300 bp, Homo sapiens
cagctatcacaagtgttaatgtattttatgtgtagcccaagacagttcttcttccagtgtggcccagggaagccaaaagattggacatccctgtgttagaccatcatttgtttgctatatgatgtcatagtggtagaatggtcacttaaggtaaaatctgaatagagaaatttggcagaaatcataggaatttctgtttgaaggcataatgagggttaatcatttttcataatagatgttaagattaatagtaatcatagcccatatttattaagcactcgccacacactggtttcgaga

SEQ ID NO: 2207 - DNA, 300 bp, Homo sapiens
aatacacacaacatataagacatggcaattaactgtttatgttatcaggtttaaggcttctggtcaacagtaagctatgagtagttaagtttctggggggacaaaaatttggttgtcaactgatgggggggcggtgttggcacccctaacccgtgcactgttgaagggtcaattgtactgtatttatatatgccagcagctctccaactgtggtctgcagatctcatgaggtctcctttcaggggacccacatgggcaaaactatattcatactactactaaagccatttgcattttcca

SEQ ID NO: 2208 - DNA, 300 bp, Homo sapiens
gaaaagcacaccccaagttcgtacagatcccgtaccccattcttatcaggtggaagttctgggggctgagaagtccaagatcaaggtgctgccaatttggttcctggtgaatgagcaaacagcacagaaaaagaaacagcagtatatgtggaagaaagcaagaaaaatcaactggcctggaacctaagacttgtccaaagatgtcacagagagtaaaatgagaaaaatccagtagcccgtgcccagagcagttcctcgtacccagcagaagggaacgatgctcttcccaaggaaggcaga

SEQ ID NO: 2209 - DNA, 300 bp, Homo sapiens
ctcatcacactgttgtatacttcgtagctattacttctttaatccccaaggacttgtttaacaaagtattcttcagtttctacttcctagttcctttgtggaactggtaaaaatttaaaatatcttaacataatattttatttcaaatgataaacagtaaggtaaaatgtggtttttcttggacaacttatggtagaatgatgtctagaatatttagttatgtcatttaatactttttttctttacaatttaaaaaaaaatttattttattttagattcagggggtacacgtgcaggttt

SEQ ID NO: 2210 - DNA, 300 bp, Homo sapiens
tagttttaaatttagcaatttgatattgatacagatgaaacacctagatatatcactttttattgagagttggtgatcaaattgtacattagctagaaagaaggaaggaaaactgatgaaaattttacagtataaagtgtatgggtaaggtacacaaatcttttttttctcttttttttgggaccactgtcagaaacaaaattttgttcatcacattattctaatagaacgtctcacacagcatgcagtgagctattgaagtttattgtcctaggaggtattaacgaaacgaatgaactt

SEQ ID NO: 2211 - DNA, 300 bp, Homo sapiens
gctgggctagcagaaaacctcaggcatctgtgaggacatgagtttacacacgctgagactcacttatacaaaaatgcaacccaattccacccctgaattgaggggagtgcatagaagtgaatgtcccgtctttctgaggtctgttgattttgtaattagtaaacgaagggtgcatttctgatttttttttcttgtgtgctagaattcattgctagtaaaactcaagataatagcgatgagtaggaggtatcaaagatgaactgtatagggacagtttaagttacttaagaatcgtcagca

SEQ ID NO: 2212 - DNA, 300 bp, Homo sapiens
tctgggaccaataatgttttaaaaatatattcatttgagattcagaaaacttgcacatcatttgctactcctatcatcttaacagtgaagaaaactgaggcctagagacattaagggggttgcaggtccagagacatgtctcaagaaagcattgctgttaaaatgtgcagttcgtgggttttcagtccatctcttaagaaaccaagtcaatcttcccctcaggaaaaagaaaagaagtagcaataagcaatttgttaatatcactacttcttatcaaggtaaaaaatgcctcataatcag

SEQ ID NO: 2213 - DNA, 300 bp, Homo sapiens
agcagattcagtgtcgatgagagcctgcttcctgcttcatagatgatagaagtgcaaagccagctgtctgggccttttttatgatactgatcccattcatgaatgctctgccctcatgatcatttcaattcccaaaggccccacctcctaatattatcacagtgataattgggttttcaacacatgaatttgagagaaacacattcagttcctagcattagcttgcttatatttatttcatctcattctctctcatagcttttatttttgtttcccctgtccaatttattatagtttttt

SEQ ID NO: 2214 - DNA, 300 bp, Homo sapiens
gttatgagtggtcattgtgaaaatttggaggaatacaaaaagtagaagaaaataacagttctatatactagagttaacctttattaactgttttgtcatatgacatcaaaatgttatattattacctgttaaatttagtatagtatagtatactaaaacagtatgtttacaaaattgaactcactgtgcagatattacaggttttattcatgtaacactatagagtgtctattgtcacatgtcattcaagttcttctagagtgtgattttctcaggcacatattgcacagatgctctata

SEQ ID NO: 2215 - DNA, 300 bp, Homo sapiens
accaaacctggagtaaagtggttgaaaaaaaagaaagtataaaggggcttattaaagtggttaataaatatgatttaggttggtttttgatatgtttttcttccaactgttatataagaaactactaatgtaaaatagtaggctatatgttgggatgtgtatagctatgtcttcaagactaatactcagagaatcaaattgtagattgtacctatctgtgagcctatttctttagccagttttctgtctactgccaagaaacagaattctctgcctcatgcaaatgccctttcgtgttta

SEQ ID NO: 2216 - DNA, 300 bp, Homo sapiens
aaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctg

SEQ ID NO: 2217 - DNA, 300 bp, Homo sapiens
ggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggc

SEQ ID NO: 2218 - DNA, 300 bp, Homo sapiens
gcgggaccctgcctctactaaaaaattaaaaatagctatgcatggtagcacatgcctatagtcctagctactgaggaggctgaggtgggaggatcacttgagctcaagaattcaaggctgcagtgagctatgatggcactactgcactttagcctgggtgacagagtgagaccctatctcacaataaagtaaaataagaattaacacactcataataactatttagttaataggaaactctgtttaagcgatattgcttatatttctctctcatgcttttgtaggtctggactcatcctc

SEQ ID NO: 2219 - DNA, 300 bp, Homo sapiens
gaaagatagaaaatcacccaggggcctgtaggctggagcttctgtagacgcacagtggacactgccgagaaacaggcctcatttctcccatgttcccgtccccgctcccggtttcctgcatgactgctttggtgccccctgactccagaatcaacaccacaccagctctgcctttagactctgcccagaggctctgggctggatactgtatttggtgcgaccctctggggcatttttgcaagttttcaggcagatgggtgggggagcagtgaaggaaggaggaaaaaagacaaagcacaa

SEQ ID NO: 2220 - DNA, 300 bp, Homo sapiens
caagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgctgccatccgggagaagctgcaggagcacatgacctccaacaagaccaccaaatacttcaaccagctcatcctgaggctgcagaaggagaagaccaacatgatgacacatctttccaaaatcaacggtgacat

SEQ ID NO: 2221 - DNA, 300 bp, Homo sapiens
agaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaa

SEQ ID NO: 2222 - DNA, 300 bp, Homo sapiens
ggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaaagacctccgctacctccgggcccagctacaaaga

SEQ ID NO: 2223 - DNA, 300 bp, Homo sapiens
tcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaacgccatttcagaagagatgatagttttatcttgccaaggaattatcttcttagtagcctatattggcttattccaaaaaaggcg

SEQ ID NO: 2224 - DNA, 300 bp, Homo sapiens
gccatttatccttttatatttgattggctcagtgattttctttacttaaatgtagcatttatcaaccacaactagcagtgcatgttatagtgttaacagaaaattccacaggaccctcttcacactagggaaggggaccatctgctactttcatattaggatgtcaggatttagaggtcaatgtgtttcctcatcaaggctgaaggctttgggaatccggggaagtgtcaggctccaagcagcacagcctgctcaaacttcatatttaagcactggacaagacactgtttccaatcctac

SEQ ID NO: 2225 - DNA, 300 bp, Homo sapiens
atcacgcccagctaattttttgtattttttagtagagatgggatttcaccgtgttggccaggatggtcttgatctcctgatcttgcgatccacccgccttggcctcccagagtgctgggattacaggcatgagccaccacacctggccacagaagggatcatttctaaatagcatagaatcacagggagtacacctcatgtgacttcacgtttagagtcagcatttgctcataatgaattacatatcagtaaatgaacatgacatgcttcaacttcaataatattaaacaaaactctttc

SEQ ID NO: 2226 - DNA, 300 bp, Homo sapiens
cagggggtcagctctggtaaaaggcttggtaagaaggaggctgagagtaacagccaacataaggttttcagattatctacatccaggctcgcccccaaccctgtcctcaggaatcactgaatgcagccatgacactgaaatttgtttttcattcattattttttcattcttacaataaacgtggttttataagttagttaaaaagtctttttcaggatgccgtagtaaacaagagtcccttttgagcatttccttagtaaacgatgaatggctgctggtcaagcttgttctggcaagtct

SEQ ID NO: 2227 - DNA, 300 bp, Homo sapiens
gttttaagtattctcatccgtcaactgggattggtaatagtacagggctgttaggatgattgcatgagatgaaatacatttagcacttggtaagcactctataaatatggcaatatgatagtccctgactcatcttcctctctgttgccctttaaacaggtgagcacctagccttgttggttttatgtgctcaacagcagttgactcccctggctcctctcacccatgctactgcgtagtcaagccctccatagtctcctctctggtctctgtttcccatctgcctttgcctttccctct

SEQ ID NO: 2228 - DNA, 300 bp, Homo sapiens
gtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaa

SEQ ID NO: 2229 - DNA, 300 bp, Homo sapiens
  misc_feature 132, 139, 162, 172, 176, 180, 181, 183, 184, 188, 190, 191,197, 198, 202, 206, 209, 211, 215, 218, 219, 220, 228, 230,231, 234, 235, 237, 238, 239, 242, 243, 246, 247, 254, 261,262, 267, 270, 276, 280, 282, 284, 287, 290: n = A,T,C or G
gcaagctggagagctgcagaggctggtagcgtggctcagtccaagcacagaggcctcaaaaccatggaagctgatggtataactcagtctgaggatgaaggcttcagaacctgggggactacaggtgcaagntctgganaccttttgctggaataaccttgntttttttgtncctntttnnanntttncnnttttcnntttncttnagnantttnttnnntgtttttntnnttnntnnnttnntgnnttttttnagctctnnttttntantttttntttntntnttntancttttttatg

SEQ ID NO: 2230 - DNA, 300 bp, Homo sapiens
cctttattcattttcactgttatccagaattccattatatgaatatgccataattttaaagttcacgttactattgttaagtgtttctaaactggaaattactccagacaatactatgagcacacctgtctgtggcttttgatgagcatctgaatgcaggccaaacttggcctgccaaacagtttctgccgttgtttgtaccagttcacactccctgccaaacagtttctgcaatgtttgtaccggttcacactcccacggcagcacatgaaagctttatttgctccatatcctctcaaa

SEQ ID NO: 2231 - DNA, 300 bp, Homo sapiens; identical to SEQ ID NO: 1231

SEQ ID NO: 2232 - DNA, 300 bp, Homo sapiens
gccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagca

SEQ ID NO: 2233 - DNA, 300 bp, Homo sapiens
cccagaggccaccaatggcaatagtagccgaagcgtacctgtagttcagcttttgacatgtgtgtaaaacatgtccattaacatgtgcttaatctgttctgtgaaagtattttcagaaatgataaaaagtaatgatggttacatctgaatataagttagatcatgacactcactccttttttcagaaactaccagtggcatcacatcttactcagagtaaaaaccacagtgggcttactgtgggctgcaaggcctcgtaggatttgccccccatgactttctgacttcatctcttgtcac

SEQ ID NO: 2234 - DNA, 300 bp, Homo sapiens
cttttctttgcagtatgaaggtagataattcttcaagttaaagatggacttttttcaccagaaatggctttatggaatcaatttgcaaaaatgtaagaggtggcaaaggaaagaataaaataatattttcattttcttctgttattcttagatcctttggtagattgtaaactccatgaaagcaggataccttcttttgccctaaggcttggcccaaaagagataccaaaaaaatacttgcttatatactaacctagtctctgggtgtgggagccatagagggttcagggtggggtggtg

SEQ ID NO: 2235 - DNA, 300 bp, Homo sapiens
ccctgccttttagttagcatatgcccttcttctcccccttgtagaagcagtaggggacagaaatgataagtcatatatggccggtgagtttttcttccaaagactggtccacactagagggtgcagcctccacagacactgggaattgctcctgacctatggaaaacaactttctttccaagaaaattatttttagtcctttggtgtaaagacacagtcctgagttgttttcacttactgaattctataactaggaatgaaacactatactcttgctaaaaatgaccttttttctttcag

SEQ ID NO: 2236 - DNA, 300 bp, Homo sapiens
gtaaacatacaataaagctgaaaattttagtgactacttatatgctcatcatctagattctatccttgagtaatctatttttataaaggtattgatgtaactattttataaatgaaaaactacacactaaaaaccaaatatgtgatctccagcatcacagaaatgaaataaggatttttttttaacttaggtaatattgcttgaactgtagtaattcaaatgtagcaatttcaaaggtagaatttcccatgtattactatactgcttcacatcagctctattaataaaagtagaacagtt

SEQ ID NO: 2237 - DNA, 300 bp, Homo sapiens
gggactacagctgtgtaccaccacaccggcctctcctggcttcttaaccacttacattaaaattgagaggagaaaggcattttcagtttctttagttaataaaaagaagccatttctggaggagttttatgcctgtaccagcagaggttcagctttccaggaatctcatcatgatccatactgctgacacaggcctttgtcacctgaagcattcttaaaataaggagactgacattaaacaggacaattgtgaactccactttgtaagcatcatacatatcttacaactcattctgaaga

SEQ ID NO: 2238 - DNA, 300 bp, Homo sapiens
gcctgaccaatatggagaaaccccatctctattaaaaatacaaaatttttaaaaaaaatacaaaattagccaggcgtggtggcacatgcctgtaatcccagctactcaggaggctgagccaggagaatcgcttgaacccgggagacggaggttgcagtaagccgagattgtgccattgcactccagcctgggcaacaagagcaaaactctgtctcagaaaatatatatatatccctaaaactacctcagttgaagaattcaaagtgcaaaataacttttcttaggattttttaatctatt

SEQ ID NO: 2239 - DNA, 300 bp, Homo sapiens
ggattacaggcacccgccaccatgcccagctaatttttgtatttttagtagagatgaggtttcaccatgttgaccaagatggtctcgaactcctgacctcaggtgatccacccacctcagcctcccaaagtgctgggattacaggcgtgagccactgtgcccggccccagttaggcttttgcaattacctagatcagagataatgatagctgtgactaggaggacagtggggaagtgacagagatggaacaaagcctaagggcctgtgagaggaagacccaggagtgaatctcaggtttc

SEQ ID NO: 2240 - DNA, 300 bp, Homo sapiens
gacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcatgacactctgtggtatcaacagaccaggaaagtgctgaggaaattcccattttaatcatcgaaggttttcttctttttaattataagcccctttgacacta

SEQ ID NO: 2241 - DNA, 300 bp, Homo sapiens
ccggccgctggggactgggccctgctcgcatgccgccccgccctccccccacctccacgactatttattgagcgcctgttgtgtgtcacggggctatgagggccgtggggtgtttgggtggattatccacacaggtcccggcccctgcccgggctggagttgccacagcctgtgctcctggtcctcacctggaggggccagcaggctgccgtcccaccacacgtggcctctgcgcccagcacggtgctctccgacagtggtgtctgaacccttggggacgagggcctgggccgcggtgag

SEQ ID NO: 2242 - DNA, 300 bp, Homo sapiens
ggaggaaaaacagtgtcttgcacacagcaagcactcaatatttttggccgttgaactttatctgaacctcccttagagcatctattgtagcctgcttggtattctattttctcataggggcctcagtgtctgtagcccccaaagcaggggcacagactctgttagttattgatactgcttgttcgtactgaagagtatcaaaaggtggggagaacattgaaaaccaaagcatcctgagtacattcagtttgctgttttccaagacagacattccagatatatagaagccaaagtcctgtc

SEQ ID NO: 2243 - DNA, 300 bp, Homo sapiens
gtgtgagttgcatataacatatataaaagctgtaacctgggaaaaagttattatctggaagctttagaaattaatgttattctttcttaagtatcatcaggaaattaatcaaaatggccaccttgataccaaaaataaggttttggggcataacatccttatgaattcaaatgttagtcatttcacatatcttccactttatttcattaagtccttcctagtagacactgttcaaacattattcaccatttactaatgctgttacaacattattttagaagatggatatggatagctgtt

SEQ ID NO: 2244 - DNA, 300 bp, Homo sapiens
gcgggcacggcggtggctcggtctcccggctgcgcgcggagcgggagggctctcctcacacaagcgcttccttgccgagaggctggagctgcggcaccgcaggcctgagccaccccttctctgctgtctccttctcttcctcagggctcccgtgtctgctcgccctccgacgctgctcagactatggaaatgatgttagacaaaaagcaaattcaagtgattttcttattcaagttcaaaatgggtcataaagcagcagagacaactcgcagcatcaacaatgcatttggcccagaaatt

SEQ ID NO: 2245 - DNA, 300 bp, Homo sapiens
ctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaat

SEQ ID NO: 2246 - DNA, 300 bp, Homo sapiens
gaggaaagcggtgcgtgaggcgggcggccagggcacgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagag

SEQ ID NO: 2247 - DNA, 300 bp, Homo sapiens
  misc_feature 146, 153, 159, 164, 166, 182, 195, 204, 221, 233, 237, 243,253: n = A,T,C or G
acattgtgttgcatcttataacttgtatagattgagctgattgaaataagattttgttccaagtattatctgatagaatacaagatgattcaaaattatatagatatttaaagcttttctgctgttttttttttttaattgcaacngcttttntgccgngcctntnttccctacccaaaagngatgagttctgancaagacaanactgtcatattgtaaanactttggtatgngatnccatanaatactgatnggatagccatcctagtcacttaccaatactgactaaaagttaactct

SEQ ID NO: 2248 - DNA, 300 bp, Homo sapiens
  misc_feature 282, 286, 289: n = A,T,C or G
attattataagactaacattctgataagccatggtataattaacattattaaaatgtttacatataatccttcttaaagtatactcttttaaaaatccattgacataaccttacttttagtttagtgatccagaatttccccagagcttaaagccactgcagtaaattagggtacgtaggatattcagtcgctactagccccaaggagtctccttatttaatggacctccctcagtacttaattcctgcagagcgcctcaaagtgggggaagagaaatgaancaantcntgggctcaagt

SEQ ID NO: 2249 - DNA, 300 bp, Homo sapiens
ctcagtaacccaattactagtaccttttgaagagaccaggctgggaattggtattaataataatagctgacatttaccaggggctacccacatgccaagcatcatgctaatcttgccaggtccttctgagtcagtgtgaatggcaggagcaccacatgttcctttctcttcagttcacacacattgagtgtcttcatgtgtaagtaacaacagagactgagggcatatgtattgtgtaaaaaaaaattttgttactgggaaaatagccattactgggaaatagctttgttacagaaagtc

SEQ ID NO: 2250 - DNA, 300 bp, Homo sapiens
gtcatgatcaactcagtataggttttcttaaaaaattttttcttaaaatgttttttaaacttcaaataagtttggttggtgctacagatttaaatcgacttgtttgtgaggataatagaattctttttgctatgaacttatcagtcagcccagcgtctgtgagacggtgcctgcttgcatggtgcagtccagagtgtattttgcaaacgtctagcactgcctttatgtaggacgcgtgcttcgttttattggtctaaaatttcccatgtcataacactttgatcatgccttagagaagtc

SEQ ID NO: 2251 - DNA, 300 bp, Homo sapiens
ggacaaaccatctccagagccttaatcgcatctgtaaagtcccttttaccatgtaaattaatattcatagtttctgaagatcaggatctggatttcttttggggcaattattcagctaaccacatattataatgaggaagcacttcttgggaggcatcataatgcttgttttttcttttcctaaatagagtatcacttttacccaaatggaataactcgctgggttattttactgagctcttgatgctcatttctttggtcttctctgtgatgaattaatgtttctatatggacatcatg

SEQ ID NO: 2252 - DNA, 300 bp, Homo sapiens
tagtagagacggggtttcaccgtgttagccaggatggtctcgatctcctgacctcgtgatccacccgcctcggcctcccaaagtgctgggattacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaatttttttttcagtatgcaa

SEQ ID NO: 2253 - DNA, 300 bp, Homo sapiens
gggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtgt

SEQ ID NO: 2254 - DNA, 300 bp, Homo sapiens
caggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaac

SEQ ID NO: 2255 - DNA, 300 bp, Homo sapiens
ctttgggggacacattcaaactgtagcaggaagtatttgctttctcataacatttttttaattaattaattttcagcgtttgttatatcagaatggacattatagcaatttccatggctgtgtcgctcctggcagattttaaagttcttccagcctgattcctctctctgtttgggtctctggcatggtgcctgctggagagtagatacttgataattatctattgggttctcaggggatctctcaaaggtggtattcaggcacccacaaggcaactcccatcacaagaaagaatggtgg

SEQ ID NO: 2256 - DNA, 300 bp, Homo sapiens
aattcggcacattgggtaaggctgtgttctttcctttccttcattaattcagtagagatttactgatcacctaatatgtaccacaaaaaaatgttctagatacttacaacacattagtaaacaaaatcgtaatccctgcctccatggggcttactttctagtgtaaggagacagacaacaaacaaaaagcctcatatacagggatattataatatggtatgttaaaaggtgataagtgcaacatagtaaaaaataatgaaataaggcaggataaaggggtattgggtgtgatagggtggc

SEQ ID NO: 2257 - DNA, 300 bp, Homo sapiens
aaggctgagacaggagaatggcgtgaatcggggaggcagagcttgcagtcagccgagatcacgccactgcactccagcctgggagacagagtgagactccgtctcagaaaaaaaaaacaactaaaatatgggtattatgcccaatccaaatttcaaaaacgtgattctaagtgaaagaaggcagatgccacagaccaggtattttctagtaccattttaggaaatgtccaaaaatggcagatcttcagaaacaaagtaactgcaaatgttacaaggaatctttttagggtgacgaaaatg

SEQ ID NO: 2258 - DNA, 300 bp, Homo sapiens
ttttagaaatagaactcctgtagatgtgtagaagagtgatgggaaagagaaaggactgatgtccttcttttcattgaaaaagatattgtttaggtcctacaatggcttaggtatggtttgagactctggggttacaaagcaaagaaaacctggcctctgccctgctcagagaacagcagggatacagcatgttagcaaataagtatatagtgtggaaaggtctgtagtcaatagcagtcattttgacaataggaaaaggaatgtgtgaaacttctgggtctgtgtgtgtgttggggttgg

SEQ ID NO: 2259 - DNA, 300 bp, Homo sapiens
agagcgagtctctctttgttgcttaggtttgtcttgaaatcctgggttcaagcaatcctccctcctcagcctcccaaaatgctgggattacaggtgtgagccaccacacctggcctctactttcttatatttccttaaatagatttcctttctttttggattaagaaaaaataaacagaaaattaaaatttgaacatattataaaaatgaaagataattgtaaaatcttggtttggagagtgtctctctgagcccagaaatcatccagaaaaatggacagatttgactgcatcacattta

SEQ ID NO: 2260 - DNA, 300 bp, Homo sapiens
gtcctggctactgaggaggctgatgcaggagaatcatttgaacccaggaggtcaaggctgcagtgagctatgattgcaccactgcaatccagcctggacaacacagtgagaccctgcctcacaaaaattatattctgattttctgagtccatgaacacattgtccaaatggatttttctagctcctccaagttacagatagttccacgcacacacagaactcaccactctcaaatattttccccactagtattactattaaatttttcaaacatgcaaaagatgaaagaattgctcagtg

SEQ ID NO: 2261 - DNA, 300 bp, Homo sapiens
gttggccaggatggtctcaatctcgacctcgtgatccgcccaccttggcctcccaaagtgttgggattacaggcgtgactcaccatgcccagccacttagttttttcttattcccacctttctatcccatataacactcttttttatcttccctgaaccatattgatgatataaatagggctgggggctgggccccgctggtcactcaacagagtatttcccttggccgacatggaagttttgacccaatagatgagctgctgagtatcaacaaggtgacatttttctgctgcccatttg

SEQ ID NO: 2262 - DNA, 300 bp, Homo sapiens
aaataagcttttctttaaattaattagaaattacttgtaggaaatgtatagaataacaatgatcattttttttaactaaatgatttacaatagtgagaaagttgaccttgagttacatgttgaaagaatagtatgtaagctggcaacagaaattgaaattgagacagatttcagcaccactgttggtaacaggctcttattccagaggaaacatgtcagttttttattagtgagtaaaggatttctgcgaagctttaagaatatctcatgttgagtattgacatgtattttgaatgatga

SEQ ID NO: 2263 - DNA, 300 bp, Homo sapiens
tttgtaggcaatggaaagccaccagtggttttagttgagcagcaatgaaattaagcctgtgctttgcaaagattaatctagcagcaacagattggaagcaacaccaccattcctggtatcagtccaggtaaaatatattacagctctttactggagcaataacagtaatattagaaggagaaataaaaaagaaaaatattgcacaggcagaatggggaggtcccagtgatggagctgatcttggttcattgaggcaggggtggcattaatcatgtaaaacacaggaggaggaactgggtt

SEQ ID NO: 2264 - DNA, 300 bp, Homo sapiens
ggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagta

SEQ ID NO: 2265 - DNA, 300 bp, Homo sapiens
ctaatatccagaatctacaatgaactcaaacaaatttacaagaaaaaaacaaacaaccccatcaaaaagtgggcgaaggacacgaacagacacttctcaaaagaagacatttatgcagccaaaaaacacatgaaaaaatgctcatcatcactggccatcagagaaatgcaaatcaaaaccacaatgagataccatctcacaccagttagaatggcaatcatagagcttttcatttatctgagtgttttcctctgcttgtcgggacttgtgctttcacgagctcctgctctcatatcaggg

SEQ ID NO: 2266 - DNA, 300 bp, Homo sapiens
cttgcaaagtatataatatctaagaggaaaggtttggaaataagctactgcattggtcttaagctagtccggcatgtgaagaaacaagaatttgcccagaagaggactgtggagaaacctctgaggcctccttccagagtaaggccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtg

SEQ ID NO: 2267 - DNA, 300 bp, Homo sapiens
ctgacatgactaccttagggatagagctaagggataataacttgcactaaatacatttaaatacttgattgcatgagtcagtttattgtagtttttgatttctgtaaaataagagaaacttttgtatttattattgagtaagtgaatgaagctatttttaaataacgttagaagaaagccaagctgctgctgttacctgcagaactaacaaaccctgttactttgtacagatatgtaaatattttgagaaaaagtacagtataaaaatagttattgaccacatgctaccaggctctgcag

SEQ ID NO: 2268 - DNA, 300 bp, Homo sapiens
tgtattcagaagaaagcaaggatagaatgagtataactctttaaaatttggaggcaaaattggctgtgagttgccatggagataggagcaatggatgtccaaggtctgaggaaatagaaactgttcgaaataattgcagagaaagcttgccaacggtgataagtaggtttgtctagcagcactgatgcgtcgtggaagttgatggtcatgaacatacagtgtgataacctatctgccctcttgaccttttctagtagtgctatgtcattttggtactaaggtaggtgaattttccaagtg

SEQ ID NO: 2269 - DNA, 300 bp, Homo sapiens
ctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgtagagatacccccattctgccattctctcttttgtggcctgggtttcacttgtaactaagtcattatccctgtatttggtttgcttagtacatgtctgtcctcaagcaggggctggcttcaggctgct

SEQ ID NO: 2270 - DNA, 300 bp, Homo sapiens
aaaaggagccagaacttgatgattttgaaaattctcagcctttctggttggcagagggtgatgaaattgagacacggcaaagatcaattcaagagccactccggggagaatggcggtctaaagataaagccaagactgtgcctttaaagcctgctgttaagacctgagaaggtagtgccttagcatcctcttcagtcacactcaaggcctctccgtcaaacaatagggcttctagcctttttagcaggagcccaaggtagaggtagaagagttcctcttggagagatctatgggtatagc

SEQ ID NO: 2271 - DNA, 300 bp, Homo sapiens
cttacctcctagaacattacctcctagaacactgtgtgccctgcagagccatcgacctttattataggccacgtgccctcggaaacttgggacagtactgatgcgttctgttgagtgcgtttggcatgtgggaattgtgatggtgcacagtgtcttggccttcactgggttttgtaggcacactaaggtttccatttcattcttcttcagttgccctggcccagcctgggtctctgggtagagcacctgcaggggcagtggacggcctgggctcagggtcggtcagcacctgagaccagc

SEQ ID NO: 2272 - DNA, 300 bp, Homo sapiens
agaagctccactggcacttttgtattcacaactaccgggtgcgataaggcagtgagggttattatgataccccttttcacaggtaaggaaacaaggctcagagaggttcaacaacagagtcataattcttcttgttggagaattcattttgttacatttcattcccaccatctgcagtaagggagacccattaaaatatagtatcctgatttttaaagagaaggtaacattaaggccaggaggtttgggatttgcccaagttcactgtgggcttctggactcccatgcccaacagcctcc

SEQ ID NO: 2273 - DNA, 300 bp, Homo sapiens
cttgaacctgggaggcagaggttgtggtgagccaagatcacgccactgcactccagcctgggtgacagagcaagactccatctcaagaaaaaaataaataaataataatttgtgtatgtgatgactgactctagtcattatggaaaataacttttggcagtttagttcctacttgttaacaattcctctttttaagagaggtactacatttgatttctcaatttctcagtttgttttcaatacaaacagcaaccactgaaatgcagaaaatggtaatcaagtgtgatgtttctataaaaa

SEQ ID NO: 2274 - DNA, 300 bp, Homo sapiens
cccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtc

SEQ ID NO: 2275 - DNA, 300 bp, Homo sapiens
ggttattgatcattgcacagggctgttggcaagtttggtgtgcaaggtttggatagtgcctggttttcactagggttttctgaaaaccagcagaaacagggggcctgaaggttgttagagtaatgagcttgcagccaacatattttagctctatcaaaaaatgcctgttagtgctcacgggcatgtactgcgagagagatcttgaatgcatcactttggtatcctaagaagtgtaatttttttccctcgtcatactgggctgtgtttagacctcgtataatacataatgaatagaaacag

SEQ ID NO: 2276 - DNA, 300 bp, Homo sapiens
agtttccatttagtttgattttaaaagctgccttttgaatatctaataccaattataaaataaatatgtgtaagtaaaataaaatggtaacttgttttttataagaggggaagttggttggttttataaattaaatgaacatttatgcggtcggttatttttacgtaaaaatagttgttatattctagggtaacagaaatttagaaacctatttttctgtagaagaaaggtgttgctatctgcttttgatttctcagatatttgcttctccttagaatgctatgatcagatttttattag

SEQ ID NO: 2277 - DNA, 300 bp, Homo sapiens; identical to SEQ ID NO: 1256

SEQ ID NO: 2278 - DNA, 139 bp, Homo sapiens
gtggagctcacctatttggaatatggggcatttgttttttccactgcaatgatttcagtctggtttcatcatgttggaattcgatcacaccattttcaaacaatgttaacatagtccagcttttgttccgtttagggga

SEQ ID NO: 2279 - DNA, 239 bp, Homo sapiens
cacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggaggtgtgg

SEQ ID NO: 2280 - DNA, 300 bp, Homo sapiens
ccttgaggcacatcacagtttgaaggacctgtttaagttgaaatagactttgcttatttattgggattctaaaaaattctgagtgagtttgcagtatgagaggaaataagatttcctcctccttcctctcattttatattgactgtttgccagaaactgttttcttctgttttcttatattttgtttttgagatggagtctcactctctcacccaggctggagtgcagtggtgcaatctcagctcactgcaacctctgcctcctgggttcaagtgattctcctgcctcggcctcctgagt

SEQ ID NO: 2281 - DNA, 300 bp, Homo sapiens
  misc_feature 264, 269, 291: n = A,T,C or G
gcaaaaacctacatacctgttattcctgtttgtgctcctcgcaatcctttaagataaggggggcaggaattaatatctccattttacaactgaaactgaaaattagaggacttcaatgaatgaaaaatctgagtagcttatcctaccaagtggcagattagttcatgattccttattaagtgataggacttgccaaacaccaggaatctggggaagaagtgtactcaaagaagtatgcttggaccaatctgaaaaaagaaaaanaattnagttcaaactgattgagtaacnattcacagt

SEQ ID NO: 2282 - DNA, 300 bp, Homo sapiens
gcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtggagatgtggtttctcca

SEQ ID NO: 2283 - DNA, 300 bp, Homo sapiens
ggggcagtcaataataatagggaggatagaaacgtcagcatggcattccagatgagaaaactgaagcaagttaaactttctacatggtaaccgtgattatgtagttgatatacaaagtattgactgtgggccttcaagaagaggttaaaatacattcattatattaacgagtgcatcttacaaagatttctttcaaaaagtacttgaagtttttttgctttaaggagtaaatctcaatcatctggaaatttaacttctgtggaatacctctttacatcttaaaggaaatgttaatgcatt

SEQ ID NO: 2284 - DNA, 300 bp, Homo sapiens
aagatgtttgattcttcagataacttttgaaatgtgctataaagggcctagtttaaaaggaacttcttttgaaaagcaattaacagttgataaagggttaaataaaaattatctagtaaggaatttcttattggaatgtaaacgtggttctaattttaaatagacagtgatataaagaataaaaagtaaacagtgaaattgagttctccagggaaaaggcagacctgtttagtaaaaaaaggatgcttttttcagtgatgtctttttttgagtgcatatgtgtgtgactcttgaagaaat

SEQ ID NO: 2285 - DNA, 300 bp, Homo sapiens
atccaatatttattgagtgtctattaggtgccaagcaccttaataggtcctatggatttgaaatgccgtccctgtcttagatctcacggtctactggaggacacagagaagtaagcaggcagttgcagtacaatgtaacactgagtgctgtctgtgtatgatgctgaggagggaggttagcctgagccggggaagcggagcttgcaatgatcggagatcgcgccactgcactctagcctgggcaacagaacaagcccctgtcttaaaaacaaaacaaaatcttcagagcaggcttaaaaa

SEQ ID NO: 2286 - DNA, 297 bp, Homo sapiens
  misc_feature 7: n = A,T,C or G
ttttgcnaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagt

SEQ ID NO: 2287 - DNA, 300 bp, Homo sapiens
actgaactaatatcaattttaaataatattgctattcagcttcaaaagacagagcctccagcatattattattattatagtaatctgattctttagaattcagagaactcacctcattagtgctcccttgctctatctggccctgtgggaaaatacccttgcatctttctatgggtatggtccactgtatcccatcatgactttaacatttttgaagtattggtcttttaaagtaagcaaacaaattcccttgttacatcaaattcaaatacagtaatgcattacaggacaaattaaagg

SEQ ID NO: 2288 - DNA, 300 bp, Homo sapiens
gcctgtcgtcccagctacttgggaggacaagtcatgagaatcgcctgaacccaggaggcagaggttacagtgagctgagatcgcaccactgcacttcagcctgggtgacagagcaagactccatctcaaaaaataaataaataaaataaaataaaatataaagtttgctccattgttgacccattgctgctgataaaagtgtatactggaatgcatgtaaaccatatatttaaaatgtataggctgggcacagtggctcacgcctgtcatcccagcattttgggagaccaaggcaggtgg

SEQ ID NO: 2289 - DNA, 161 bp, Homo sapiens
gtgtgttctgtgggagggtgtctgtggggatgtgactatcagggtgggcctgtgctggggatggggcaggcctgggtctggagaggattttgtgtgaaagtaaatggggtgtttgaggcgtatgggtggctgttggtgtggggaggcatctgtgtatggct

SEQ ID NO: 2290 - DNA, 300 bp, Homo sapiens
taaataagttgatattaatgatataagcatcacacaattttacattaagaaatactgtgcaggccatgcgtggtggctcaggcctgtaatcccagcactttgggaggccgaggtgggcagatcaccggaggtcaggagttcgagaccagccttgccatacatagtgaaaccctgtctctactaaaaatacaaaaattagccgggcatggtggcaggcacctgtaatcccagctactagggaggcttctgaacccaggaggcagaggatgcagcgagctgagatcgcgccactgcactcca

SEQ ID NO: 2291 - DNA, 251 bp, Homo sapiens
ggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgagaaaaaaaaaaaaaaaaaaaaaaaaaaaaaaaaaaaaaaaaaaaaaaaaaaaaaaaaaaaaaaaaaa

SEQ ID NO: 2292 - DNA, 300 bp, Homo sapiens
ctggaattagtggcttgctgataatctcattttataatttgttcagcaatccagcaagaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatac

SEQ ID NO: 2293 - DNA, 300 bp, Homo sapiens
atgactgagtgtataccctagttaaaatgatcaggggagacttaactgaaaggggtaattgagctagatttgaaggatgaggagtagcagactagtcaaagaaagggagagaagaacatacctaaacatctgatcaccagtgactgagaaagttatcaggatcaagtggaaagagaaaggactagcagagttacaggttagagaaacaggtaaaggctactatggacggcataatagttgcatcccatgttttgtctcttaagaacagttgcaaactattgaaggttttaaagctgtgtg

SEQ ID NO: 2294 - DNA, 300 bp, Homo sapiens
attgtcttgtgttatggtgcttcagcattggattcagcagccagcttcctagtacgaaggcaacgattacctccacagggtcccttccattgtcctcctgcatcattttcctccaacttgaataaatgttctacccacctttctcctttattttctctaccccctgtaccccgctccctctcacaattaactctacagcagaatgtgaattctctgattttagaataactattttatggtaacttcaaatatatcctagttgtatccacattcagcttgggtaggtaccttcatagtagc

SEQ ID NO: 2295 - DNA, 300 bp, Homo sapiens
caaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccctgcacggggccctccttcctcccagcagcccttggtgagctaggaattgagatccctgtttgtgaaagagggaactgaggtgcagagaagccagaggtgtgccagatccttaggcaggatttagatgaagtcgccctggc

SEQ ID NO: 2296 - DNA, 300 bp, Homo sapiens
aaaacacatgcacacatgtttattgcagcaaaccaccatggcacatgtatacctatgtaacaaacgtacacattctgtacatgtatcccagaacttcaagttaaagaaaaaaagaaaaatatattagtttagcaacattcaaccttatcctatataaattatgctaagaactttgttagataaattctattataaaaggtcctagctagtagtattaaatttgttgttgttgtaatttatgtacaacaaaattcacccattttaggtatacagtttgaatgctttttggtaattatataa

SEQ ID NO: 2297 - DNA, 300 bp, Homo sapiens
tgagtacttatgaaaaattgtgagaaattcattgtgtgggattttcaccattactacatgtatttggaaataaaaattgtatgactatgtatatgaaacttgttcatgttctaaaaaataccctccatttataatatgtttttaaaatttgccactgagaagtacaaatttccttcttatttcatcttagttatcaacccagagtcactggaggcaatgcagtgtagtggttaagcgtgcagattctgaagttagacaagatttgggttggaatcctgactctgccacttactagctggg

SEQ ID NO: 2298 - DNA, 300 bp, Homo sapiens
acctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattgga

SEQ ID NO: 2299 - DNA, 300 bp, Homo sapiens
  misc_feature 271, 272, 273, 274, 275, 276, 277, 278, 279, 280, 286, 297,298, 300: n = A,T,C or G
ccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcataaaaggannnnnnnnnncaaggnttctacaaggnngn

SEQ ID NO: 2300 - DNA, 300 bp, Homo sapiens
ctgggtcatgaaataacagattaaaaatgttctctggtaaaagaattaaacatttctgtaaatggaaggaaaataaaaagatttcagagagtctgatcaataatagcttgtgggtcctagtgagtggagcagtgtataaagaggtaaggtttttgagggaaaaaaatactatgtcaaatggggggtgaatgataaaaatcgctctcattttcctttttttcacctttcatcttcatttatggaatttctatacaataaatatgtttggcatttaataacagtgcctctcccccggaatac

SEQ ID NO: 2301 - DNA, 300 bp, Homo sapiens
acgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaa

SEQ ID NO: 2302 - DNA, 300 bp, Homo sapiens; identical to SEQ ID NO: 229

SEQ ID NO: 2303 - DNA, 300 bp, Homo sapiens
gtattcatgagaggcaagtgataggttactagggatggattgtgtgggagaaataatgcagaggaaatgatgatcatctccattgaatgacagctgttatatagcaaagataaatgtaaaattagtcttattcttggaagtggaagacagcagttatcagagaggagaatttaatcaaaagaatcagaatagcatggtcacaggccagattcacattgaagtatttactctatattttactgctgttacattcaaaatgtatcagaagtctcatggttcaattaataaagtgttattcgc

SEQ ID NO: 2304 - DNA, 300 bp, Homo sapiens
tcattgtgtaataaaatggcagtttccaaagatggatgtctttagtttttaaatgacatgttgatttttttcatgatatctgcaaatatttttgtcttttttgacctcagaacaaatgtaaagcattgattggagcacacacaaaagttaggaaatatgctgcttggcaactgagtaaaagtaaatatatagtctcttaaacttccaaaaaagtatacaatagtacaggatgggttctattcacaagctttctgtctgtaaccgtaaaagatatcactatctaaaaataatatcagaatg

SEQ ID NO: 2305 - DNA, 300 bp, Homo sapiens
ctgggtctcaggcctttgaactcaaactggaactacatcactggcgctcctggtctccagcttgctgactgcagaccttgaaacttctcgggctccattaacctcttttatatatagagagagatacatacacacacacacacacaaacatacacacacacacacattggttgtatatctggagaatcctgattaatatacccgataaattcaaaacaaaacaaaacttgaaaaaaaaatttttcaggtgaatatttgttttttagcatctgagtttcagtccaaacagggaaggaaaga

SEQ ID NO: 2306 - DNA, 300 bp, Homo sapiens
tgagacagagcagccccagaacacacaccggggagtacaggagcctaggccacgtacccaacattgcaggcagagaaaaaagaaagtgtattccatgtaagcaaatgttatttggacctttctctctgtctgacctaatcatggctcacagaaagtaatcatactcctaataatacatcaacttatctgatttatccacacaatcacgtagattaatgtatgcttctatttcctggtcgctttagcataatattgatcataaattgataaataggaataaaacaatataattagattaat

SEQ ID NO: 2307 - DNA, 300 bp, Homo sapiens
caaaaacaagcaaaacaaaacattttaattgttatgcatagtatatatgtgcatttttgttaaattaagacttataatctcataatgatcatgatttcccccaaatgctgatgatgaccaaatttctatttctgtcccagaccttgaacccccagcctaaaaatcagattgcatattggatgtttcttcctggaagaatgtcaaactgaacaagtctgaaactgatctttgtgcatcacaacccagccaaacctgttacttctcctacattccctttcttggtgattggcttgtccaccc

SEQ ID NO: 2308 - DNA, 300 bp, Homo sapiens
agttgtattaggatctttatgtgtggccaactcattaaattttcagattaactcagaaatattgttcctttattttgcacatgaggaaactgaggctcatatgtttttttcttctttattttttatttttagagacagggtctcgtttcattgccctggctggtctcgaatttctggtctctgggctcaagcaatcctctcacctcagcctcccagttacttggaggatgaggtgggagaattgcttgaacctgggagggggaagttgcagtgagccgagattgtaccactgcactccag

SEQ ID NO: 2309 - DNA, 300 bp, Homo sapiens
gtttactttgttgtctttggccctttatgcaatcagtgtaaaaggactagccgtttctggccctacactaaagcttatttatatttaaatcagtgattccaaactttaaatgtataacatcatgttaattttgtaacatcaatggttttctttaaaatttcaagatatttatcttgttacttgtattggacagttctaagaaatcttagagggataactgtcttacctgttttttaaaaaagatcagcttgcaatcttctgcttcaaccatatctgtattagaatacagtattatttcta

SEQ ID NO: 2310 - DNA, 300 bp, Homo sapiens
gatcaatccaagctcctaaacatggtattcacagtacagtcctaaaaacaccatccccaacttgctgtaaacccaaaatggcgggggcctcccagatatcctatgtctgtgcctttgtaccagctgggccctctgcctgcaatgccatctccatctcttccatccccttccaggagacgctagcactcactctctcctcctctacataccatcattcctcctcctgaagagctactctccctaactcacgtgtcacaacaacccacctgccattatcctcctcttcatcttcacaccggt

SEQ ID NO: 2311 - DNA, 300 bp, Homo sapiens
gacagctgaggcccctggaaggcagatccaactcctcctccagcgacaccactggctccttcacagcttcactccaagaaacttctagaccccccagggggtgtctcaagtgaaagtctggccccacatctacccccaaggatggcactggctaggactgcttcaggtctcggttaacctaggtcaaagtgtccttgggcgcaagtctgagttaggctgcagaaacacctgctacctcccccaggttcacactgacagctgccgggcctgggtcaggcacagccagtgctcaccttcatg

SEQ ID NO: 2312 - DNA, 300 bp, Homo sapiens
cctagttaaatcacaacaagttagtaatccataaatgatgtgtcctgtttctctttagtagaaattatatttttggctaccagttaagaaacttgtactcctttgtcccttatgttactataaactcaagatgatgagttttgtggtatttgacttcataggcaaaatcaaaatttttactttgttgctattctgttttatgaaataaacttctgtctatgcatttgaactaagtttcagcaaattcaatctaaattgaataattccagctcccagttttatcctatgttgctcataaaa

SEQ ID NO: 2313 - DNA, 300 bp, Homo sapiens
  misc_feature 272, 275, 279, 288: n = A,T,C or G
gtcaggctctgctggacactgcatgtccaaacgtcattttacccatgtgccagcgacaaggtagattcgcttgtaccaattttgcacataaggaaacagccttagagaggttaggttgcttgtgcaagcccagggtaggtggcacccagtctgccaatctgcaacgcactggtatcttccagccagtagaccttgctccctgggtgcccagttctggatctcaggaaaggcggattaaggctcctaatggcgggacctgggtggggatttgntgncctntggtggcanaagggacatcac

SEQ ID NO: 2314 - DNA, 300 bp, Homo sapiens
gaggattagccatgctggggtctcttggacaaaaggctggtactgattgaaaaattccctgagtatgtctagaagtgtcaggctcctctggaatcagttacagtgggattggctgcttaggtataatctttataagattaaaaattatagattatttggcagcttgtttgaaagtgttggtcccaagaaaaagttctgctgtgtgttatggcagaattattaaaaaaaatacattcttaagttgaggtttctaagtaggcttttgtaaaaacaggcaattacttgctggaggcagttaat

SEQ ID NO: 2315 - DNA, 300 bp, Homo sapiens
attcgatttgggtcgcaattacacagacattgacgggcaactggagcctcccagggactcctgcacgagagggagttactgaagtccctgcagagtgactgttttcccctagtcagtgcctccttttcttcaggtctcaaggacgggatgagcttgccttggaaagctttgagggagtctcgtattttaccttcatagcaaaagttgtttccccacttctctccaccatttcttatttcttcctgacagttgttctggcacatctcttgatcgattgtagtattttctttctttcttttt

SEQ ID NO: 2316 - DNA, 300 bp, Homo sapiens
agttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactg

SEQ ID NO: 2317 - DNA, 148 bp, Homo sapiens
catccctggagcagcttccaacactacttcagggtggcagtgtttggggcactgggcgagcctgccggcctctagatggcctcatctcttccttccacaaactgtctagaaccaataaaaggaaacctgccaaaaaaaaaaaaaaaaa

SEQ ID NO: 2318 - DNA, 300 bp, Homo sapiens
tgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaag

SEQ ID NO: 2319 - DNA, 300 bp, Homo sapiens
ctgaggttgttttcctgttgttgttgttgtttttccttgagaggagttgcaagacgtgggaggctgtgggcagggttccacgggagaaggaggatgctgcatgtctgggacttgtgaggaggaagcactgaagaaatctatgtggcacacggaggtgttttcaggtgttgaaccatagggaggtctacgtgatttcctcattaggaggattagagagggcagagtcaggaaaccaatagaggaggcctggactaaatggtggtagtggatatgtctgaggctggggatcaggctctggtg

SEQ ID NO: 2320 - DNA, 300 bp, Homo sapiens
catcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccgg

SEQ ID NO: 2321 - DNA, 300 bp, Homo sapiens
ggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctct

SEQ ID NO: 2322 - DNA, 300 bp, Homo sapiens
ctggaaggggcagagcccaggacagggctccatgtccacaggacggcgaggagcgaagaccatggggactgagtacacagatgaagacacagaagcatagagaggataagtaatcactagcaagtggaagaaccgggattcagatccagaacaggctgactccagagtcactggctgtcatgtagtttcctcaactactgcctcagctctacaatcccagagtaaagctcttctccaaatgaagagccaggaagaggtagaggtggcaggaattaaactttgtaaagccatgtccctggg

SEQ ID NO: 2323 - DNA, 300 bp, Homo sapiens
cctaggctttaccctcaatactgcttctgcctgaccaaactgtctctctcctgtggctctgtgtgatgtgacttgtcctcttctccaaggcagtattactcataaattcttctttagcggtactgatctatctgtgtcatcgctcagtcaaccacatatattaagacctaggcacagaacaattctatttctataaaattctagaaaatgcaaactaaaccataatgacaaaaagaatattagtggtttcctagggatgggatgtgggcaaagagagacgaaagaaggagggattaccaa

SEQ ID NO: 2324 - DNA, 300 bp, Homo sapiens
gaaggaagaaaatttgggactttgttttaaaagtggaatactatcttcttaaacaacttgtgtttaaaacaagccccaatccacacttgatcttcttaagctaggaaaagtgagctcacactgagtgctggcaggatgctccatgtgcatcattattttgtttaattctcacaataactctctaaatcccttttgaggataaggagactggggctgggagaagttatttcaaggagtaaataaaaaattcagacccacttgggttttatgccaaaggctctgtttttacaaatacacaat

SEQ ID NO: 2325 - DNA, 300 bp, Homo sapiens
aattcggcagctccctcaaagaaaggagaactaggaaaatgttttcgccatctcccaaagatgataggaaagttctgagcagggttctgggtatagccccttgtgagaaattcaaggcccaatcaatgccatagatgagttatatattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagaccc

SEQ ID NO: 2326 - DNA, 300 bp, Homo sapiens
ctgtagtcctattttgccatatgacatgattgaaatcaacacctcttagaaatagttttgctgcctcataattgattaccatcatgataacctgtagtcagtgtgaaatagagataaaaattaatgtacttagttaaatgcatatgaaggtctaatcttgttccagagttactcttactggattatttttagatttttattaacattactggtctctaactttactcagtctggataagaaaaagaataccatgcaattgttaactatttgatgtttactagattaactattaatatatt

SEQ ID NO: 2327 - DNA, 300 bp, Homo sapiens
aatgtgtatgcggggctggtgggaacagcccgggtggcgggggtggatccctggtgtgagcctggcttcctgtctgctccaaggggcgtggaacaggacggactcaggtccaaatccctggtttcctgtcccttagtggtgtggccgtgggcaaacgccttaacttccgtgagctttgacagtctgtctgggaggcagggctcaggcatccctggcctcttggggttgggtgagagggagacagaggtttgtgaagcgctttgcacacctgggcatctggtcagtgttcagtaaatgcca

SEQ ID NO: 2328 - DNA, 297 bp, Homo sapiens
  misc_feature 223, 245, 258, 267, 275, 279, 283, 287: n = A,T,C or G
gggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcggtggcagcgatgacaacatcgagtccatggagcgcttcgacgtgctgggcgtggaggcctacagcccgcagtgcaancagtggacccgcgtggcgccgntgctgcacgcctncagctagtngggcgttnctanatgnaacngccctattta

SEQ ID NO: 2329 - DNA, 300 bp, Homo sapiens
taggatctttatgtgtggccaactcattaaattttcagattaactcagaaatattgttcctttattttgcacatgaggaaactgaggctcatatgtttttttcttctttattttttatttttagagacagggtctcgtttcattgccctggctggtctcgaatttctggtctctgggctcaagcaatcctctcacctcagcctcccagttacttggaggatgaggtgggagaattgcttgaacctgggagggggaagttgcagtgagccgagattgtaccactgcactccagcctgggac

SEQ ID NO: 2330 - DNA, 300 bp, Homo sapiens
agaaagagttgtgttggaaatttgactttggctaacccagaattgtatagtttctatatttttatttgtttttaatgttaccagatggtggcagtagaggtggcaaccttatagctccatctggcagccgggagcttattttagtcaacacaaactgtaaataccataccatagttatgttttacctggaagtcggacttagttccataaactgatcattttctgtggcttgtagtgttcaaattgtataatattcctcataaaataatatagaaatacagaaataaaagttataataaa

SEQ ID NO: 2331 - DNA, 300 bp, Homo sapiens
ttttttactatgtaccataatgtcccattcatgagaacctagaagtagtttttctcattagcgaatgctagaattttattttttttcacatagtgaaaaggtgaaattggtctgtcttcctctttactttagctgctagtaaggttgaaacaacgatggtgcccaaatttaacagttaggtgacatcttcttctacgtgtgctaagattacccagacttcactttacccttatttcccactgactttgatccctttacttggttttattctgtagtatggattttttgcatcttttcagt

SEQ ID NO: 2332 - DNA, 300 bp, Homo sapiens
gcaacgtgtgcggtcgggcgattccggagcccctgcgtggaggaactgctgggcgggaggagacgccggcggctcgggcgatggctgaccgcacacgttgccaccctgaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcacaggatgagatcagcaacctggtgaagttg

SEQ ID NO: 2333 - DNA, 300 bp, Homo sapiens
ccgctgcctgcacggcgatgagaacagcgaggtgtggcggagcctgtgcgcccgcagcctggcagaagaggctctgcgcacggacatcctgtgcaacctgcccagctacaaggccaagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcac

SEQ ID NO: 2334 - DNA, 104 bp, Homo sapiens
ggaagagggaagaagagaagctggttatttctagaggatgtcgtaatctacatcacaggcagaactgatggctcagtggctgagtggccagtatattgtctttt

SEQ ID NO: 2335 - DNA, 300 bp, Homo sapiens
ctggatccagtccaggccagagcctcctctgcagagaaggtactaggtgcccatgcacagggtgactgccagcctcgtggagtgggggcagtggtgtccctgcgggcgggcttggtcttctgaggccatgtcagtgccaccccagggccgccctccatggcagtgtggggccaacaagcctgtcttcccatttttctgagagaggctggaaatcctgttctttttatatataaagtgtttccttttcaaaatattggcaactaagtaaatccaaacaaagtatgggccaaatcatggcac

SEQ ID NO: 2336 - DNA, 300 bp, Homo sapiens
gaccaaggagatgtgagtgaaaatgatgcaggctgcttccaggtgtgaccagtaagatacttcccacataatcttcctactctttcttccctgtttggcatcccatgtgctaagaatgggaaccctgaggtcctatatgtggaaccataaggtaaatgtctttgggctctgaatctcacacagggctcactgagaataagaaacatccttcttgggctttgtatgaataagaaaatactagcaaatttttaagaaggaagtaattccagtatttcacaaacccttccaaagaatagtaaa

SEQ ID NO: 2337 - DNA, 298 bp, Homo sapiens
  misc_feature 235, 257, 258, 260, 268, 269, 272: n = A,T,C or G
gaacctttgaatagtggttgtacatacagtttttcagagctggtgtttaataacaatatttttcattctaatattacattattctttttatcatttaggtctttatccgtcagtgtttttagagaactactgcacttgaccacaaactgataaatacttggtactgccccatctcactgttctgtttactttgtcttaaatatctcttttttttttcccaggcagctagtacacnactgaatcctttaagctttcanngngaatttgnnaanctcaggattgaccttttacaagcctt

SEQ ID NO: 2338 - DNA, 300 bp, Homo sapiens
gaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacagccaggctggtcttgaattcctgacctcaggtgatccacctgcttcggcctcccaaagtgctaggattacaggtgtgagccaccacgcctggctaattttgtatttttagtagagatggggtttctccaaaggctggtcttgaactcccgacct

SEQ ID NO: 2339 - DNA, 196 bp, Homo sapiens
  misc_feature 165, 166, 169, 170, 175, 178, 180, 182, 183, 185, 190: n = A,T,C or G
ggatataaggccaagagacaaaaaagccatagcctgaaagatttagcaatggtggagtaatgtctccctgtgctgatacaagcatgaactttctggaatattctgctagtctgaaattacagcaggttgtctggggtaggggggaggcgtttttttttttttttnnaannagggnctncntnngnccccnaggggg

SEQ ID NO: 2340 - DNA, 300 bp, Homo sapiens
ttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaa

SEQ ID NO: 2341 - DNA, 300 bp, Homo sapiens
agcaaccctagcaatagactgactctactacaaaacaatttggttatttctcttactatttctctattatatctgttgagggaatgttatcatgagcacaggtattagtcctatgcttttaatcggtttagtggtttctttgtgtctcattttattcatttgtaatttttttaaagactataaaacttccacagtttctttagatcattaagttatatgactctttttcatgggggtcagttaacaatacataagaaaacatttgttctaggataatatatgacctaacagtcttttgtt

SEQ ID NO: 2342 - DNA, 119 bp, Homo sapiens
gctagttcgagttttttttccttttactctggtattgacacattttctgtgatcattgttaattagtgacatagtaacatctgtagcagctggttagtaaacctcatgtgggggaggtg

SEQ ID NO: 2343 - DNA, 300 bp, Homo sapiens
gttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaag

SEQ ID NO: 2344 - DNA, 300 bp, Homo sapiens
atgatgtaaagtctgaaatatacagctttggaatcgtcctctgggaaatcgccactggagatatcccgtttcaaggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagagg

SEQ ID NO: 2345 - DNA, 300 bp, Homo sapiens
caactcctgagacatacactcattgatgattcatcacgaaatgtttaattatattgagcatgacgctaggaccaggaggacatttggagaccgtattacccagaccttactttcatgtgaaacctttggaaaaggcacaactaaaaaactggacagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtga

SEQ ID NO: 2346 - DNA, 300 bp, Homo sapiens
gttttttaaagaacttgataaatttaccttaaaatttaaataaagtatactgaataactaagtcaacttagaaaaaaaaaagtgttatctaagacaagttacaaagccatcaccaaagcccatgatccggcagacgactacaagcatagggtcagatccatctataaatgagagcctgacatacttcatctatagcaaacatgggagacaaatcagtggtaaaatgatacagtgtttgggaagtgttatttgaaagatgggcttatttaatgtatacagatgaactcaattcctctgtaa

SEQ ID NO: 2347 - DNA, 261 bp, Homo sapiens
aaaaagaaaaaaaaaattagccaggcatgcgaaacgctgaggtgggaggatcagatgagcttgggaggttgaggctgcagtgagccttggtcatgccactactgcgttctagtctgggcaacagagtgagaccttctctcaaaaaaaaaacccaaaattgtaaaattacttctatagctatattttatgataaagaagtgattgtttctcaaaatcgcattttaaggacgttttatggtacttgttggaattgggacttag

SEQ ID NO: 2348 - DNA, 300 bp, Homo sapiens
aaggtgggtggatcacaacgtcaggagatcgagaccatcctggctaacatggtgaaaccctgtctctactaaaaatataaataaattagccggacaggcgcctgtcctcccagctactcaggaggctgaggcaggagaatggtgtgaacctgggaggcggagcttgcagtggcaccatcatatagctcactgtagcctcaaactcctgggctctagtggtcttcccacttcagcttctggagtagctggggctactgcacctggaattgtcttaatctgttttaatactattaaaatttt

SEQ ID NO: 2349 - DNA, 300 bp, Homo sapiens
aattttccttatatgttctttgacccttgaattacttagaaatgtattttttaatttctaaatacttacaggtttaaaaattttgttttcaattactaatttaattctgtttcatcagaaagcacgaccatcgtggcattgaaacttgagttatagcctactatcatgatcaatttaaaaaatatatatatagggctgggtgcagtggtgcacatctgtaatcccagtgctttgggaggctgaggtgggtgaatcacctgaggtcaggagttcaagaccagcctggtcaacatgacaaaa

SEQ ID NO: 2350 - DNA, 300 bp, Homo sapiens
aaaaaaaattgtggtgattcacacctgtaatcacagcactttgggaagccgaagcgggagggtcctttgaggccaagagttcaaggccagcctgggcagtataatgagaccctgtctctacaaaaaatttttaaaagtaaagaaattttaagataactaaatactacatagtcatatattttaaatatttattacataaaggtaaaccaaatagaagaggaaataatgttatgccctacttcatatgaccaaaaactggaagatagtgtctgaaaatgaaaatgattgtattgggaaggt

SEQ ID NO: 2351 - DNA, 300 bp, Homo sapiens
atgacttcctagctttacccggggttttttctgcaggtggagaagggtggagtcctcccagatggttctttctttgctcccctaacagcctttaagatgtggctacttgtttttcccaccgtttaacaccctccaacttcatttggagcacgggttcctcaagggatcctgagagctgggtgctgggtgctggtttggagaggcaggatgatgcttctcccggctggggagagcagagcaggaaggctggttggcgccatgaggaaagagccacgaggttttagctcccgaaccgactcg

SEQ ID NO: 2352 - DNA, 252 bp, Homo sapiens
cctggctaacaggtgaaacccggtctctactaaaaatacgaaaaattagctgggcatggaggccggcacctgtagtcccagctactcaggaggctgaggctggagaatcgcttgaacttgggaggcagaggctgcagtgagccgagttcacgccactgcactgcagcctgggcaacagagtgagactctgtctcaaaaaaaaaaagtgtagaaaaacttgactttaacttcaaagtttaatttgaaagttta

SEQ ID NO: 2353 - DNA, 300 bp, Homo sapiens
caggactcaagatgactttctaaggtgatttggggatgcagtgtatgcatttttttactctttttgaaaaaaatcttttcttcgcctttggagtgtaacatttggatagttttattcagcccataataggaccaaagggaaggggataaaaaaaaattctttaaagtacctcagataaaaaggttttgtgaagaaaaggactcaaaatcctaggttataccaagactttatgttcattttgaattttctttattcatttttttcctctctgtgtatagaataatcaggagatattggtgg

SEQ ID NO: 2354 - DNA, 300 bp, Homo sapiens
gggacattaccagtcatgcaaaccaatgtgcaaaatgcaggcgttgctgggagcccagaaggcctactggccagggctgtcgatgctgaatgtgcagcctgatgccagggggtgggccttgagtgctgcccagccaggaactcctcagcgcccagaataccaatgaccctcctttcccccagctccagggcctctgcttccctctcctttcccaggctctctttgcttttccctcctccctcctgggactgtaggcaaagcccctggcacggacagtgggcaggacagccagatgcctag

SEQ ID NO: 2355 - DNA, 300 bp, Homo sapiens
attatttaaagcttattcaatttaaaagactacttgtaattccggacttattctttaaatagttggtattaaggtttcttttgtaaaataagaggtggtagtatttttcaatgcccttaattaacaaaattaaaagtttgaaaaccatatgttgattctccctcattttaaaaaattttgtaattccactggtccacaaaaatcccaattgaggagagctctgggaagagcacattctgtcaatgggtctcaacattttggtctcaggaccactttacattcttatttaggaaatgacct

SEQ ID NO: 2356 - DNA, 300 bp, Homo sapiens
  misc_feature 161, 165, 181, 186, 188, 189, 191, 197, 201, 205, 206, 208,212, 217, 221, 224, 225, 231, 234, 238, 245, 249, 252, 256,257, 263, 266, 269, 273, 274, 280, 283, 284, 285, 288: n = A,T,C or G
cttggatgtatggtttaatatgtataccttataattctgcctctagccaaatgctatggttgcaaaatgtggcatctgttagtttttattgtctgtgtcttctttgtttactataccttgggtaattttgtgttaccaaaaaaaaaaaaagggacgggtanggtnaaacccccaaaaaagncaatncnngnttttancctnaaanncnaatntcaanggtnatnnccaacnatngggnttttttnaacnttnaaannctttangcnccntatnntggccnttnnnaantttgggggttgg

SEQ ID NO: 2357 - DNA, 300 bp, Homo sapiens
cccactgaaaactgctgtctagaccaacttttttttctattattttttttcttcttatagagatgaggtctcactatgttgcttgcccaggctggtcttgaactcctggcttcaagtgattctctcaccttggcctcccaaagtgctgggattacaagcctgagccacggcacccagtctcagaacaactgctattggttcatttaacaaactccattacaattttacttttccgtctccttttctagactgagtctctgaatcatttctcccatatattctccatacctagaaaacacc

SEQ ID NO: 2358 - DNA, 300 bp, Homo sapiens
cgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaatggaaacaagcc

SEQ ID NO: 2359 - DNA, 300 bp, Homo sapiens
ggatctcatagctagggaacatttcacaaataaggtgagattttgtaaccaataataaaaatgaatgtttttataagtaaataacttatttttcatatggctaaagatggtaaaatgacttcattctatagccattgtaaataagaatttgctattgatgaaagaagttcagattggcatttgaagtattgagtgtatgggatctctaaggatttcttagattttatatttaaatattttttaaaccttagaggagtcaacaaactggctcttgattttcagcaccctactctcatgaaa

SEQ ID NO: 2360 - DNA, 300 bp, Homo sapiens
cccagccataatggagcctgaaatcaggaattcatgtttcaaggttacatgtacaaatgtatgccctctcagaacaatggccattttgagaaagccagtgagagacagccagaccaggtcctctggcctagcacccaccagtgcctgccagctcagcccaagtctcctcacctaggatagcttgatggaataacaatgtattttaattttctgtagacctaaaactgctcttaaaaagtctattttaaaaatccatcattaaaacacagactttctccataataagaagttggaggggct

SEQ ID NO: 2361 - DNA, 247 bp, Homo sapiens
  misc_feature 231, 234, 236, 240: n = A,T,C or G
tgctattgtaataataacaataaagagaaattagaagtgggagtcagggtagaaaaaaatgcaaaggccttggtccctaggagaccaacactccagctgagctggccttagccccagccccttctaatttctctttattgttattattattattttctctgctattgtaatatttttttgttaattaaatgttttggtcaaaaaaaaaaaaaaaaaaaaaaaaaaaaaaanccngncccntaaaaaa

SEQ ID NO: 2362 - DNA, 300 bp, Homo sapiens; identical to SEQ ID NO: 247

SEQ ID NO: 2363 - DNA, 300 bp, Homo sapiens
tcatttctgatgctccatgatagagttgcaaagcatgctttaaaaaatgcaccttattctgcattatttgcaagtttacttgtggtgtgaatgttttttctactatttctactattagatgtgaagaaaagtatacttggcttaaaatgtgtcacaccatgacaattagtcttctaatatttgcctcatttatataaaatataatacatgtttgtcagcatgtaaaggtcctgggggccttgtacctagagttaaagcaggcacaaagcagccatgacattgtgacaagatataccatgc

SEQ ID NO: 2364 - DNA, 300 bp, Homo sapiens
  misc_feature 255, 257, 260, 264, 266, 267: n = A,T,C or G
gggacgtccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggctctgcccccatgacccaatcagctccaaaggccccacctcctaatactgtcaccttgggggtgagaattccaatgtgaatttgcagggggaggngnggnaaangnnaatttcggggccataccacccttcaccacaccc

SEQ ID NO: 2365 - DNA, 300 bp, Homo sapiens
tgaaggacctgcctgcggctgctttacagtttgtttgtttttttttaaaataagtagaagatatacactaaagtaatgataaatgtatagtatagtaaatacacaaaccattaacagttgtttattttcaagtatatgtactgtacattaattgtgtgtgctgtacttttatacaactggcagcatggtaggtttgttcacaccatcttctccacaaacctgagaatcgtgttgttgcactgcaagtcattaagttaggaattgttcagcttcattataatttgtgggaacataagatgt

SEQ ID NO: 2366 - DNA, 300 bp, Homo sapiens
ccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcc

SEQ ID NO: 2367 - DNA, 300 bp, Homo sapiens
gaagaagctgcagaagaaatgaagaaagtgatgatgatttagattttgatattgatttataagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggc

SEQ ID NO: 2368 - DNA, 274 bp, Homo sapiens
  misc_feature 174, 184, 189, 190, 195, 204, 206, 210, 220, 222, 224, 228,230, 232, 233, 239, 242, 243, 246, 248, 254, 257, 261, 264,267, 268, 271: n = A,T,C or G
ccttgtggtagttaccacaacacatgcctcattaagaaacagcaaccatcagagggaatgcctgcctccctgttaccagctctgcagatgtgcacatatcttcctgtcgtaagccaatgggacttaaaccttacctcttgtgttttggagactatctttttttttttttttttngaaaaagggnccccnngggtngctaaggcngnaggncagggggggnancngggntnanngaaccnttnnccnanggggtnaangaanctntcnngcntaa

SEQ ID NO: 2369 - DNA, 300 bp, Homo sapiens
gaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagat

SEQ ID NO: 2370 - DNA, 294 bp, Homo sapiens
gctacttcataaaaataatttttttgaatcatatttgggaatctagattttagatgataatttttgcctatggctactttagcttgcattgtgtaaatggctgctagggcctgcgaaatagattttatttttggagggggatttgtttttcaatacaggatgatgaaagagatgaaaacttttctaatatagtacaataattggctgtggtcattttaaagggatcagttgcatagcatatagtagatgctcaataaatacttagtgtatcaatatggcttctgttaaacattg

SEQ ID NO: 2371 - DNA, 300 bp, Homo sapiens
ttttaaagtaaggatttgtctctggagtttaaatagaactacagtcaacttacatgaagaattagaaaaagtaagcccttcatattttgtaaaacacatttgcaggcatcatctcatttgatcccaatggaagccctgtgaagcaggcaagatttggacaagtttcttcattttatagatgaggagattaagacttagggtggcatctgtaggtgacatccccactcctagcacaatcagtcttttcctggcagctgggcagacactgaaccaactcagagagtgaggccgctgctcaag

SEQ ID NO: 2372 - DNA, 300 bp, Homo sapiens
aagtgatttcctctgcttttgtccaggcgcgccaaagaacgtggcgcttagtcacttcagattcccttctgtctgtgatcccctctgagaaataaagccataaatatgctgagttctgttgacattcacaccggaaatagcacagagctccaagtattgtggtctcctttccgattttattgctaaacagcaagaaaaacagcagaggggctttcctggcgagtcagagaaatgcaacgtggttttttgtgtgtttttttttctccgcaagacagaggaaactatctcttcacaccattg

SEQ ID NO: 2373 - DNA, 300 bp, Homo sapiens
gctgggagtataggctgagttaggaagattgcttgagcccggaaggcagaagttgcagtgagccaagatcgcgccactgcactcccaactggacgacaaagcgagatactgggagtataggcattcgccaccctgggcaacatagcaagaccctgtgtctacaaaaaatttaaaaaaaattagcctgtagccctagctatgcaggaggtggaggtgggagaattgcttgaacccaggagtttgaggttacagcgagctgtgatagcaccactgcactccagcctgggccacagagcaaga

SEQ ID NO: 2374 - DNA, 300 bp, Homo sapiens
taaaaaaccaccttttgttcgaaactccctggagcgacgcagcgtccggatgaagcggccgtccccacccccacatccttcctcggtcaagtcgctgcgctccgagcgtctgatccgtacctcgctggacctggagttagacctgcaggcgacaagaacctggcacagccaattgacccaggagatctcggtgctgaatgagctcaaggagcagctggaacaagccaagagccacggggagaaggagctgccacagtggttgcgtgaggactagcgtttcgcctgctgctgaggatgctg

SEQ ID NO: 2375 - DNA, 300 bp, Homo sapiens
ccaacatggtgaaaccccatctctactaaatataccagaaattagttgggcgtggtggcaggcacctgtaatcctagctactcgggaggctgagacaggagaatcgcttgaacccgggagggggaggttgcacttagccgggatcgtgccgttgcactccagcctgggtgacaagagtgaaactccatctcaaaaaaagatgagatgaactcctaggttcaaatgatcatcctgcttcagcctcctgagtaactgagatacaggcacgggccaccgtgcccagcttgtatactgcacttt

SEQ ID NO: 2376 - DNA, 300 bp, Homo sapiens
atccaactgtggcttctcccaggaccattacacttgtatctaaatacctacttgacatcttcttttggatactgaataaagatcttgaacaaacaaataaaaacagtaggttgttgatgcatgttactttgcccaatagatatattctatcagaatgtgatttgtatatataatatgtttacatattaaattttgattcaattaaaattctccacaggggagattctgtggtaagttctttcgtaaatgaagtaattattctagtgatttaagttcatgttacttgtactttatgcttta

SEQ ID NO: 2377 - DNA, 298 bp, Homo sapiens
  misc_feature 274, 280: n = A,T,C or G
gtcagatggtagaaaatgaaataattaaatagataccatttgagttctgggagccaggtgaagaagtgtttgtttgtttttgagacggagtctcactctgttacccaggttggagtgcagtggcctgatcttggcgcactgcaacctccgccttctgggctcaagtgattctcctgctccagccttctgagtagctggggctacagacgtgtaccaccacacctggctactttttgtatttttagcagagaggggatttctccatgttggtcangctggntttgaactcctgacctca

SEQ ID NO: 2378 - DNA, 300 bp, Homo sapiens
gcaggacgtcttcttcgacatggaggcctacctgcccaagaagaacgggctctacttgaacctggtcctcggcaatgtgaacgtgaccctcctcagcaaccaggccaagttcgcctacaaggacgaatatgagaagttcaagctctacctgaccatcatcctgctcctgggtgccgtggcatgtcgatttgtccttcactacaggtagtgggtgtggccgtgtgtgcctgggcctgggcatgcagacgtcaggtgggggccgggagagagggatccaggggacccggagcctctcctgct

SEQ ID NO: 2379 - DNA, 300 bp, Homo sapiens
gcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacata

SEQ ID NO: 2380 - DNA, 293 bp, Homo sapiens
  misc_feature 272: n = A,T,C or G
cagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaaaacagaaggaacatttgctttattggttacttactagtttagcctctaggttatggcacagcatgctaaaaaatcatgtgtttaaaagtaaatgttggtaaaatgctggcatctggtcctattgngttgatgcattttcacttctg

SEQ ID NO: 2381 - DNA, 300 bp, Homo sapiens
gaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaaaaaaaaaaaaaaaaaa

SEQ ID NO: 2382 - DNA, 300 bp, Homo sapiens
  misc_feature 232, 238, 239, 292: n = A,T,C or G
gatatgctttagaattaaggtgagtggtattatctctagtttgagacaaagagaagcgaagtaacaaaaggccacataagtgataaatagtggacctggagtttaaacctgggatccccacctaaatcagaaatacaaaatcaaccacttttttgatgatccagggtctatgtatatttattacatgtatgtatatatgtatatatatacggcatgtgtatatatgtacatncatacnnatagatgtgcttgtactagcgtttttcccaccaggatagttagcctttcttcnccccttgc

SEQ ID NO: 2383 - DNA, 300 bp, Homo sapiens
cccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagag

SEQ ID NO: 2384 - DNA, 300 bp, Homo sapiens
gttacctgtgtatgactgaagtacatattcgttatctgcgtgagacagtacagattggtgtatagtattttacagccacttcattatatgctatttccgtgtactggcaaaaaagagaataaaacttcctaggatataagtacctactgctgttttggtgcatgtccagttaggcttttctctttttatttgtttgtgtacctgtaactccatataagcatatataatcatgttacatatgtttaaaaggcgtcattttgcaatgcagttttatcactagttttttctctgtcaagggat

SEQ ID NO: 2385 - DNA, 300 bp, Homo sapiens
gagagacagtgagagagacacaccatggggcctgatatggaggcacttacgtccaccaatgctgtaacatttgcattcgttaacaccctttcattaatttattaaatcattctccagtgtaacttctgtagaattcccagtttttgcttttatgaaattctgtagttgatgaacctcagattttacaagtaattgaacttaactacaggagaaggaggagaagaaggtggagggaaaggacaagaaaaaaaagcaagatataactttttttggttcccctcttttaatattttttctaaa

SEQ ID NO: 2386 - DNA, 300 bp, Homo sapiens
ctcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcgtcagtttttctacctctaaaggg

SEQ ID NO: 2387 - DNA, 300 bp, Homo sapiens
gttaggttggacacagaaggggcaatcaaatttctgtattcagatacctcttaaaggtacactgtgccaccttgctgcctttgattgcaaatacaaagttaattttcaaaaaggaaaaacaaaacagctctttttcctaaaacacatgttgtacttcagacctaaaattctaagtcttatttgtttctcacccatgagttagatttaggtaatagtattagtagagtccttagagaatcttaagaggtcatttactccacctctttcattttaaattggggtatccaaagcctgaagagg

SEQ ID NO: 2388 - DNA, 300 bp, Homo sapiens
tgcactccagcctacatgacagagtgagaccctgtctcaaaataataataataatgaactgagactcagaaaagatgtttgttcagggttacaaagctcagacaggacagggcagcattggaaaccaaaattggtctgactcctaggctcatgctgtaaatcacggtgcaaggcttctactatctatgtttttcctaaaagaatgtataaatgaaaagatggttaacatattaagcaaaatatgttaaacgtcaaatgaactgtataaacgataaatgctggagagttgaggtggcaaag

SEQ ID NO: 2389 - DNA, 245 bp, Homo sapiens
atcgattaacacttctaatgagtcaagtcctagggttttttggttttgttttgttgccaacgaggaacacagctctgggggaatggtgtcatccacctcgctttaaaaataagcacatgatggctgggcaccgtggctcacgcctgtaatcccagcactttgggaggctgaggcgggtggatcacctgaggtcgggagtttgagaccagcctggccaacatggtgaaaccccatcgctactaaaa

SEQ ID NO: 2390 - DNA, 189 bp, Homo sapiens
ccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggcttttttttttt

SEQ ID NO: 2391 - DNA, 300 bp, Homo sapiens
gaccctcatgccaccagcttctgctccagcctttcttactcattaggctctagtctcacttcttattttttaaattgtgagtaattttcatgcttggtagttgatttcttttccatctctgtatgcatacttcctgcacctagtaggcacttgatttttttttctttgaatacacagcagatgccatgtaaactcattagtacttgcctcagaacactgaattcttacctgtgttaaatgcatgaatacattaaaaactttttagttttacttagaagtatataaagtgtaaactaatca

SEQ ID NO: 2392 - DNA, 300 bp, Homo sapiens
gtccaggccaataatcagttggttaagtgaaaaaagtgtttaaagtgaagaattataaagaaagtcattatggatctcaaacttttactttaattgaaaccataaaaacatatattcactcaccaatgttttatgcagggttaatgccttctctttaaaattggacttctgattggatttctacctcatttttcttatgtaaacacttatagttcacttttgatatttatgggttttgatttttgaaacaaagggaaaatgttaaaacatatactgttcagtaatgccacctaatccatg

SEQ ID NO: 2393 - DNA, 300 bp, Homo sapiens
gttgaaggtatgtgtcagttttaaccaggtgttgagttatttgatcactcctccaaagattatttaatagtttcaataatatctaatgatgtgtgggaaaccgtagaatttttcatacaaactgggacaaatgaacatgcatactattaaaatacttcctacaataggcataaaatgggctttcttaggtgaaccaggaggtatagttagcctaatcatatgctatgattattagtaatggttttctgtgttttatcattcatatttgtaaatcttttttgaatgactacttggaaatga

SEQ ID NO: 2394 - DNA, 300 bp, Homo sapiens
atttatttgccctatttcctccatgtacggagacattacagcaacagcccagtcagatttttttcatgctatcttttagtcagatttaatttaatgtgtatttctagtttattgcttctgccatgttttattctttatgaagatccccgagtattgagtgtgccagttaccagattctctcccagctctaaattacctcttcattacttgatctgcaatattggagcctaaccctttaggccaggggtgtccaatgtcttggcttccctgggccacattgaaagaattgtcttgggccaa

SEQ ID NO: 2395 - DNA, 300 bp, Homo sapiens
gcaggtcccctcccacatctaatccaccactaaggcctgcttcttaatagctcttgttcggctttggttgagacagggttttgctctgccgcctaggctggagtgcagtggcgtgatcactgcagcctccaactcctgggatcaagcagtcctcctgccttggccttccaaagtgctgggattacaggcgtgagccactgtgcctagcctgaatagctcttaaatctatccacttttcttcctctgcacacctgacaccctagtcctgctgccctcttctccacctggacaacctcgccc

SEQ ID NO: 2396 - DNA, 300 bp, Homo sapiens
gcgtcgctaaggtataaaacttgaaccatgattttacatttccagttctcaaggacaggctttgaatttaatttgttgttaagagtaattagcaattctagggaaaaaaaagctatttttattttctctacctcctaacacaaaaggtaacattcatcttctaggaagggaaactcttgataactctgtgtctttctaggtcagccacagactacactaagtcaccaactccaaaggggaaatttggctttttggtgagtacttgtgctagagaacagtagaatgcataatctggtcagc

SEQ ID NO: 2397 - DNA, 300 bp, Homo sapiens
cttagaggccttaggcaggtctactgggtctcccaagctgagacctgttattcccactttgcagacagaataggtcctaagaggtcatccaagaccacacagactgcacagaacagctgaggtgggaaccggggacttccttctcatattttttgaatgaattaatgaatgagggattgtgagaatggggctggcctgtcttatgcagcctctccgagagtggcccaagaactctgaaatggtcctggaagtagagagagaaaatggaaattgacagtttaggactcaacagccacaaag

SEQ ID NO: 2398 - DNA, 300 bp, Homo sapiens
gatacatccaaatattattcatgttatagtaaatcagatgaagccttgagcttctcagcagccacgtaaggcttaaatatgagggaacaggggctcttagaagtgaagtgacttctgaaagatgcacagagaattaggaaagagtctgaattcaaccctggaaccctgactttcaggtgagtgcctggcccactaaagaatgacaaagccatggggagtggcatggaaagcatgagctttggagttagacaggcctgggtgtgaatcctggtcaccccagttctgttaaagacctcagaa

SEQ ID NO: 2399 - DNA, 300 bp, Homo sapiens
gctttatctctaaattagaatcacaaatgcgtaatcttttcagggtaaaaatgtgtcatctttaaagtctgtttcagatatattttaaattactattttaaatgaattcatatggaaaagtcgtgggagcttaaggccttgtttaaaagggaaaaaacaactgagtctttttagattaatcaaaaactatcctcttcctttggagaggagagagtgtttgtcacacgcggaatgaagtgccatgttctttgaggcacgatttgtatgccatttggaggagggagtccgttcaagagaatg

SEQ ID NO: 2400 - DNA, 300 bp, Homo sapiens
caagattgggctatggaattggaaggcctgttttggagtactctaaattaaaaaaaagttatatttgtaaaataaccaccacaagattgcctgattcacagttcttctgagtattggcgtaggtaattatttaagatgtttgataaattgtaaaatgctttttacattttttaaggaatcaattgaactactggaaaccagtatgtagtattcttggcaggtctaggtttcataatcctaatttctttgcagcccactattcagaaatgtagtgattaacagagtcaagaatgtttcagg

SEQ ID NO: 2401 - DNA, 300 bp, Homo sapiens
gtgattcctatttcaatatgtgaaacacttaaccaaagaatatatttcgatgaatcttaaacttgccttaaaaacagaagaggttaaaaagaatttagaaaaaataaagttttagagtgtttgagaatgtgtatataaaatattttcaaagccataatatggatgctcttatggctcagaagcatgcctactagaacacgtctcggaatgagagatgtttaattctgtcacctcccagaaagttttgcagggtttctcacttgaatttgcttccctttgcaacctcttgtcctgaaggcc

SEQ ID NO: 2402 - DNA, 300 bp, Homo sapiens
  misc_feature 220, 227, 230, 233, 234, 235, 238, 245, 248, 250, 256, 262,265, 266, 268, 269, 271, 278, 280, 286, 290, 292: n = A,T,C or G
gcgagggcctggcccccagggcggccacaccagaaggtcggagaaaggcccaaggcggatgccacgcccagcagtggtgagggacccacagattttggaaacgacctggacacactattgggaaggagatgtggacggcctgtctcctcctgcagggcccaccctaagaatgtatttttaaacacatgaaataagtatttttcactgataaaaaaaaaanaaaaaanaanttnnnccntttaaanttntngtgggntttttnacnnanntncaaactngnaagaanttcntngtggattt

SEQ ID NO: 2403 - DNA, 300 bp, Homo sapiens
agtaaattcagtgtttctgttgccgaagagtgtttattggttctttcactttcatttcatagggccctttcttctactggcattctcactttgaattactaagaagtttcttctaatatccctctatctcctttttctttctagttttagataaagctgtcaaaagaacagttatcatagaaatagaaacatttaaattaccggcacgatagcttatttcttgctgcaaccattcagaatatctatttgtcactgccttgggtgctttgaagtgaaactgtgcttagatataaaaagttt

SEQ ID NO: 2404 - DNA, 300 bp, Homo sapiens
ggaacgttgaggaggacttcaaaccagctccggagtgctggataccagcaaaggagacagaacaaataaatgggaacccagtgcctgatgaaaatggacacattcctggttgggtaccagtagagaaaaacaacaaacagtattgctggcattcctctgtagttaattatgaatttgaaattgccctggtactaaaacatcatcctgatgattctggacttttggaaattagtgcagtgccactttcagatctcttagaacaaacactggaactcataggaacaaatatcaatggaaacc

SEQ ID NO: 2405 - DNA, 300 bp, Homo sapiens
gctgcctgtggcatagccactgctgtacgtttttggttgtttttaagaaactcgatgaagaggggtgtcattctgggctcggggtggttgccaatttttcaccagaaagggagccaccccttgcaaccacttctgtctccgttagccccccctctgccctcctccaagccaaagcgtggcctggcttttgtcttcccatttagttttcctcttttacccttccttttgtgcttaatttattaaaatagttgctgtataatttattttcataaactataaaaaaatactaaatggttaaaa

SEQ ID NO: 2406 - DNA, 300 bp, Homo sapiens
atctgaacccatgaagttgagtaaaaaaagcaatttgcagaaggatacatacaaaatgacaccatttatatagtagactgaaagcatgcagaacaatccattgttgtttacgtgtgtaacagtcataggaatgacaaccactgccttcagaattatggcgacctctgcgatggaagagaatgggatcagagaaggatacacaataggctttaactgattttgtgattattgatattagaaatgtttaaaattaagatattaacatttcatgaagctgagtggtgagcacaccagtgttat

SEQ ID NO: 2407 - DNA, 300 bp, Homo sapiens
tacatatttgtcataattacaataaaatacaaagagctattttggaactgggcaagctgtttctaaatgtatatggaaaaataaaaatgtctccaaaaaatccctgcagagggaaactagcccttccagatataaaatatattatagaactgtgtaattaaagcaatatggtactggtccataaaagaacataaaaccaaatagttcagtagactcaaaatgcaagcgttggtgagggtatggagaaaagggaacccttttacacttggtgtgaatgtaaattagtacagacattgtgga

SEQ ID NO: 2408 - DNA, 300 bp, Homo sapiens
gtttactatttattgaatgatgagccatactatttaaattaacaaaattaactgacttaacgaaattatctccagaaaaatactcttggaaaaaagtcatcaatgttcgtataattctgatattttaaaaaatcttttagattaaaacaaagggtcaaaacctccatagagtcaatgctaaatgggtgaaaatgtgacataaaaatgccctgtgttcaccagattgtcatatactttatgtaactcacctcagttattattatgcctactacacagatgaaaagactgaatctcaggaaa

SEQ ID NO: 2409 - DNA, 300 bp, Homo sapiens
atttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatctt

SEQ ID NO: 2410 - DNA, 300 bp, Homo sapiens
atttagtcactagctataatacatttagtgaacaaatgtagtcttgcactaaaattagagaatacctatccttttcaagaatacataaaataatgaccatatatataccacagagtaagctgcaaccaattctagataacttaaatacagaccatgtttggaaatttaagaaaaaaaaacacatttataacttgtggatcaaaaaagtcatagaacttagacaatacttggaactgaatgtaaatacaaatgctattaaaatttgtagtatgcagttaaacaggacttgtatacgcattt

SEQ ID NO: 2411 - DNA, 300 bp, Homo sapiens
gtttaatctctttaactatcaaattgcaattttttttttgccttgcaaataaacaaattacaattgtcatttactggtgagacaatgagaaaaagacaccctcaaacactgttggtagaacacaaattgttaaaatctttctaggagtcattttcaaattatgtatcaatgacctaaaaatatttatgtctcctgttcttatacttccagaaatctattctacagtaataaccggagataaaaacctttacatataaacatgatttattatactgaaaagtcaaaacaacataaatatta

SEQ ID NO: 2412 - DNA, 300 bp, Homo sapiens
gtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacct

SEQ ID NO: 2413 - DNA, 300 bp, Homo sapiens
gtgattaggagtgacagagtaggtaaagcagacatcgtctctgtaataaatacacatggtgataagtgctctgatgaagtaaaatagagcactgtggaaacacagaggagggggtggaaaaagtcagggaagtctgttcagaggaagtcacatgtgaagttagtgaagtggggaagcaaatgggtgcggtgggaaagagagtagttcctgaaaagggaacagcatgtacaaaggcctagaagcaaaacattgtatgcacatagtaactgtttaattggatatgaattttaaaaatcacat

SEQ ID NO: 2414 - DNA, 300 bp, Homo sapiens
gccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgccagtggccaggcctatgtggccctttctcgggcccgcagcctgcagggcctacgtgtgctggactttgaccccatggcggttcgctgtgacccccgtgtgctgcacttctatgccaccctgcggcggggca

SEQ ID NO: 2415 - DNA, 300 bp, Homo sapiens
ataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctcttt

SEQ ID NO: 2416 - DNA, 300 bp, Homo sapiens
gctatgtgttctgactttgttgattcaaataagtaagctaaatcaatttaagccattaataggtttataaagttatttgctatgtgttgttcttacatcattgattcatgtaagtagacttgtgtgacagctaattcttaaaaaattatgaagatgttagacttcttttgatatatatatgttgattgtatgaacagattgacatcaatatacttattcattataaaagatttgagtgggaactcaccaaatcccacaccaaaaaaatttaaaattttaccatagtaaaaaaaactaaaa

SEQ ID NO: 2417 - DNA, 300 bp, Homo sapiens
gcacaattggtattcaaacccaagtctgtttgactcccaaacccatactttgaacctgaagtctgtactgctgaaagtttctccttattgaagaatttatattttgcattaatttatgtcttcagaattatacaaagtattgggccacaccaaatttgagtctggtatagtagccttcttgtaaaaaattatatcatataacatttttatgactgtgaagacctcttaattcttcaggaaggagggccctttttcaaatcagacatcctggggtttttactgaccttatttcattctctg

SEQ ID NO: 2418 - DNA, 300 bp, Homo sapiens
gtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttg

SEQ ID NO: 2419 - DNA, 300 bp, Homo sapiens
atgacatagtggatctgagagcacttacagcatttctgcaccatgttcagtacttgaatctgaatctaaagagagggctttattggatcactattctgggataatattgaaataacaactaataacaataacaacaatttttgttttgtgaaaaaataatacaaccaaatgaaaatagattaatcaaaacagtgaaaaccctgtccccttttctgagcttatgaaaagagaacctaattagtaggcattctttttatagctaatgtgctaattgcctcagagataacacctgtgtaattt

SEQ ID NO: 2420 - DNA, 276 bp, Homo sapiens
atcattctggatttaagttgctttgtctcttgattgctcatgaacattcctatgtgagtaaatattcttcccaatgtgatttttttcttgttgttaaagacaggctctggttttatcgcccaggctggagtgcagtgacataatcatagtataagcatagctcactgcagccttgaactccagggctcagacaatccaccttcctcagcctcccagggtcctgggattacaggtgtgagccactgcactctgcccccaacatgatttttttttttt

SEQ ID NO: 2421 - DNA, 300 bp, Homo sapiens
ctctgttcagaagcccctgattttgctccagcagcactctcaccctttctagtgagtaagtacactggattttaaatccctagcacctagcactgtgcctgggcagcccagcataggcactcaataaatatgtgaatgaatgaatgtgtctgtctgtcagtcagtcagtcagtgtttatgggatctgagtgtattcactagtagattctatgttcttacttggcttcaagaacctgtgaatgaataaggatcaccactgtaaactaaaaacaaaattttaagccatcagctgactgaaga

SEQ ID NO: 2422 - DNA, 300 bp, Homo sapiens
aaacaatataactcaaatgcctttctacaggactacaaagctgtctgtatcaggttatggagttaaatcataatttctggatcatgatcttaaacctttaattggttccatttctactttactctttactaacaagtatcctgatggcctgaaaatccatgttgaaatttgaagtttgaattttccagatcaaatatgaaatttattttcattttttaaagtacaaaatatcagttgtataatcatggtaaaacataaaattttgctataaaagatttttaaaggctatttgattaaaac

SEQ ID NO: 2423 - DNA, 78 bp, Homo sapiens
ctcagaaccactctgtcgtttttaagcagggtcacacactctagctcactgggtccattttaatttctattaaacatt

SEQ ID NO: 2424 - DNA, 300 bp, Homo sapiens
gccaggctggtcttgaactcctgacctcaggtgatttacccgccttggcctcccaaactgcagagatcacaggcatgagccaccattcgtggccagttgttagtttttgagatagtgtctccagtttacagatagggagattgaggcttagaggaggcacatagtggcagaactaggatttgaatccaagtctgttttccctccaggacccaagcccttaaccactgtgcatttttaaaatagccagaggaggactcatgaccaccacctggggatgtgagcaaagccagagtccagaca

SEQ ID NO: 2425 - DNA, 299 bp, Homo sapiens
  misc_feature 211, 224, 226, 237, 239, 248, 252, 253, 257, 290: n = A,T,C or G
gaccaacctggctaacatggtgaaaccccatctctactaaaaatacaaaaattagctgggcgtgatggcatgtgcctataatcccagctacttgggaggctgaggcaggagaatctcttgaacccgggaggtggaggttgcagtgagccaagatcacaccactgcactccagcttaggcaatagagcaagactctatcacaaaaaaaaaangagagagagagananataaagaggtntnttgggacanttanncatntttcctacattttctctttttttcaaagcccanaatccttgc

SEQ ID NO: 2426 - DNA, 300 bp, Homo sapiens
tttaaaaagcattttattatgtattatgaaatatttcaaacataaaaagatgtaaagactatctaccaatgactccccccttaataaaacaaattaacctgaaggctgttttgtgcccctccttgattgtgcattcacctcccaacccctcgctccttgggcaactgttatctttgttatttgtcattgccttaacattagatttttttattactgcttttgtaattctaatgatatcaaatggaaaaaatattttgaatgcaactcctcttttaatttgctccaattttatctgtattt

SEQ ID NO: 2427 - DNA, 300 bp, Homo sapiens
gagcgacagaagcttctggaaaccatgcagcacttgcaggaggaccgggacagcctgcatgccaccgcggagctgctgcaggtgcgggtgcagagcctcacacacatcctcgccctgcaggaggaggagctgaccaggaaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtggcctca

SEQ ID NO: 2428 - DNA, 300 bp, Homo sapiens
ggaagagctcgtcttggagtccaagcttttgccacttcaattgcaccagctccaggaaccatacaaccatcttcaatggcatttttgatagcacgaagtccatctcttatggcatccttgacttgtgtgagagtatgcttatttggtcctttaaccaacaaggtaacagagcaagggttaacacactcctcaataaaagtgaacttttcttcacctaatgtatactcatacacaagaccagcatgtcccaagcaatctacagtgagatcttcaaaagaattcacggccattccaccacaa

SEQ ID NO: 2429 - DNA, 275 bp, Homo sapiens
  misc_feature 209, 213, 214, 217, 220, 221, 223, 224, 226, 228, 229, 234,236, 239, 245, 247, 248, 254, 255, 256, 258, 261, 264, 265: n = A,T,C or G
ggtaaagcttcattcagtatccattcacccaatactggtttgattctagggcctaggaaaataggactgagcaaagcccttgtccagatggaacttatgttttagaggggaaaacaaaccataaaaaggtaaacagtataaaatcaggaaaggataaatgtatatgaagaatcaaaatgaggacggtgatggggataagaggggaaggntttnnatnacnncnngntnngaagngnaantttacncnntgtcgnnntnttntgnnctaccatggt

SEQ ID NO: 2430 - DNA, 300 bp, Homo sapiens
atgggagccatgggcagtggtcctggctggtgaaatgattctagccacgtggcccacccagggggcaaaacaatagaaaccttcagaaatgaaacgtcacctggctgcaagaagatagtcccacaggcgccctagagatggggatgccaagtggcttctcgggaagctgtaagaatccacagggcattgtaagatggagggaaatattaagttttcttcgtaaagaggtgaggggggcgagagcagcaaaggacactggaaaatgagaagcatggatgggaagtgttgcattgagcataa

SEQ ID NO: 2431 - DNA, 300 bp, Homo sapiens
  misc_feature 212, 218, 232, 241, 244, 255, 262, 273: n = A,T,C or G
gaccaacctggctaacatggtgaaaccccatctctactaaaaatacaaaaattagctgggcgtgatggcatgtgcctataatcccagctacttgggaggctgaggcaggagaatctcttgaacccgggaggtggaggttgcagtgagccaagatcacaccactgcactccagcttaggcaatagagcaagactctatcacaaaaaaaaaaanagaganagagagagataaanaggtatatnggnacaattagtcntttttcntacattttctntttttttcaaagcccaaaatccttgca

SEQ ID NO: 2432 - DNA, 300 bp, Homo sapiens
aatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacag

SEQ ID NO: 2433 - DNA, 300 bp, Homo sapiens
ctggagcattctaaatgtatcactaaatatagaggagttctaattctgacaggaattctgtgagggcactggtagtatcctcatttaacagatgaagtaatttgagatctctgctggaaggtgatggagctgtgatttgaaccctggtgcctgattccaaagccatggctaagaataaataattcagtccactaaaatacctaactttggcaagccttggaaacagagtgcagaagattaatacagattgcccaggccagtacaagcagctatacagagaaaataagtaggtgctaggat

SEQ ID NO: 2434 - DNA, 300 bp, Homo sapiens
gccctctgcttcctggctgaccttggtgtggccctctgatggcactatgtgtcctcttctctgagctttctgaggatgacaagccgtcttttcaatgggactcccttccagacctgttggtctcaccatactggaatcatcataaagcctgtattgtaaaacatcattggtgtctaaagtttgcacaatgctatggcccccacattaagggagtctgggtgagatcacttcattgcccctacttctctgaccagaaaacacaagagttcatgggagacaataataacaacaacaaaaaca

SEQ ID NO: 2435 - DNA, 300 bp, Homo sapiens
gggaattctctgccttttggggaacagttacagaggacctactaaacccttggctggtgccaggccccgagaccacagagataacctgggacccaggctctgcccatggggagctcccagccctgtgaggaagacaggccatcctcacccagcacatcctactgtacccgaagagagggcgcagtgactcattttttgccgttggcattaggtttaaaagatggttgaacgtccacagaaggaaaaggaattcctggcagagggccctgcctgagcataggcagggaggctgagcagcca

SEQ ID NO: 2436 - DNA, 300 bp, Homo sapiens
  misc_feature 279, 290: n = A,T,C or G
cttgagaatgaagaacccgcccaggaagagccagaacccatcactgcctcgggttctttgaaggcgctcagaaagttgctgacagcgtccgtggaagtaccagtggactctgctccagtgatggaagaagatactaatggggagagccatgttccccaagaaaatgaagaagaagaggaaaaagagcccagtcaggcagctgccatccaccccgacaactgtgaagaaagtgaagtcagcgagagggaggcccaacctccctgtcccgaggcccatggngaggagttggngggatttcca

SEQ ID NO: 2437 - DNA, 300 bp, Homo sapiens
gtaaattcctgggttccaggctcaagccttccactgtatgctccatgttaccagctatgccttttgaacgggagatgttgcataaataattgttgagtatgcactttagattctttgctaacatcacatttggtgaaactataaaataattcccatgaaaattggattgcttaatatcataactgatatttaataatatttaatattgctctaaaatttctggctaaaatgaaaatattcaaccatcaggaaggagaaacaaaactattactgtttgtaaacagtttatcatcagtactt

SEQ ID NO: 2438 - DNA, 300 bp, Homo sapiens
acctgtaatttcaacatttgatgagtcagagaaaaaaaggtttcctttgggtcttatttgatcactattctgttaattttaagcaagcttgtagtaaattgatctatttggatataaataggttacatgattatcagtactagagacccatgtatcctatttatttacaaaagaatattaaatatcctattttaatttttatattacagcctattttgattttttagataaaagtctagagcttttattttaatgaatgctaagagatcagaatgcactggcattctctgatttaatagt

SEQ ID NO: 2439 - DNA, 300 bp, Homo sapiens
gttaggtccattttgatgttacaggatacttgtaagtgactttttgccattctcttttgttacccatggcctttgtcacccccttgaatatctcttttactcagttctcactttctgttgttgacatacttgttgacatgtcccaccagtccatgaaatgaaataccatatcttccttgtgttgatattacttttgtgagtatttaagacatatataataaacaaatgtaaaactttggaaattgattctcttctcattaaaaaacatttaaagggaacatttagaatatttgtttacat

SEQ ID NO: 2440 - DNA, 300 bp, Homo sapiens
gaaaaaacaaagtaataacttaggccttgatcaaggattttagcacctaatgtttgctaagcttagctgtctggtgcagaaatacaagacataaatattatttcgtagacagttattatttccttactgtgaatttagcagaatttatagaagtcttttgggtagtaagctttggttaaattatttgtttttaaaaaatcgcagttcatgaaacatttctacttattaaatacaatgtgaatactatatctattcttgctactggtcataattgttagccctctcccatgcctcttctcc

SEQ ID NO: 2441 - DNA, 300 bp, Homo sapiens
actctggcacagccagagtcattggtctttcaagcagtcattcatatcagcgactttagaagaactgaaagaataggttgatactgaacccactcccagagccaggtagctgaaagggcactgtgattgttatcttactaggaacacgtggagtgggagtaaggcagttttctgcagaaaagagggattctgggcagacaaaaactacatatgcactatgttttgttttgtttttttgtttgtttgttttaaattaaaaccagaaaaggcgaagacttggagaatgctcaaaattttttt

SEQ ID NO: 2442 - DNA, 300 bp, Homo sapiens
gtaagccatatagtctgtccagaccactgaattcctttgttgtaggctgaacagactacaacaaatgggtgtggtataaacatagaaccagtccaatctggttcagctttgttagtaacaaaatgtaacaaaatgatgagtcgtttttcagtgcaatggacccccagggtgcaagtcacatatcgctggagcattaacagatgaacaaagcatgcccaattcataacccttgggtggaatgaaaaagtcaactacaggtagaacccaagtactcggatcaaggaatggggactatgctgg

SEQ ID NO: 2443 - DNA, 300 bp, Homo sapiens
  misc_feature 279: n = A,T,C or G
agtggctgggaccgcaggcgcgcgccaccacacccaactaatttttgcgtttttttgtggagacggtgttttaccatgttggccaagctggtgtcgaacttctgacctcaagcgatccgcccgcctcggcctcccagaaggctgggattacaggcgtgagccaccgcgattggccgcaggatcatagttcactgcagcctcgagcagccacttccggggcagctcctccattctctgagtttgagacttgctctcatctcagatcccttcagagctctnctggctgaacgaccttgggaa

SEQ ID NO: 2444 - DNA, 278 bp, Homo sapiens
  misc_feature 6, 12, 14, 15, 19, 21, 22, 25, 26, 29, 33, 37, 43, 45, 47,48, 49, 50, 51, 52: n = A,T,C or G
agattncccccntnncctncnnccnnggncacnaaangggaantntnnnnnnaaaaaaaaaaaaagaggtgggtggattacttgaggtcagggtttgagatcagcctgaccaacatggtgaaaccctatctctactaaaaatatagaattagacaggcatggtagcgcacgcctgtaatcccatcttcttgggaggctgaggcaggagaatcgctagaacctgggaggtggaggttacagtagccgagatcgcgccactgcattccagcctgggcaac

SEQ ID NO: 2445 - DNA, 300 bp, Homo sapiens
actggttaaatagcccttgatgacttttcatgtggcatgagagggatatgcttataaagcttaattctgatattatcctcttactacctacagtatgttttgcaaaaatcagtccacttagcaaactaatctttgtaaagcagtcagtttcagaagatactttttatcaaaaaagatggcaggtttaacattataccttttggtttttgcccaacatttgatttaatctaaagcaagaatataaaataattttaagaagcatataatttcttttgataaaaagtaacaaaaatttaatgc

SEQ ID NO: 2446 - DNA, 298 bp, Homo sapiens
  misc_feature 240, 243, 244, 245, 250, 251, 253, 256, 266, 268, 270, 273,274, 281, 283, 289: n = A,T,C or G
tttggtcagttgcaccttctgggtcactggtagcgcgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagacaggagcaactcggnggnnngcggnngncantttgatttgngncntcnncggcagncncatccnccgaatcac

SEQ ID NO: 2447 - DNA, 300 bp, Homo sapiens
caaagatctaatgagtcacaggatgggggatgaaattgggaaaggtctggattagcagagttgctgcagaaagaagtagaggggaatatcttagaaggcacttggacagaatgggggtgatataaaagatgtatgctgtcatttttgttttggctcctagaaaatatagcagaaagtgagaatttgtgccatacatcctgttctgcaccttaatatggaagtttgcctttccacacgagtcttccttcacaattaacctctaattttttttttgcagttttctccagattttggaagatt

SEQ ID NO: 2448 - DNA, 300 bp, Homo sapiens
atataaaactgaagggagagactgggagagagcttcacagaagagatttttgggtcagatgctgaaagactaggaaaatgtagtgcagagatggccggaggagagtctggagttccaaatagttgcctgctagggaaggcagggagaggctatgccgtgaaggatcctccatacactttaaggattttgggttttactctgtatgtgatttggagctcctgaaggatgttaatgaaaagagtgataggattggatttgcttttggaaagatctccatggtagcacgttctaaaatgggtt

SEQ ID NO: 2449 - DNA, 300 bp, Homo sapiens
ctttagaggtaaccagtatcatgactttaatggtaattatttatacaatttttaatataactttgtcactttacgtgtattcctaagcagtatgtttacttttttcgcctcattttaatctttatgaatcgtgtattctttcttcctttgctcagcattatgttttgaagagttatccatgtagttatgtgtagttttatttcattcatttttgttattatgtattatccctttgaattaaatgtgccagaatttattcatccattctgctgttggtagatcattgagttgtttctagta

SEQ ID NO: 2450 - DNA, 300 bp, Homo sapiens
gcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccagtgcattctccccctgacacagagaaggggccttggtatttatattta

SEQ ID NO: 2451 - DNA, 300 bp, Homo sapiens
gttctgagcagttagtacgtggcagttgtattattagaggaagcctgtcttgtttttttttaaataagctgatagagtgaggattcttttaatcaagactgtttgggattgaattgccactcctgcttaccagagtgtaggcagtttttcttaaactttccaagaagactggtgtcctcatctaaaatacgaaatgcttacagtaattgcctcatggggttgtttggggtgactaaatgtagtaggatttactacatagtaagttctcaatacattgtagctattattattagttcggta

SEQ ID NO: 2452 - DNA, 300 bp, Homo sapiens
ccaggtctctccactgtcaagttactattattccctttataatttgcagtttaagatgaaatgcactagttttagtgcttcatctgtaaaactacttttttatgtgaatttattttttaaaaaatgtctgtcactaaagagaaaatcatcatcgcttggcatggataaaaacactaactgccaaagtcattaacttttggccaaataccaaagccagctaaagtcacagggccttggcctgtattctttgttaaaaagagattaacaactgtcgggtgataaacataagatataccagca

SEQ ID NO: 2453 - DNA, 300 bp, Homo sapiens
cctccctccgcgagctggacgctccgcagcccgcccgccagccggcccgccggccgccgcaggaatccctggataaagaccagctcaaccatcgctgagaaaacagacctaggcttcccagggcggttaacccgccggcctctgggcagagactaaaagacaaaacaaaataaaacaacaacaaaaaactcccagtgtgtttcctactcttctttgtcttggaggaaagcaaagggagagaaatggacttcaccagtggtctttggcttcatcaattcacaggaaatggcatcaagatgg

SEQ ID NO: 2454 - DNA, 300 bp, Homo sapiens
cttcttctcaactctctgattgcttatataagtgacgtcttctgaaggaaagttcagcattttttctcagatatgataataatatatgctaagatcttggccaggcacggtggctcacacctgtaatcccagcactttgggaagccaaggtgggcggatcacttgaggtcaagagtttgctgccttcaaatcaatcattacttcttagcacctcttgaaatagaaaataaaaaatttggccaggcggtggccaggcgcagtggctcatgcctgtaatctcagcactttgggaggctgagg

SEQ ID NO: 2455 - DNA, 300 bp, Homo sapiens
tgcacactaacatggcacctgcataaaaaccacagacaggtaactttagggacttcacagtggactcaagcagactgatcccagattgtaggtagaagtgtgtttgcaaaggccagaggagctgttaggacataatgcgatggagacaatttgcaacaatcactgaatccacgtttctgctgtttaagggtggctgaaaggatggaggtatagcttgtaatgcaaaatatacgcagaggttcatagtgaagctgaggaggagggccttcaaaagttaagtgggagatgtttaggtcagta

SEQ ID NO: 2456 - DNA, 300 bp, Homo sapiens
ctggaattagattgtgtagggccgacattggatttattttaagtacaataggaagccactggaatgtgataaccagaggcttgatgtaatctagtctaatctattaaaggattgctgtctagtttgtgataaatggagccttgaccttggtgtcaagaaattgtccttgataccagcaaggccaatttggaggttattgccattctgagatgagaagcagtaatgacttggtgtttatttgagatagaaagcaagtaaaatagaaacattttctggtagtagaggcaagaaaacttggtg

SEQ ID NO: 2457 - DNA, 300 bp, Homo sapiens; identical to SEQ ID NO: 262

SEQ ID NO: 2458 - DNA, 300 bp, Homo sapiens
tctaaattcatggattatatttatatatgtccttaatcctcactcacattggccctacaggtagattcattgctcactgtcagttctcttgctgaagttttcctatttttctcttgatttgctgaaattccttctccagtagtttaatcaaaagggactaaatgaaaaaaaaaatattcagttgttgcaagttcaaaaaggtttttagtctttgtgtttgattgacagctttccagcatataaaattcttaggccacactttctttccttgagaacttcacagatgtcacttctgtctct

SEQ ID NO: 2459 - DNA, 300 bp, Homo sapiens
tctaaattcatggtttatatttatatatgtccttaatcctcactcacattggccctacaggtagattcattgctcactgtcagttctcttgctgaagttttcctatttttctcttgatttgctgaaattccttctccagtagtttaatcaaaagggactaaatgaaaaaaaaaatattcagttgttgcaagttcaaaaaggtttttagtctttgtgtttgattgacagctttccagcatataaaattcttaggccacactttctttccttgagaacttcacagatgtcacttctgtctct

SEQ ID NO: 2460 - DNA, 300 bp, Homo sapiens
cagacagtggccccggctgggagtggtttttgtttgtttgtttgtttgtttttaacctcatcaatgttataacaaaacaacgctgaatgaaacgatcctattgacgacctgctgtgaaatacaggataataactacccaaaggagggcagtgtgaaagtggaatcacactgttgtaaaggtattttattgtgggaggtggtacagtattaatctaagaagaccagtaaagacgaatattgtaatccctggagaaagcaccaagaaaataaaacaaatagagcttttcaggaaaaaaaaac

SEQ ID NO: 2461 - DNA, 300 bp, Homo sapiens
gaccacctacggaaaactgaggcccacataagctcgattggttgtacctccaacagatatttattaagcacctactaaatactgagcccattgcaagcaccagggaagcctctgtgaacagcacaaggtccctgctctggagattctgcttcagtggtggagacagaaaataaacagtttcccgtcaccaattttccttggaattggacagatggcagccaccataatgatactatatgtgtccaagctaaacaaaatcattcacttccctgattttgataagaaaattcctgtaaagct

SEQ ID NO: 2462 - DNA, 300 bp, Homo sapiens
atttctagctataaagaattaggttgttaggttgaataattgtaaagcctgtgcccgagccgccagttggcgatgcaggtggttgaggggagatgtgggtggtatataagaagcaaaggactctcagcccctgatgtgccccgcgtggtcttcttagggaggctcaatgcataaagacagaataaaatgggatcctccacagagatttaatctgtagaagatcaaacacctgttgcctggtcaccttagtctaaaaagtagtggagttttgttttgttatttttttaaagcatgattcta

SEQ ID NO: 2463 - DNA, 300 bp, Homo sapiens
gtgagatacctgcccctactttgccttcttccatgattggaagcttcctgaggccaccccagagtcagaagccgctatgcttcctggacagcttgcagaaccagtattcactgactgctgaaactagagcatcactgagaagcaagagatagactgacctaactagagggagagctgccatccaggatgatgccaccatcacaggaggtgagaaggaacacagcatcttctgcaaatgctacagtaaatagggacggggtgcagcaatgtgaggaaagtggaatgaacttggactttgaa

SEQ ID NO: 2464 - DNA, 98 bp, Homo sapiens
actctctctacaactgacagagtaaatagacaaaaaatgtatgggggatatggaatattttatcaacacaagtaaaaagcttgatctaacaggtggtg

SEQ ID NO: 2465 - DNA, 300 bp, Homo sapiens
gctggcaataaataagatatctttattatgattatgttaatagttaaaatttgcatgttttctagatagtctgttaacaggataaaaaaatacaaaaaggcgagcttcttaatgattcagctgaattaactataaaattaaaatacctgctaattattatcttctaaaataacacaaaatatattcaatacgcaatacaaacctcagtaatccaattctcctaatatgcaattatttataacctctgaactaagaggaagtggtttgactaaacagagaaataacaatgtttttatccta

SEQ ID NO: 2466 - DNA, 129 bp, Homo sapiens
gtggcatttgatgctgtgggttggagcccagctttggggtcagacacacctgggtttgaatcacattgctgccccttccaggctcacatcattttatttcttttttctttttctttttttttttttttt

SEQ ID NO: 2467 - DNA, 300 bp, Homo sapiens
aaaggctatctatattagctggggttccccccaaaagcaacattggataaggactcatgggcagatactttcttctggaaaatgatcccgtaggatatgggtagaaaaagaaattgggaccagaaagaatgaaacaggaaagaaagaaagcctattgaaggatataaaatttctgtaaacaactggagcttagtcccactgaggccccctgaggaactgcgcagaatgtaagacagaggaggaaatatttagccaccagttcctatctcccattggccaacttgatgctgagttcaggag

SEQ ID NO: 2468 - DNA, 300 bp, Homo sapiens
gggattacaggcgtgagccaccgcgcccagcctcatatcccccatttcaaacacgctgtaaacaatgctcaattactttcctcttaagttgaaaccaccaattactggggaaaggggcagttagattttattggttgactttgtgtttttactaatccttgttgaaaagtagaggaattggtttagttgagaaaacaaaatactaaaaaatctgccactagactttttaagtcaagagtttgtataaaatgaaacatatctactatctaatctataaaatttagaatctttttaattcta

SEQ ID NO: 2469 - DNA, 300 bp, Homo sapiens
cattacatgattctgtcttaacgaagatagaagcattttattgcataagttttcttctgtgtgtgggaatcatatgtgggtgtatatatgtttaaggggtatgcatccgggtagacgtttgtgtgtggacatgtgtgtacaggtatataagtacatgtgtcatagccttggtacaggtctcatagccttgcagcactgtgttcctggcgggagtggcatctgtctgcatgtctgaaaatgccacgtgtgcattctgctgatcaccaaggttcgtggctgtaggcatcctctcttcagtgc

SEQ ID NO: 2470 - DNA, 300 bp, Homo sapiens
gctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaag

SEQ ID NO: 2471 - DNA, 300 bp, Homo sapiens
cagggatccacttgccttaatttgcacagtgttcttataaatcaacagaaagtacacataacagaaaaatttaaaaggttagggatcatttaggaaaaaatgcaaatgccaacaaatgtgagaaaatgctcaatcttacttataatttaagaactacaattcagccaggcgcggtggctcatgcctgtaatcccagctacttgggaggctgaggcacgagaattgcttgaacccaagagggagaggttgcagtgagccaagatcatgccactgcactccagcctgggcgacagagcaaga

SEQ ID NO: 2472 - DNA, 300 bp, Homo sapiens
gtgaggcatatttgctttaacatgcgcttattacagaagttatgtttactgtagaaatttctggaaatacaaatgcaaaataaaacacaaatctctgtcattctgcagaaacagcattcttttgaccccttttgttttattctatagatgtatatttttgtgtttacagaaacttgatcatattattttataacttgctgtttcatataaaattatcatgaacatcttttgtgtcatgacatgtctcttcttttaatgagtgcatagtcttccaaactacaaatcttccatactctgttt

SEQ ID NO: 2473 - DNA, 300 bp, Homo sapiens
ggtaagtgcttagaacaatatctaacacatagtggttgcccagtaaatgtgagctgtgttgattttgagattataactacaataagaactttttcaaattgatacatatttagccgatataatctaattttttaagatggaattattctagttgttggatttacacactgtagcattatttttgggaactaccaaattattccagtttgtcatcataaagtagttgctaaagcaataaaaagtgaaatatttattcatgaaagagtagttcatgtcattaagtgtatgaatggagtgatt

SEQ ID NO: 2474 - DNA, 300 bp, Homo sapiens
aaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttg

SEQ ID NO: 2475 - DNA, 300 bp, Homo sapiens
ctatgatctagatctagtataactcttgttgttttatatattttattacactggaacagctcgtgccctcggtctcttgcctcggcacctggatggcttgccgcccacatattggaacttcattgtggaagttactttaggcctgacagtgaaggagtttcctctagagagagtttctgttaacttctgatctgtgttcttttgtaaagcatgtctcttgtaaacagcatatagttggtcttctctgccctacagtttattctaatgtccctatgtctctaaattggagtgtttagtaca

SEQ ID NO: 2476 - DNA, 300 bp, Homo sapiens
attcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcaagccttgccagggcccaggcttggca

SEQ ID NO: 2477 - DNA, 300 bp, Homo sapiens
ccccattcaagtttcaccagttttctcaatcacattccacaggcaattttaattcacatgtattatttagttgtcacgtctctttaatctccttcagtctgcaatagattcttagtttctcttagattttcatggactttgttacttttgaagattatcagcagttattttgtatctctcagtttgggtttatctgatgtttctgcctagattcaagttagacatttcaagtagtactgtaacagaagttatgctatgttcttttcattgcattctatcagattacatgattttgattca

SEQ ID NO: 2478 - DNA, 300 bp, Homo sapiens
accatgttgcccagtctggtctagtctgttttaacaagttgttgctgtgtaatgatatatgtgtggtgttaatttgcttgttcctaagtttaaatgaggtagagcattttatgacatgcctgttctagtcttttgcttatttttctaattgccttttctttttcttaataatttcagttcttcatatgttcagcatactagtcctttgtcaatttacatgtattgaatatatatactctcccattctgcggcttattgttccattcttcatgaacatttgtaattttaatgtcctattta

SEQ ID NO: 2479 - DNA, 164 bp, Homo sapiens
cggcacgagcccaggctggtcttgaactcctcagcttttactttagcttcccagtgtgttgggattacaggcatgagccacaatacctggccaagtccttttttttaatcaaatgacttattaatacacagtttctttgccagcttttgttccctttagtgaga

SEQ ID NO: 2480 - DNA, 300 bp, Homo sapiens
gggaaaagaaaaatagtagtagaagaggaggagccattactttcatttctgttcattctgaagaaacagagatgactctttctgtataactcaaattcttaaaagaaacccttgatatatagtgtcaattatatgaactctacctcagggtacctaaaaaaagaatgtttggttacccgaatgagggggaggttttcctttagagagaagtattggggccaacaaatgaaaaaggaatagtttgaacaccacattttgcaactcctaatgaaataatggatttaaagaattatcgatggc

SEQ ID NO: 2481 - DNA, 300 bp, Homo sapiens
aagaaagggaaagtaggaacagggagcagagcaaagcataacttgctgtgttccagggatttaaaaataaattactgtcaagagcaatataagggtcatgggtttgatcaggaactttttgtaaatgaaaaagttcacaatttggaaaaaacagtgctagatgtgttatggaaattgttatcacaaattattccactgaaactcaagtatataagacaacaatatattgctgtgaaatcttaattttgacatatggaaggtaaccaaaaataagaaccatacctttttgcttgaagtgca

SEQ ID NO: 2482 - DNA, 300 bp, Homo sapiens
ggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaagg

SEQ ID NO: 2483 - DNA, 300 bp, Homo sapiens
gatggggagccattgaagggttttttgagcagggaagtgacatcacctgggttacattttaaagattcactctggcagcagagtgagaaatagactaaaggaggcaggaggacacgagtgaaaacagggagctatagcaagagtctttgtggttgcccaggctaaagatgatgctggcttggactggtgtagtagtgatagacctacacaagtggtaggatcaaaacagattgaagctagagctcacaggaatttgctgccatgtgtgaaaaagaggatagaaatgactgctaggttgag

SEQ ID NO: 2484 - DNA, 300 bp, Homo sapiens
gctatttgtgttttgttgcactgttttttttgtttgtttgtttgtttatttggttggctttttggagagggaaatgggggtgaaatatttttttattggtgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaa

SEQ ID NO: 2485 - DNA, 300 bp, Homo sapiens
  misc_feature 289: n = A,T,C or G
gtctcatcctgaggccactttctagggccatttctggcaccagatgttttatttcagctcccccaaaagcaaaaccctgaggcagggatcttggttgaagtggggaggggatcccagaaagtggggtgagggtacggaggcatgaggtaggaaagggaagaaaggagataaaatgtgtgttaatgagcaggttagcactgtggaccaccacgctcaatcccactgagacgtgaggaagctgggaatgtatccaccaggccttaatttatcaagatgaggattactcctngaaatgttaac

SEQ ID NO: 2486 - DNA, 298 bp, Homo sapiens
gcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtgaagacgatgaagaggacgaggaggagggcgaggaggacagcagcaactcggaggatggagacccagacgcagaggcg

SEQ ID NO: 2487 - DNA, 277 bp, Homo sapiens
  misc_feature 15, 16, 17, 18, 19, 20, 21, 22: n = A,T,C or G
tagttttttgttttnnnnnnnnttttttttttttgtatattgatgaatgagatcttacctattaaatatattattggattatggttcctgaaggtcattaaagtttgagtgtgtgtgtgtgtgtgtgtgtgtgtgtgtgtgttttatgacttaaatatctttacgtgtgttttttagagcttggttctttaaagatttggagaagatatgtaaattaccaaggcacttggttcttctgttttatatactaataatcagggcctaagttaaataaaaa

SEQ ID NO: 2488 - DNA, 300 bp, Homo sapiens; identical to SEQ ID NO: 1333

SEQ ID NO: 2489 - DNA, 300 bp, Homo sapiens
atttgctctaaaggctgagaataccgatactttcccactggaccccacaggtaggtcatatttcccagcttcccttgaagctagagaggccacgtgtctgagtcctggtcagtgatgttggggaagtgaatgtggaactgctaagcctggagccggagcaaccttcctcctgcagtccccggaggatggtggaactcttacacggaaggatatgcgttcctggaggcatgcgaggcaggcaggagccccacagctcccctccacaccaattcatctgcacaggaatatgggattgcgaat

SEQ ID NO: 2490 - DNA, 300 bp, Homo sapiens
ggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgtt

SEQ ID NO: 2491 - DNA, 300 bp, Homo sapiens
ctaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtacaccggatatgggctacttgtgactagacttttaaactttgctctttcaagcagaagcctggtttctgggagaacactgcacagcgatttctttcccaggat

SEQ ID NO: 2492 - DNA, 300 bp, Homo sapiens
aaaaggtggccatgtgagaaggactcagcaagactttgctggctttgaagatggaagaatgtggccaaaagcctagggatgaatatggcttctagaatctataataaacaaggaaacattatttcccagagcctctagaaggactgcgttttgcttttgcctcggttttagcccagtaagacccattttagacttctgatctttggaattgtaggttaatgcatttatattattttaagccactaatttctggtaatttgttacagcagccgtaggaaattaacatgtaggaaaataaac

SEQ ID NO: 2493 - DNA, 166 bp, Homo sapiens
ctcagctgaaattcttttccctatctagttttgttaaggaattcaacacatgccagttaagctgtcataaatgaaataatctacctcgaggctgtattttaacagattattatatcgaaagaaaaaaatgaatgtttataaaataacatttctttttttttttttt

SEQ ID NO: 2494 - DNA, 300 bp, Homo sapiens
ggaaccaggggctgcagaaccagcccctccccaatgaggaccccctctggacgcccctccccatggagaacaccaggagccacagaccccagaccacagagcacacaggggagggcacggggcggccggggcagggtgtctgctgcctcgtttatgggatttgctccgcgtctagcacactgctgcctgcagtgctcctgtcccctgcagtggctactctgggcctacgggcctaatcctggttggcatgaaaatgtcctgaggctactgtgacaaatttccacaagctgagtggcttaa

SEQ ID NO: 2495 - DNA, 300 bp, Homo sapiens
tgaacttgttcattttgttttgcttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaacaccagtcgatgggctgtctg

SEQ ID NO: 2496 - DNA, 300 bp, Homo sapiens
ggttcagagaaaagtaggcagagaaaggcagtttaggaggtgacacaagagggaagcctaaggagagagaactggatggagcttcccaggtgatgacagggttgaactccagggctatacccagctgagcaaggagagctttgcctcttcaggagactggaagttggggaagactccaacaggcttgtggtcagaagctcaggagactgggaaggaaaagtgaatttctgaggagtcctagttcatttcattaatttgttcaattctttaacgtatgtttattatggacctactatgttg

SEQ ID NO: 2497 - DNA, 300 bp, Homo sapiens
tagacagccatgttgctcacacaaagcctgtttgctggtctcttcacacggactcgagtgaaaatacacacgcacacacacacaaatggacatttaccccactcctgcttttgtgctattgtggtcatgcatagtatttcttttttgctgttgtttttcttgttgttttcactgtcatacaggtatttatgatggaaacagaatcagagtctgaccttcctgacttgaagtacaaggtttctggggtttttcattcgtgttttatgtgttttttaaaaaattatttgtgtttttaatcga

SEQ ID NO: 2498 - DNA, 300 bp, Homo sapiens
agacaagccagatcaccaagatccccattctgaaagaccgggagcctggaggtgtgacccagcagggctgttgtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttga

SEQ ID NO: 2499 - DNA, 300 bp, Homo sapiens
accacgcccacctgtaaccattatttttaagattgctaccattggatagttctgtcattgtccaacttttggatatttaaaattgatccctgtgtggctaacagaattaatgtttccaaaaatgttgaaaattatatagttctcttaattccccacctctaactatatttttgggttatttctttaggaacagatgcccaggagtcatattactgagaatctagaaatcttttgcaaagttcttgttatattgccaaattgcttcccaaaagggttgttctaaaccataatttcaccagc

SEQ ID NO: 2500 - DNA, 300 bp, Homo sapiens
gagaaagtaaagtccctttataatggcatgtgaaccagacaatttagtagccagggttgtaaggcaactcttaactgacaatatagttagtatattctgggccttcatcttcaaaattagtaggtagtatttattgagtgcatatcatgtgccaggcctggtgctgagtgcttacaatgatcattttatatatgggaaaattgaggctcagcagggtcaagtgccttgtaagaggtagcactagtaagtaacagtgctcaaattcaactaggtctttcagctttttatacaatactgcct

SEQ ID NO: 2501 - DNA, 300 bp, Homo sapiens
gtgatttactttctcattcaaaatacatattggatattgtatctaattttgtattggtaattttgggttatgaaaccccagatttgaagccccaaattgtatagggttcaatgcccataaaacccagatctgcccctgcttagaggccggcccctctaggagacagcatgtggggccacccagagatgcaggactcttctgttctgccctatcgcagcagagaggccatccctggagctggaaggtgcagactgggaattgctccttctctgaattgctagctcctgctaatgcctgcat

SEQ ID NO: 2502 - DNA, 300 bp, Homo sapiens
gtggcccaaggggcccacaataaataacacagtcactcctattggtacagcaatgccaagatttagaagttatttcataggagctgggacaaaggtcaaacctctctttgggcaagaccgtattctttattgcatagctttgaaaagagattttgtattacccaaacatttattttaaaaaggcacccccatatatccatcactcgaactgtacatttctaaatgtacattgacctttggtatattagtctagcaatccagattttgcctcttgttaagcgtatcagggtcctggcagga

SEQ ID NO: 2503 - DNA, 300 bp, Homo sapiens
agacactgaaggaaccaataaataatcctgcctctattaatgtatttttatttatcatgtaacctcaaagagccttctgtattgagtaagcattctatgtctttttttaattgtacttgtattagatttttaaggcctataatcatgaaatatcactagttgccagaataataaaaagaactgagtttaattatgaataatatgtaagctaggacttctactttaggttcacatacctgcctgctagacgggcaacatgaagtaggacagttctgttgattttttagggccatactaaag

SEQ ID NO: 2504 - DNA, 300 bp, Homo sapiens
tccccatctccacactccctaccctctgtcccctcaaccctgctttatttttttatgaagaagagagatgacattatttggattttgatattaaacagctaggttatcttaggtaaatacataagcttttgtgggccacagtttcttcatttgaaaaatgaagttggactagttttgcagtgcttaactgcacagagcattagaatcacctggggagacttcataaactacacaaccaggggtgtacctgagatcaaatgaatctaggccttctcaactttaatgtgcagacaaatcacc

SEQ ID NO: 2505 - DNA, 300 bp, Homo sapiens
  misc_feature 18: n = A,T,C or G
ttgcaggatcccatcggntcgtccccatctccacactccctaccctctgtcccctcaaccctgctttatttttttatgaagaagagagatgacattatttggattttgatattaaacagctaggttatcttaggtaaatacataagcttttgtgggccacagtttcttcatttgaaaaatgaagttggactagttttgcagtgcttaactgcacagagcattagaatcacctggggagacttcataaactacacaaccaggggtgtacctgagatcaaatgaatctaggccttctcaact

SEQ ID NO: 2506 - DNA, 300 bp, Homo sapiens
atctatatctattaatatttttctgtagatctatacctatcatatccatccatatgtttatattatatttacctaatctatttaatctatatcatgttatgcacatatatatgaaacatttttgagtggaaaattttatggaaaaagtattctatataaggtggattagtaatcctcttttgaaaaaaaattctagttcttctcaattgtgaaagatatgtctaagctttctaacaaaatgaactccaaacagtcttagatgtctgcctctttttaatcatttagtgaaataattggttt

SEQ ID NO: 2507 - DNA, 300 bp, Homo sapiens
gttggtgtgtgtctgcatgtccaaatctccctctcctttctcttataaagacataggtcattggatttagggcccatcgtaaatccaggacaatttcatcttgacatccgtaactgattttatctgcaaagtctctatttccaaataaagtcactttctgagatttcaggtggacagttatttgcggggatagtattcaccccactagattcagggttgtgggaagtgttgcttactaaactctggttcacggagctgccaaagaaaagagatttatttttaaacctaggagagaaggca

SEQ ID NO: 2508 - DNA, 300 bp, Homo sapiens
caggctcatctccaactgacctcatgatccactggcttcggcctcccaaagtgctggagtgcagtggtgtgatcatggctcactgcagccttgacctcctgggctaaagcaatttgccttcctcggcctctcaaagtgctgggattacaggtgtgagccactgcacgtggcctctttttagtttattttttccaaaattattttgaaaagtttcaaggtggaatgtagtgacaccatcacggctcaccgaagacttgacctcctgggctcaggtgatcctcccacctcagcctctcaagt

SEQ ID NO: 2509 - DNA, 300 bp, Homo sapiens
gttgatctctcatcagtgtttgacagttaatcactttttcctccttgaaatacctctttgaggcttccaagacaccacacacaactggtttacctctctctgtctctctcttttttgtttcctttgctgactctttctcagcatttctgctagggttcagtccatggcttccttcacatttctgtctcactttctcccttaatgttgctatctagtcttttaattttatttatttctagttttaaaatttaattttaaaaacttaattttatttaatttttgagacacagtccttgtagt

SEQ ID NO: 2510 - DNA, 300 bp, Homo sapiens
aaaattatcaaaccatcctttgctggcattaaatattcaagttgaagatccttcaccttcctttaatcctatattagagtctataggtgtgtctttcttatagcaatcctgcactcacataaaaactggattttcaatataagatcaaaatgtatttcacaaaaaatgcatctttatatttggttacatttctcctgactgaatggtgccatgtacagtctgtgtaagttatagaaaacgtttgccaactcgtagtctaccattttggtatttggtttctatttggttcgtctggtcttt

SEQ ID NO: 2511 - DNA, 300 bp, Homo sapiens
ctgagacatgagaatcacttgaacctgggaggtggaggatgcagtgagctgagattgagccattgcactccagcctgggcaacagagcgagactcttgtctcaagaagaagaaaaaaagaaaaagaaaaagaaaaagaaaaaacttttgatgccagtagttctgtgaagacaacaaaaaagcagggctttgagagagagcaatgagggcataggtggctgattacatcagatgggttaatctccaagtgaaatttgggggaacggtgttccaggcatagggaatagcagatgtaaaggcc

SEQ ID NO: 2512 - DNA, 300 bp, Homo sapiens
gtaaagtgtactgattgagaactagagttgtggggtcagacagacctggcttcaaatcctcctcggccacttacagctatgtgatctctctgagctcaggtttctcatctgcaaagttgggttaataatacaagttcttgctcattgttttgttgggaggagtgaatgagataaatcacgtaaagcacggaccacagtgactggctgataataagcctcagtggatggtcgcccttagaattattttgtaaccctttgcttttgaggcagctggtgagctctgtagcctcagagattact

SEQ ID NO: 2513 - DNA, 300 bp, Homo sapiens
ggatgggtgccctggagccaggcaaggcaggaggccccagaaacttggtgggggagataacggaggggatggagcaggaggaatcctgaaaaccggactgggagagatggggccgagtggacgatgcccagtaccagcgggcgtctgagactgaaacattaattctgaagaagaagaaactagacagtcagacctccaggactaagatgaagtgagccgagaggagatcgtatcataagaatgcttctgtcgttagccgggtgcagtgctgtgtgtatctagttccagctacttgagagg

SEQ ID NO: 2514 - DNA, 300 bp, Homo sapiens
ctaaagccggctatgggaagccatgtcatacttggctaccttcctatgttccttctcacagcaaaactcttggactgatcatttgaagtcacccctctgtgtcttcttgtgaaatggcttgggcgtctctgggctctgacttgctcatctgggaagagatggggtagagggagttggattataaatcatgcttcactcagtcaacagaatgctactcaggcactaaaaatgatggcgtagccctacgtattctgacatgggaagatggccacaatatcttattatgtggaaaaaactagt

SEQ ID NO: 2515 - DNA, 300 bp, Homo sapiens
aaaatgctttcctatacatcatcttaccacagtatcgtgagacagtcaggaaaagtagacaaatgtcattaacttcattttaaagatgaagaaactcaggcacaaaaacagttatcaaattgccaaaagggcacatagttttagaaatgggactgaaatccagctttcctgactcaaagtcctatgttaatccaccagtcatttattgagcttctgctatgggctatgtattgtgctgaatgtagaccaacacagaataattcctaaatcttacagactttttcatagtaccctgtctgg

SEQ ID NO: 2516 - DNA, 300 bp, Homo sapiens
tataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgcaaatgagaacagcgcctcctctgagctgc

SEQ ID NO: 2517 - DNA, 300 bp, Homo sapiens
cttgcttgaaatacagaatgtccagatctactgagtcagaatttacattttcaaaagcttcctacgtgactcatgcatattaaagtttgggaagcactgacttagattaccttttgagaattccagatgggtcagaaaccagacagaaatactcagtagtgagaagctatggtgtatcagaagctgttaggcatttcatggtttggtagtgagcaagacagatagttttcctgtattcagcgacttagtctagagagagacaggatggaattaagtgtttaggtgctagccaaaagtaaa

SEQ ID NO: 2518 - DNA, 300 bp, Homo sapiens
aaatcagttattaaactttatgtatatattttagccagagcttaatttttatgaagataaagacatgaagtttaacaatggacaacagttagtacagctaattgtgaggtcaagtaattgttagacataggggaaggctttgttccacaatattatatggaccactgaacaagaatgacagccctttgttatcacttggcatatgaaaagtgttgtgtgcatagtttgtgttaattttttatgtgcataaaaatgtgattttaatttatatgctctgaaggataattcagggtatagtta

SEQ ID NO: 2519 - DNA, 300 bp, Homo sapiens
aatccttcttgggaaacatgttattgtcctcattgtccagattagaaaactgagtgtaaagtaagttaaattatagtcctaaggttgaatgctaataaagacagaatacaagtccaatatattggactcaaaagccctcacttaactatggtctccatgggcttcccttggctctctctgcctttttttattttttcttattgcttgaggccctttctggaaggtaagtctggattatctacttcacactgttttagagaagacttgtggtttccatttaccccttactccctccgctcc

SEQ ID NO: 2520 - DNA, 300 bp, Homo sapiens
ctttcagtggcctccctgtggaagtgacatgctcatttttgccttattctgtaagtggggagtcactaagtctagcctatattcaagggtaaggagagttaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagt

SEQ ID NO: 2521 - DNA, 300 bp, Homo sapiens
  misc_feature 219, 221, 225, 249, 266, 273, 276, 277, 284: n = A,T,C or G
gttacaaacagtggaaaacagacattttcagatgtttgcacaccatgcaccatgcaaaatacaaaccagctgaatcataaaaacaaatgactagttactgggagggttttctctctttctcattatttttacttctaccaaagtaatgtgcacatactggtaattttattttattttaattttcaccaagctagctaattttctttcttttttttttgngnaggngggctgtcggccttttgtcgaggntgatctccaactcctgncctcaancannccttccncttgggcctaccagag

SEQ ID NO: 2522 - DNA, 300 bp, Homo sapiens
ggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcac

SEQ ID NO: 2523 - DNA, 300 bp, Homo sapiens
ggctgcctggggaaggagaaatctgagccaagacctgacaaatgaataggagtaagctaaggaaagtgactggggtgagtgagttccaaatggagggaactgcatgtgcagaggcctggaggtgaggggaacctgggcacattccaggagctgaagggtttgttgtggctggaacataaagagccaaagggggccaagcagtgcttcacacctgtaatcccagcactctgggaggccgaggtgggcagatcacctgaggtcaggagttcaagaccagcctggtcaacgtggtgaaaccct

SEQ ID NO: 2524 - DNA, 300 bp, Homo sapiens
aggcatttcaaactgaacacatctgatacagaacttttcatttccttcccaactttgcccacgccagcctgctcctccttcacgctttccacttagtatatgatcccactattcactcagtctctgaagcttaaaacctaggattcatccttgactactgtattctttacaatctactcctaatgcattagcaattcttgctagctctaccttcaaaatatattctgaatagactatttcttgccgtttcccttgcctccccatttcccatctgcaccccttctctcctccccaaatcaa

SEQ ID NO: 2525 - DNA, 300 bp, Homo sapiens
aggatgtctgctggacatccaagtggctgtgtcaagtagtcatctgtctatttgtgtctgaagtgcccaggagaggcctgagcttggagcttacatctgggactcattgctaagtaaattatatttatgtaatgggaaaggatgaaaacccacatgtaggatgagagttggccttgagcctttagcgttcccgtagtttcttttatttatttatttatttattttgagatggagtctcactgtcgtccaggttggagtgcagtggcgcgggcgcgatctcggctcactgcaggctccgcc

SEQ ID NO: 2526 - DNA, 300 bp, Homo sapiens
ttcttgaggagctgagccttcgctcctcagatcacaggctcacatgttgaagctggcagtgctagagactagttcctatctgtgtgacagcatttttaatttaacaggaccgcctttgatgttcccaaatatttataggcagctttagatcatttcagtgtgtgctttctttttcttctctctctctctctctcttttaactggagcaaaagttcttcctcatgcaacagccttccttttatcctgtttagtttatttttgtttcctttgcagctttggcgaaggctgtctggctgcatt

SEQ ID NO: 2527 - DNA, 300 bp, Homo sapiens
tgaagccaggaaagggggtgggctagggggtgctgttttaggtagagtgatgggaacagccccactgagcatactttagccacatgagtagctggaagaaaagccttctaggaccagggaacagcaagtgcaacagccctgagacaggatgggcttgtcagtttgaggagcagtgggaggcctgaaccaggttacatggggcccagccagtatggccacgactttgtgttttatccagagtacaaaggagcctcactgagggacaagggaagtggcatgatgtgacccgcatattaagag

SEQ ID NO: 2528 - DNA, 300 bp, Homo sapiens
gcggagaagaggggtagtggttggaaggaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacatggcgccatgagccagcctctcaggaaaagggtctcatgaacaaatgaggaaagcaagtagaggtagggcagggagggagaggcaaaggaat

SEQ ID NO: 2529 - DNA, 300 bp, Homo sapiens
  misc_feature 253, 255, 258, 263, 267, 268, 281, 282, 289: n = A,T,C or G
agcagtatagccacagcaccaacgaatgaggaagagcaaaatactgcatgacagctttgctaagaattctttcactttttttgtctatcagccaggagctagcaacttggcttatttggaaattttaagtgtacatatcctggctccttaaatcctttacagatttaaagtgcagtcagtggagggcgagtggtttcggaaaaaaaaaagaaaaaaagaaaaaaaaagaaaaaaaaaagattttttctttctntnaancggantcgnnatggggttggatnntttcaangggggggttaa

SEQ ID NO: 2530 - DNA, 300 bp, Homo sapiens
cccaaccccaggtgtgccgcgtgctgcccctgagagccctgccccgcgctgtgaccccggagatgcgcgccctggtggtagactggctggtccaggtgcacgtaggagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgagcccgccttcctctgcctcctgagcgcggactccttctca

SEQ ID NO: 2531 - DNA, 300 bp, Homo sapiens
ccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgt

SEQ ID NO: 2532 - DNA, 300 bp, Homo sapiens
agttttggatgagacttggtatggtccattctgggacaaaattcctctctctctctctctgcggacccgtgaaatctagaaaataagttatttgcttctaaaatacagtgatgggacagacataggatagacattcccatttcaaaagtgagaaattgggccaggtgcagtggctcacacctgtaaccccagcacctgtaatcctagctccccaggcggctgaggcaggaggattgcttgagcctgggagatcaaggttgtagtgagccatgattgcgccacctttattggaaactttta

SEQ ID NO: 2533 - DNA, 300 bp, Homo sapiens
ggccaaactagggcctgctctgacatccgcaatgtacgtccactagcagtgcgcaagacctcccgcgagacaggtgttgtttttaatgcccatctcacagatgaggaaaagatctcaaagtaccttgattatttacccaaagttcccgacccaggcctttaaaactttttatgcatgcaccgcctcttgaccacatcagacaatcaccacaaaacgatgggctgacagttactagagggttagtaacttatctttaaaagggccaggtagtaaatattttaggctttgtggccaaaagtc

SEQ ID NO: 2534 - DNA, 300 bp, Homo sapiens
acatacagtttattattcacacactgggggagggtgatgaataatgattatttaatgagccctcttcctagttttccctaagtctgcagaagacaaagatcctgtttccaggccatgaaaggactgaagtaaatattgtaaataagtacagctgacccttgaacaacatggaggttaggggttcagttgaaaatctgcatgtaagtggacctgtgcagtccaaacctgtgtttaactgctgaattaaaggtgcttccttctgctcattgatattacccatatttacaaacatgctagaga

SEQ ID NO: 2535 - DNA, 300 bp, Homo sapiens
caaatattaaatattcaatgaatgatagctgcctctacttctccttttgttgtttttattttccatttatgtagtcatttatttattttaatgtcttcgaaagtattgactttaacaagtactttgtgatgcatttattatttcatttgttattatttatgtatttgatttatttctttgtgaggtaggatagaatctcagtcagatttttgctgttaggataccacagactggataactacaaagaagggaagtctgtttaactcgcaattctagaggctggcgcatctaagagcatga

SEQ ID NO: 2536 - DNA, 300 bp, Homo sapiens
ctgtgttctctcaatgacagagaaatcactgtggtgctatgttggtggaacttgctaggaactcccctctatggtgctcaggaaagctgttcgttgagagatatctctctacagtaactctactatgaaaccacccaaggtgagggtaaggatgctgctgcttagaaagagatgcagacaaatgtactaatgaaggctcaacacagctctttcaaggcaagacaggtcaagaggacaaaaagtaaaagtatgaaaggctttaagaaatcaggtagatcgtaggtgtatgtgtgtgtgtgt

SEQ ID NO: 2537 - DNA, 300 bp, Homo sapiens
gagaggtaatgcttcattttgcatagttgggaatcaagataatctgtttttaataatacaagaaacaaaagcataactatattatttatattacaaaagcaatctttagaaaaactaaaaggggtatataagtattgagaggagaggaaaaggaatgatatggtatcatgaggtaatttttgatcaattatagtaggaaatagacaatatctaaaatggataaagggaaaatggcaatattatctttttattttatattattttaattttttaagacaagtgctcgctctgtcgcccatg

SEQ ID NO: 2538 - DNA, 283 bp, Homo sapiens
  misc_feature 177, 178, 184, 190, 199, 202, 205, 212, 218, 221, 222, 225,227, 234, 235, 237, 239, 241, 243, 244, 247, 250, 259, 262,269, 270, 273, 277: n = A,T,C or G
aagtgactcaggttacttccagatggtgaggactttctgaagctgtcgcccttacaggccatgacttttctctagcactgtccagattgcaggtgtctttcctgatgcgatatggggctatcccttaccccaattcttatttcacggagaaaagaaaagcaattttttttttttttnnaaacanagtctnattttgtcnccnggntaaaggncagggncannatntnggttaanngnancntnngcnttnggggttaangcnattttcnngcntaancctccc

SEQ ID NO: 2539 - DNA, 300 bp, Homo sapiens
ggccactccgcctcttccctcccttcgtcccttcttcctctcccttttttccttcttccttcccctcctcgccgccaccgcccaggaccgccggccgggggacgagctcggagcagcagccaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcct

SEQ ID NO: 2540 - DNA, 300 bp, Homo sapiens
caattacaaaaatggcagcaggagattaattatgagatctacactgaaatgacttaacctaaaattaatgtgttggcagtttgcaatatgttaaattttggcattatctctcttttggcaatataaaaatctttttttaaaaaacatgacatttgaattgaacatgtgcagaacccctgaagtatgtctgagaaaccctaggttctgtggcatatgagatgaaaaccactgacaaagagaaccagatattacatatgttcactgcattttcacatcaagaaggcttgggaaaagggctag

SEQ ID NO: 2541 - DNA, 300 bp, Homo sapiens
cagttttgctgtacctcttgaaagttaaagagacatctcagcactttaggaggccgaggcgggtggatcacttgaggaataaccaggccatacggagttaggagctgaagggacacgatgagaagtgaccagaaggtaagagtgtgagccctctgtcacgcccagataagcgcaactagaggactccttggtctagtggtaacgccagtgcctgggaaggcacctgttacttaagcgggaaagggaatctccttttccctggaggaattagagaacactctgctccaccacttcttgtgg

SEQ ID NO: 2542 - DNA, 300 bp, Homo sapiens
gcttcttgtgttggaggaaacttcagatacttcatttactccagagtgcccagagattccccagtcggaaaggatagactgcacacctgaccaggaggtgaccgaggatatctgcagatggcaatataagtgctgctggtcgcctgtggcagatgccaatgtccctaggtgcttcttcccctggaactggggctatgaagccagcaatggccatacaaatacaagcacaggatttactgcccagttgaaaaggttgccatcaccatctctgtttggaaatgatgtcgccaccaccctttt

SEQ ID NO: 2543 - DNA, 300 bp, Homo sapiens
gccatacttcctgccttccaggaacagggacaccagtgtgactggagcacagtgagcagtggggtcggaccggacaccgtcgccaggtcctgtggggccttgttgctattgcaagggcttcggtttggactgagagtgagcagagaagcctgttagagagtttcaaataaagatgggacatgatctggctgatgttcttggaggacatgctgctgctgtgtctcatgagaatagactgaagcggggaagagtggaagtaggaaaaccagttgggaggctgttgtaacctaggtgagtgag

SEQ ID NO: 2544 - DNA, 300 bp, Homo sapiens
gatggacagtggcactcggtggcagtcaccataaaacagagactgctttggtgtgaccgacgttgaggtcccacctgccccactgtccatagaggccgtgacctttcctgcctccaggtaaacacataagtgcttcccgggctgacttccgatgtgtattaggatcccagtgagacttcttgggcggatgctgaaaacaagcttaaattctggccccaacaatacagagtgagccaagacgacatgacctccttcttcagagaaataaatgcctttctccaaagcctctagaactatagt

SEQ ID NO: 2545 - DNA, 300 bp, Homo sapiens
ggcattcacattttaatattccttggatgaacatggcatcatatgattagaaaaccaaaattcatttttgatggctgttgtggtcagatcgtgtcctctaaaattttatgtgctggaaacttaatttctagtgtcaacagtgccgagaggtaggggctttgggaaagtttaatggattaatgcccacatataagggcttgttggagggaatttgggctctttgttgccccttccatcctttctaccatgtgaggacgccacactcctcccctttggaagatgcagcaaacaaggtgccat

SEQ ID NO: 2546 - DNA, 300 bp, Homo sapiens
ctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtc

SEQ ID NO: 2547 - DNA, 300 bp, Homo sapiens
ggaaaattccagtttatacctgttgtacctgtgtaattattggtagcactccctttcactcttacaatgtcttggtttggatgatatatggtgaagtttttgttgaaactaaattatgaagtctgatatatttggataaaaataaagaattgcttttcttctccttttgctgattttttgacacatcattctaagcaaaatcatctcagcttcgtatatttcagcctgaagtacttcttaccaaagttgtttcatgtaacatttgttcaatatgttcgtgacatgtctctcagtaatgaa

SEQ ID NO: 2548 - DNA, 287 bp, Homo sapiens
  misc_feature 259, 260, 261, 262, 263, 286: n = A,T,C or G
tgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtannnnnctgacctaaaggttttagattcnc

SEQ ID NO: 2549 - DNA, 300 bp, Homo sapiens
gggatcaagtccatcaggtcccaggaaaggcgtgaatgggagtctgaaggggagaaatggaactgcaaataattatttggaattatttatttatttatttatttatttatttattttttgagactccatctcaaataaataaattaaaaaaaactgctccaaacaaaaagatataacttactttagtgcataattctaaacggtgtttttgctataaagggcatcattgggataaatggtgaaacttgaatgggatctgagaattacatttaacttttctgtaactttgtgcttatttca

SEQ ID NO: 2550 - DNA, 300 bp, Homo sapiens
gtcagaggtcaacaatgagtatgtggcaataacaggattcaaacccagatctgttagcttccaaagtccttggtcttacatgctacccactagttccttggagggggctccggaccatggaggtcacacaccagtgctccgagtgtggtcctcacagcacctgcatcaacatgaggttgggatttgattaaaagtggatttctggggccacccacattctgaatctaaagttctgggtgtggttttaggaacctgtgcttttaacaagtacccttagtgatttatatacttactaaacac

SEQ ID NO: 2551 - DNA, 300 bp, Homo sapiens
gagcagtaaggtcaatttctagtctgctcttgtttccgacttgtgaaaataagctgttaatttacattgtccaggtgagggagaccacctggggagacagctgtttagaaacaaaaggaaagatggtttttgtttgtgtggctcagtttcaaagcttaattttccctttttttgtagtgagtttgtgatcccaagattttattttccttttacaatcacatggaatggcacccatttatttagaattgtttctctactgtctcctcacctgctggagactgtgagcagctttatggctct

SEQ ID NO: 2552 - DNA, 296 bp, Homo sapiens
attacaacaatatggatagtagggaggaggaaaacaagaggagaatgggatcaacagaaggcatatatggggagtgtctggatggctggaaaattccattttttgaccaagatgtggtaaacacggggagtaaagttataattttttctcttactgtgcttttaggttttgttgctttctgtctgtatgctgtgttccacaataataaaaatatttaaaaggcaaaaaaaagtaaaataatgaatataaaattacactgaaactacatattctcatagatagaattgtaattatta

SEQ ID NO: 2553 - DNA, 226 bp, Homo sapiens
  misc_feature 199, 201, 212, 214, 225: n = A,T,C or G
gaaacactgaaatgtatacttttaagtgggtagattttatggattgtgaaatacagcacaaagctgagaaaaagggaacagaaaattatcaaagtcaaaccctacacaaagttattagaagagaaaaacactacagaaagacacgctcaaaaaaacagaacaaatctgaaacatggtaagacccctctccacaaaaaananaaaaaaaaaangntttaaaaaacnt

SEQ ID NO: 2554 - DNA, 300 bp, Homo sapiens
agcctctgatcatcaagacatggcagaatacaaagacaagtcacaggctagctgaagatatttgcaatacataaatccagcaaagacttatatccagagtatataaagaagttctgtaaatcagtgagaaaaaagacaaaccccccaattaagaatagtcaaaagatttgaacaggcacttgacaaaaggggggtattgaaatggccaataaacacataatcattacttatcacagaaaagcaaattaaaaacagaaagagataccacaacctcctccccagaatgtctatatggaaaca

SEQ ID NO: 2555 - DNA, 300 bp, Homo sapiens
gaaacagttggctattcatcatcttcggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgacccaaatgaacctcgatactgcatttgtaatcaggtatcttat

SEQ ID NO: 2556 - DNA, 300 bp, Homo sapiens
ctaaaagaaaatttatattctaatttttatttgttgcctatgtttcataatttttaatctaaggtctttttagaaatgtttgttagtccaaatgagtgctcacaatatggtaaacacatgggagatttctttttttttaaattttatttccatacgttattggggatcaggtggtgtttggttacatgagtaagttctttagtggtgatttgtgagattttggtgcacccatcacctgaacagtatatactgcactccagcctgggcaacagagcagactccatctcaaaacaaacacac

SEQ ID NO: 2557 - DNA, 300 bp, Homo sapiens; identical to SEQ ID NO: 1364

SEQ ID NO: 2558 - DNA, 300 bp, Homo sapiens
cccttctgagcctgtccattcatcggtggttctgcccctactcccccagccctaaataccccagctgctgttcctccccatcacccagccaccggattctccattcacccctttctctcacccctggagccccgtgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggt

SEQ ID NO: 2559 - DNA, 300 bp, Homo sapiens
atgaccttctgcctgttctatctctgaggacagttgtgattggatttagggcccatccagttagtccaggatgatctcatctcaagatcctaaatctgattacaattgcaaagatcctttttccaaataaggtcacatgcacgtaagttccggggattatgcttgcgtgggacacatcttttttgaggccaccattcaacccactacaaaatccaactgaagcccagcgaagtggctcatgcctgaaatccccgcactgtgcgaggccaaggcaggagggtcacctgaggccaggagttc

SEQ ID NO: 2560 - DNA, 300 bp, Homo sapiens
ggagatttcaacttaacttgaccactgcactccagcctgggtgacagagcagagcaagactgtgtctcaaataaataagtaagtaagtaagtaaatatcctgtaggtatctatgtgactcaaggctagtcactttcctatctatgctccagttttctcatatttgagacaagagacttgattttagcataaaggtgagagttgaagtaatgagtgtgaaagaggaaagggagaaaacatacagagaagagcagaaaacacaagcagctggtaggcagagaatgcagaaattcaagttaga

SEQ ID NO: 2561 - DNA, 300 bp, Homo sapiens
cagagttttgagcagagaagtgacactatcagacttaagcattaaaagaattgtccaatgaatggctgtgctgaaaatatatttgaggtaaagtaagctagaggcaggggtattgaaatcaggctaagagatgtttgtggtttgaattaagtggtagcaggaggtgttaagaattagtcacattgtgtatgtattttgaaggtacaaccaacaggatttccaggcaagatagagtgtgatgtgaaaaagaaagaaaggagtcagtagtgactcaggagtttgtctgagcatccgaagtgt

SEQ ID NO: 2562 - DNA, 300 bp, Homo sapiens
ctgagacctcgtctctataaaaacaaaacaacaaaacataaacaacaacaacaaataactatgtgataagcattgggttaggcactagaaaatagtgctcaaacaacaacaacaacaacaaaacatgattcttgtctcaaagaatgcacaatgttggggaaagacaactaaaaagtaataaaacataaagtttgaaggatattatgatagaggaattataggatacgttcaatcatttgaaatttttgaatgtcatccttttgggtggagcaccgagagggtttgtgaaaaagcttcccc

SEQ ID NO: 2563 - DNA, 300 bp, Homo sapiens
gagtggatatgttcgtggagacactgtggaaagtctggaccgagctcttggatgttcttggacttgacgtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggaga

SEQ ID NO: 2564 - DNA, 300 bp, Homo sapiens
ggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggtgggtattttagacttcattctcctagctgtgaattaagggtaaa

SEQ ID NO: 2565 - DNA, 300 bp, Homo sapiens
gcacaagccactgtgcccggccaatactgcaaaatattttaaaaagttaaaattatctcttctggctggtcatagtggctcacacttttaatcccagcacactgggaagctcagtcagaaggattccttgaggccaggagttcaagatcagtctgggcaacacagaccccatatctccaaaaaaataaaaataaataaataaaacagttatcaggctgggagtggtggctcatgcctgtaatcccaccactttgggaggctgaggcaggcagatcatgaggtcaagagatcaagaccagc

SEQ ID NO: 2566 - DNA, 276 bp, Homo sapiens
  misc_feature 172, 173, 175, 178, 187, 190, 196, 198, 200, 201, 202, 216,219, 226, 228, 229, 231, 237, 249, 256, 263, 266, 268: n = A,T,C or G
ggaactccaggcttgccactacccaaccccagcctggctctgaaaatgttaattgactgtcaggacggcttggtggggcgggggcgaggttgcagtgagtgagccaagatcacaccactgcactccagcctggtgacagttcgagattctgtctaaaaaaaaaaaaaaaaanntnggncctttaaanctntagggngncnnnttacgtaaatccanacntgataananncnttgatnagtttggacaanccacaantaagaangcntngaaaaaaa

SEQ ID NO: 2567 - DNA, 300 bp, Homo sapiens
acagagcgagactccagttcaaaaaaataaataaaaattaaaaaataaaataaaataaaaaatttactaggcatccagcattcattaaggagaataattcagttaaggaggaaaagaattctgggattctgggaatttccttaaccaataaagagtatgtgtgagaaacctactgctaacatcatacttaatggtaaaagtccaaagatcagcaaaaagaggatacctggtctaaacacttccactaagcattatactggaagttctagctagtgcaataaatgaaagagtacaaagtat

SEQ ID NO: 2568 - DNA, 300 bp, Homo sapiens
ggaagggaggtttaaggaagagactgtggacagaggtgttagggaaggtgtcagagaaggttaaggagccaacatggatcatgggggtggtacagtgttgccagggctggggaggattggctgcagtgtggggtacccagccgctgccatgtggagagggacctgtcactcctgctgtgaactctcccttcttctgccctctgacctcctgctggtgcctcccattggctaaacacagttgatggccagtgcactggggagctgttcttggagcccacaggcatctgcttcttggcacag

SEQ ID NO: 2569 - DNA, 300 bp, Homo sapiens
ggtgattgggctggttctgtaccgggtgtactccgtggggggccgtgatctggcaaagccttggaggtgggactgtggaggcaccattgattgaactgtgtcccctgcagttcacatgttgaggcccaaacccccagtgtggctgcatttggagtagggcagtaattatggttaaatgaggtcgtatgggcgggtgctgatccactaggattaggatccttataagaacctgccaccttctctctgccacgtgaggacatgggtagaaggcggctgtctcccacccaggaggagccctta

SEQ ID NO: 2570 - DNA, 300 bp, Homo sapiens
caaagctgttttataaattagggagaagagtgaggagagaggaataggatagacgaaggtagagagagggagcagtggagaagaaaacctcagagtgaggcaaaggaagaggtgtgaaggggaaaagaagtggcgatggcagggaagagcccctggccatgagagagactggggggagtgggaaggaagggaagttatggggcagggggcacagagcagagaacaagagagtaaggctagagagatgaaagaaacagtgagactgagctaagaagagcgatctcacgcttaagagacaga

SEQ ID NO: 2571 - DNA, 300 bp, Homo sapiens
  misc_feature 267, 269, 291: n = A,T,C or G
cccctctccacattgacctctagagtggcctgtccaactcctaagtccaaccttcccacaccggacagaaagctttttactggccccgttgctcccgggtgaggcctaaacacttgatgatgatgaagatgaagatgtgatgatggtagccatcacacagctctcccatgtaaccctcacgacaaccctgcaaggcaaatagcatcaccatccttatttggcaaatgaaaagctgatggctcagagaaggtaaatgacttgcccaangngactgagccagtattgccacanacaggctcc

SEQ ID NO: 2572 - DNA, 300 bp, Homo sapiens; identical to SEQ ID NO: 299

SEQ ID NO: 2573 - DNA, 300 bp, Homo sapiens
gatctcttttgaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctgaaggaggatgggcttttgcccaaaccactctcttctgggggagaggaaga

SEQ ID NO: 2574 - DNA, 271 bp, Homo sapiens
  misc_feature 240, 243, 253, 265: n = A,T,C or G
agacaatcccaaatatttggagattgtcttaactggtttagtgtagctataaaagaatacatgaagctggataatttatgaagaaaagaggtttatttggctcacagttctataggctatacgagatgcatcatgccaccattttcctggagcccttcaggaagcttccactcatggcagaaggtgaagggcagccagcatgttcagtgatcacgtggtgagagggaaggcaagagaganaanagggaggggncacgctctattnagtacc

SEQ ID NO: 2575 - DNA, 300 bp, Homo sapiens
cagttcacagtattaccctcagtgcaccagaattcctttctatccatatactcaccagcacttgttactgaactctagtttttgccaatttgatgggtgtgaaatggcatcttattgtgatttttaatttttctcattacttacaaagttcatcatgtctcctagccctttgggtttcctgttcaatgtcaatttcctatttatgtattggcccacataaaaaatattgcatagtctattttaaaatgatttataggggctctttacatattctgggtactaattattccttatgtgtga

SEQ ID NO: 2576 - DNA, 295 bp, Homo sapiens
  misc_feature 11, 20, 23, 24, 26, 31, 44, 56, 65, 71, 72, 82, 86, 92, 96,108, 118, 126, 127, 129, 133, 137, 146, 148, 156, 158, 169,173, 174, 175, 176, 177, 178, 179, 190: n = A,T,C or G
ctggacgcctntaatgcganaanngnccccngtttaacagaccngcaaatccgggngcggaacangacccnngggtttcctnttgntccctngttngggggcggtggntggggctgtncggccaannangganttgntttttttangntttaaaanangattttaaaantcannnnnnngtttttttttntttttttttttttttaattctgaaacagacctgttttgtaccgagttatttttgggataaattttactggttgctgttgtggagaaggtggcgtttccacctttt

SEQ ID NO: 2577 - DNA, 300 bp, Homo sapiens
atggggtatagatggttttccccctgtgtactctagtaaatttctatgccatttctcctatcgatctgccttttgtcagttgatttttcagcttaacttcagagagcaaaggggaaggtggccaagtgcagtgtctcatgcctgtaatcccagcactgtgggaagctgaggcaggcagatcacttgaagtcaggagttcaagaccagcctggccaacatggtgaaaccctatctttactataaagaaaaataagtcgagtgtggtggtgcacacttgtaatcccagctactcaggaggct

SEQ ID NO: 2578 - DNA, 300 bp, Homo sapiens
gggggttcccaatagtagaaagggtccccattcctgctcagcaccgcacctctctacccccccacagacacacatgcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgcagatacacatgcacacacacatacacacactggcccctgtttttctgtggtg

SEQ ID NO: 2579 - DNA, 300 bp, Homo sapiens
gcttgatcgtctgggcctgtgtttcagctgggataggattctcaatccttcttgttcaaatccgaagtccagaaagctctgaaaactgaaagttttttcataatttatttcactgtaaaacctgaattgaactgatatttatctcactaaaaatgattattcatatattttactgtaagaatagtaaaattaccaagtaatatcccagacctagttagataaatgcactattttcttttaatttcaaaacaatcttaattctgaggcacatttggctgacagcatttcagataagggatt

SEQ ID NO: 2580 - DNA, 300 bp, Homo sapiens
tcctattttacgtggttgttgagaggatccgatggaatgactagctgaaagtgtttgtaaaagtcaggataagtaaagcaatgctgcaggaacaaacaatccccaaatttcagcagcttactacaaaaaaatatgtatttctcactcatgttcatgtccaatgtgtgttagcaaggagatactgtctctcacagtcatgcaagaccccttgctggggaagctgcacctccatatatgcttctaccatcaccagggcagaggagagggagcatggtggatcatacactggctcttaagact

SEQ ID NO: 2581 - DNA, 300 bp, Homo sapiens
atttcctgaggtctccccagccaggctgaactgtgagtcaattaaacctctttccccaataaattacccagtctcgggcatgtctttattagcagtgtgagaatggactaatacaagtaccattaataaatttcacaacgtagattaaatgtgcaaattccttgaaagacacaaattaaaaaatgacctgagaagaaaagaaacttgaatagatctgtatctattaaagaagttgaaattataattagaaaccttttgaacattagaactccaggccccttgttgtgaattctatcgaac

SEQ ID NO: 2582 - DNA, 300 bp, Homo sapiens
gcctgtagtcccagctatctgggaggctgaggtgggaggatcatctgagcccagtagattgaggttgcaatgaatcatgattgtaccactatactccaacctggacaacagagcgagaccctgtcgcaaacaaacaaacaaataaataacctgggcaacagagcgagatcctgtctcaaataaataaacaaacaaaagtagcagattagctgggcgtggtgttgcatacctatagtcccagctgcttgggaggctgaggcagaggatcacttaaacccaagaggatacagtgagccatgt

SEQ ID NO: 2583 - DNA, 300 bp, Homo sapiens
gtttaagtcttgtagctgtatagcattccattgtataacttataatttatttatgggttgtactattgatgaacatttgagtagtcttcagtttggaactaccacatatggtgctgttatgaatacttttgcacaggtatgtgaacacatgtacacattgcagttggtatatatacagtactgaattactggcttataaatatcattaaattttaaaaacaaaattaattgccacaagcatattattgtatctttgaattttaaaccaaattaaaaattctatgagttgttgaatattat

SEQ ID NO: 2584 - DNA, 300 bp, Homo sapiens
taaatgttgaaattaactagacaaagtagttgaagtcctgatgaaaagattgttcagttcttcttctcctgtagctcagaacctgtttggatcatacatttaaatgtagaaatataaagcttttagaagaaaacataggtgaaaacctacaagacaaaacttggtgaagagtttctccatgtgatgcaaaaacatgatccatagaagaaagaaatctgtaaattggactttatcataattaaaaacatttgctttgcaaaatgccctgttaagatgatgaaaaaacaaactacatactgg

SEQ ID NO: 2585 - DNA, 300 bp, Homo sapiens
caaataggagatgggttttttttcgggggggagggaaggaacagctttgcattaacaactactgagaattatacatttaaagattatcttcaatgtccaataacccttatattcaatactgaatttatttccacttctcgccttcatttttatttgttacgtattctcaaagttctctcctagtagaagaatgaaccagaaatgaacataagcatgtcggaattcacgtatgtggcagactgtattttccaaagatggccacaacaatatttctcattccacatggtctgctggaacctt

SEQ ID NO: 2586 - DNA, 300 bp, Homo sapiens
  misc_feature 283: n = A,T,C or G
aattcacgaggtggaaataggaaaagctagatgtgagcagccgacttcacctcgatccttgactctcactattcacaccagttatgtggggagccgtagctcttccaatatggctattgtggaagtgaagatgctatctgggttcagtcccatggagggcaccaatcagttacttctccagcaacccctggtgaagaaggttgaatttggaactgacacacttaacatttacttggatgagctcattaagaacactcagacttacaccttcaccatcagccanagtgtgctggtcaccaa

SEQ ID NO: 2587 - DNA, 300 bp, Homo sapiens
gaagagctgaagagaggaggtggcaggactaactaaaagtgggacagtcacttgttatagtgaaggtagaatggacagaattgggcaactaattaagagggagaaccctctaggagaacaggagaacgcatccaaacctggaaaaccaggaagagaagatccttggtgagaagcagtcaatgagtttgctttgggatatgttgagttcccaaactcatcatgaggtgaggcttccaggtagcaaatgaatcacttgagaccaggagttgaggagcagcctggacaacatagcaagacccc

SEQ ID NO: 2588 - DNA, 300 bp, Homo sapiens
caaaaagttaaaattttatttttctctcatgtaacattttggataatttgatgattccctaatgttgggacccagtcttttctgtcttaggctcacaactatccttgagcctgtgtcatgggggatgactctgaagctgcgtgcaccctgttcattcacattttcttggcctgaacttagtcactaggctattcctaactgcaagagaagctggaagatgtagtcttccttctgaccagccatgtgctcaaccacaaattgagtttcagttattggagggcagaaagaatagatatgggg

SEQ ID NO: 2589 - DNA, 300 bp, Homo sapiens
aagtctcactctcatttgtgctttctccatcccatttcccttccccttttaggcaaccattttagctgacttcttgtttatcttgccagtgctccttcatgcaaatatgggcatatattctttcttcccccactttcttgcataaaaggtagtgtatcatgtatatactgttctgcaccttgatttttttcacttgacatgtcttagaaatctttccttatcagtgtttatagaccatcctcattctgttgcatagcaaaggtgattatattcctgttacctttggggttatggcccatc

SEQ ID NO: 2590 - DNA, 183 bp, Homo sapiens
ctactgagcctggcttgcaactggggtgagctccaccttgaacgtcgatcctcctgcctggtggagccatcccagctgatgccacatgaagcagacacaagctgtccctactaagctctgctcaagttggatattcatgagtgaaataaatgactgttactaagtaaaaaaaaaaaaaaaaaa

SEQ ID NO: 2591 - DNA, 300 bp, Homo sapiens
gagaaacactcagggcctgaaccaaggaattaactgtgattggagaggagaggcagcagccacagaaggcacaaagaaggtggaatcacccaaacatttgtcagattgaggggtgagggggcatgagaactccaagattacactcaggtttctgtctttggtgcctttaaaaattttaaccaaagttgagaatttactgtatgctggggactctataagaggctttatctttattatgtctgttaatccttgcaacagccctgtgagaggtatttttgccctcatttgatggatacctga

SEQ ID NO: 2592 - DNA, 300 bp, Homo sapiens
atatgcacattgtaccaatggcagacttttggctttgatattgttctataattatgtaagatgttaccattatgggaaactggaggaagggcatatgggacttctttgtactgctttttctattccctgtgagtttataattattttataataaaagttcaaaaacacttattggatggacatcacagaacataatagaagaaagaatcagtgaattataggtctgtttaatagaaatgactcaaactgacacacaaagcaaaaagaatgaagaaaacagaacacagtgtctgagacttt

SEQ ID NO: 2593 - DNA, 300 bp, Homo sapiens
cctgcctcccattctatgcaaagtcatccctccgggcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcat

SEQ ID NO: 2594 - DNA, 300 bp, Homo sapiens
ggaatacttcccaactcattttatgaggccagcataactcgtatcaaaacctgacaaagtcattacaagaaaagaaaattacagaacaatattgttagtgaataaagaagcaaaaatcctcaacaaaacattaacaagtgaagtaaacaatatataaaaggataatactgcatgaccaagtgggtgtggttaataatttcaggaactcaacatcagtttaacatttaaaaaaatcaacataatattattaataaaataaaggagaacaataatatgatcatctcagtgtgtaaaataaaa

SEQ ID NO: 2595 - DNA, 300 bp, Homo sapiens
ctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgac

SEQ ID NO: 2596 - DNA, 300 bp, Homo sapiens
gttaaaagaataaaaaagaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaa

SEQ ID NO: 2597 - DNA, 295 bp, Homo sapiens
gcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgtgg

SEQ ID NO: 2598 - DNA, 300 bp, Homo sapiens
gaagagaactatctaaatgagtaatggtcaagaaattttaaagcataatgacatgaaacaaacaaccggtccaggaagctcagagaatacaattcatgacaaacaacaaaaatacagcaccagacatagcatttcctatatgtagaataaaagaaaataaaataaatcaataaatagacaaagagaaaatcttgacagaatctggaatgaaaactacattccttgtagagaaaaaagagcaaggatttcagcccacttccagtaagaaaccaggcaagaaagaagagagttgcgggaaat

SEQ ID NO: 2599 - DNA, 300 bp, Homo sapiens
aataattatgctgaatgaaagaagccagacagcaaaaatttcctactgagtgattccatttatataaaaatctagagaatgccaattagcctttagtgaaataaagcagaacagtaattgcctgtgacagggtgggaaagatttggactggaagcagggattaccaagaggggtgagaaaacttttgaaggtgatgaatatgtacattgtcttcattgctttgatggttttacaggtgtatatgtaattcaaaatgatcaaattatacactttaaatatgttcagtttattttatagaat

SEQ ID NO: 2600 - DNA, 294 bp, Homo sapiens
  misc_feature 251, 269, 288: n = A,T,C or G
atatgctgaggtcctggcctccagtacctcagaatgtgactgtatttggagatggagatacagccttcaaagaggtgagtaagttaaactgaggttgttaagatgggcccgcaaccaatctcaccggcatccttagaagaaaaggagttggagacacagagagagaggctagacacaggcacacgtgaagggacggtcaggggaagcggcagcgagagggtgctgtctacagccacagagaggcccctgangagaccaacgctgccggnaccatgatactggactganttaccg

SEQ ID NO: 2601 - DNA, 300 bp, Homo sapiens
tgattctggaacagagtgcacaccaggagaatctaagaatttgggtcaaaaagaaaatggcaattacatcatattctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttg

SEQ ID NO: 2602 - DNA, 300 bp, Homo sapiens
ccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcc

SEQ ID NO: 2603 - DNA, 300 bp, Homo sapiens
cccatgtcccgcccgctcgtctgcctggctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttctttactgctatgagctttactgaacggctgaaaaacttggaaaataaaatggacatgctgtagtcttga

SEQ ID NO: 2604 - DNA, 300 bp, Homo sapiens; identical to SEQ ID NO: 1392

SEQ ID NO: 2605 - DNA, 300 bp, Homo sapiens
ctaaggaaagggcctagggccaaggcaggctaaatgccactcgggtctttgttattgggcttttattattctgttggtctgttccaccaccccagtggatgttaataggccaaattttgtaaacattttgaataatttgccctgtaaaatgagttccttagtcactgtgaagctcttgagagacttcccaggttgatataatttttccagtaaggtttaactactgccattgctgtgacctatcaagaagaaggtgttaacccagtttgaaaacatgcaaatcataattagtacgtgctg

SEQ ID NO: 2606 - DNA, 300 bp, Homo sapiens
ggaagtacaaattaagatcacagtgagataccattatccacttgtcacaatggctaaaataaacaatagtggcaataccaagtcctgtgaaggatgtggagaaatggatcacttatacactgctggtgggcatgtaaaatggtacaaccagtctgaaaagcagtttggcagtttcttataaaagtaaacatgtaattatatgctgtggtctgaatgtcctccaaaaatttatatgttgacacccaaaccctcaaggtgatggttttaggagggtaggccctttgggagattagtttctga

SEQ ID NO: 2607 - DNA, 300 bp, Homo sapiens
gctcaaacaatctgcccacctcgtcctcccaagatgctgggattacagtcatgagccactgcagccagcctacatttttaaatggttggaaaatcaaaagattatttgatgacatgtgaaaatggtataaaactgtgaaatctattgtccataagtaaagttttctttgaacacatccatgctcactcgttaacttattttccatggctgctttcatgctgcaatcttgtccctgcccttaaagagctaagggtctagtagagaggcagtaatggtgtgagataatggctaaatggaagc

SEQ ID NO: 2608 - DNA, 94 bp, Homo sapiens
  misc_feature 52, 55, 56, 63, 64, 80, 81, 83, 86, 91, 92: n = A,T,C or G
cccctccagcccccaaacatagcttcaaaaccttccttgctatttgttcttnggnnggggggnntttttaataatcgctnncncgnccccnnac

SEQ ID NO: 2609 - DNA, 300 bp, Homo sapiens
agaaggcaggaatgtcaggcctctgagcccaagccaagccatcgcatcccctgtgacttgcatgtatacgctcagatggccagaagtaactgaagaatcacaaaagaagtgaaaaggccctgccccgccttaactgatgacattccaccattgtgatttgttcctgccccaccttaactgagtgattaaccctgtgaattaccttctcctggctcaaaagctcccccactgagcaccttgtgacccccgcccctgcccaccagagaacaaccccctttgactaattttccattaccttcc

SEQ ID NO: 2610 - DNA, 300 bp, Homo sapiens
gacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcat

SEQ ID NO: 2611 - DNA, 300 bp, Homo sapiens
gagaactccaaatagcccaagagggtggtgcacccccaacttcataagggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaa

SEQ ID NO: 2612 - DNA, 300 bp, Homo sapiens
ccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactact

SEQ ID NO: 2613 - DNA, 300 bp, Homo sapiens
agagaactagtctcgagtttttgacagataatagccaccctaggaggtgtgaagtggtatctcattgtggttttccatttttctgatgactgagaatgttgagcatctttccctgcgtgttgtccatttgtgtatcttctttagagaaatatctgcttacgtcctttgcccagttttaattggattgtctttctgttgctgagttgtcggaattggttgtacatcctccatactgagtcctcatcagatacctgatttgcgaatattttcttccataccatgagttatcttttcactttc

SEQ ID NO: 2614 - DNA, 300 bp, Homo sapiens
ctagaattctgttactgtcaaaaacgttttcaaaaatgaaggcaaaataaagactgtttctgagaaactaaatcaaaggtaattttattacctgtagacctgtctttgggaaacattaaaggatgtttgagggcagcaggaaaataatacaaaacttaagtttgggtctgtacaaagaaaatcagcttttctaagatcaagccagagttgcttctcttacaaccttacggcgctaatgcattaagttgaagtcgactgccaaagaggcccagcagagggcagcacccccatcattttttt

SEQ ID NO: 2615 - DNA, 300 bp, Homo sapiens
gcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctgg

SEQ ID NO: 2616 - DNA, 300 bp, Homo sapiens
gtttagggtcagatccatgtatttgtagcttggaggtgagcccaggggttcatacacaactttgctccctactgtctgtgatccctctgccactttctggttccttggagctccctttcatgatcctcctgtcagaataccagggctttaatttgcccactctctgccatgcacttctcatgactgcatctgcatccagggccaagcggtaggaggacagagggagcctaaataaacaataggatttgtttcacagtcttgaagctacagcttctctggtcagagaaaagaattcaaagc

SEQ ID NO: 2617 - DNA, 288 bp, Homo sapiens
taattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgcttt

SEQ ID NO: 2618 - DNA, 300 bp, Homo sapiens
caacaaactaggaatagaggaaactatctcaacataatagaagttatatattaacaacccacagcagacgtcacattcaatggtaaaataccaaatgctcttcctctaagatccaggaacattacaaggatgcctaactttgccacttatattcaacatagtactggaagtcctaaacggagcaattaggcaagaaaaagaaataaaaggcatccaaattggaaaggaagaggtaaaattatctctgtagctgatgatgtgatcttattttaaatgctgtgatcctaaggataccaccaa

SEQ ID NO: 2619 - DNA, 300 bp, Homo sapiens
ctcctgccctccctggggtggttctgtcttttgcaaaggtggctgcatccttaggggaaggtgaggggagaagcagggagcatggagagaagtggctttcgattttctctctccttttggggagttcctccttatgtggctggtctggtgcatagtgtgatgtattcctgtacgcaacgttgccctgacagccagtccaagctgagtctagagctggcaaggtgagctcccagtagtaagagggtgtgggcggcaagccacccaggcaccgaggcaagagacagaggacacgagctgttc

SEQ ID NO: 2620 - DNA, 300 bp, Homo sapiens
cttgagagaatagatctagatgggtggggcacggttctggggaatggaagggccaaagaggaaagtgggcaatggtggggttgagaacgcagcttctggactcagcaggcctgggttcaaactctgttaatcactcctgttaatcccagcgctttgggaagccaaggagggaggatcacttgaggccaggagttcaagaccagcctgggcaacataatgagattccatctctacaaaaaataaaaacaattagccaggtgtggtggtgcacacctgtagttccaggtacttggaaggctg

SEQ ID NO: 2621 - DNA, 107 bp, Homo sapiens
  misc_feature 61, 62, 67, 69, 70, 73, 74, 76, 78, 79, 82, 83, 84, 90, 91,94, 95, 98, 101: n = A,T,C or G
actttaaaccctacctgtgtgattcagtagggtttgagaattacgtgtgatactggggggnntgggngnnttnntngnnagnnngggggnnttnntcnttntttttg

SEQ ID NO: 2622 - DNA, 300 bp, Homo sapiens
catttcttgtctttattaatttgacttctctagggacctcatttaaatgaaatcatacagaatttgaacttttgtatctggataaaaaatatatacagcattttgctgactgtaaaatgtatttttttgggccgggtacggtggctcatgcctgtaatcccagcactttggtaggctgaggcaggtggatcacctgaggtcgggagtttgagaccagcctgaccaacatggagaaaccccgtctctactaaaaataaaaaattagccaggcgtggtggcacatgcctgtaatcccagata

SEQ ID NO: 2623 - DNA, 298 bp, Homo sapiens
  misc_feature 7, 10, 13, 23, 24, 30, 35, 38, 43, 48: n = A,T,C or G
tttgggnatntgnggggtttttnntttttnttttnccnggtcngttanaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcaaagagattcttaaaagtatctgtgtgttgatcatcagttttacaaaaacacctatttggctgaaaggaataaaa

SEQ ID NO: 2624 - DNA, 300 bp, Homo sapiens
gatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtataggaaatcacatgtttattacccatgtatttgttgttggatgcttagtctgtttccatatctttctattgtaaatagtgccgcag

SEQ ID NO: 2625 - DNA, 300 bp, Homo sapiens
gaatggagttccacctgggctgttttattaactatttgcccctccgtttcttcatctggaaaacagaaatgataaccttactattaattgtgtgaccttggacaagttacaacatctccctgggcgcgattgtcccatctgaaggtcataatagcacctgccacagaggatggtagtaaggattaaattagttaatccatgtaaattacctaggtaagtgcctgccatatagcaagtgcttggtacttttttttaaaaatcactgttatgactattgcagacacctttgccatgattgga

SEQ ID NO: 2626 - DNA, 300 bp, Homo sapiens
gggggaaaatgacagaggaaaaagagaaaatggagcagaaaaaaatagtagaagaaataatagctaaaaaatttcagaattcagtgacaagtagaaatttacagatataagatcatatgctcaagaaacaccaataagaataaatatttaaaaatcccacgctggttcttgcaaacttttgaaaaccaaagttgaagagcaaatcttgaaagcaacaagagaaaagccatacagtaataatccagttaatggctgacttctcactggaaaccttgcagaccagaacggcatggaataaca

SEQ ID NO: 2627 - DNA, 300 bp, Homo sapiens
ggtggatgccatctttggcttcagcttcaagggcgatgttcgggaaccgttccacagcatcctgagtgtcctgaagggactcactgtgcccattgccagcatcgacattccctcaggtgctgggatccagaaggtggggtgggagagattggggccctaccctcctgactcttgcccacaccaggtctaaaataattttagtctagaggggcagaacacagctttctggacccccatcagggctggggaacagtgttcagaagtcccctttacatgttggccccatgaagagaccacggc

SEQ ID NO: 2628 - DNA, 299 bp, Homo sapiens
gacctcctgagggctgtgtcatgcgccatgatcagtcatatttggctcagaataaagctcttcaaatattttagagttcaactcttttcactgacaatagtaatgagattttaaaagatttttttaaaaaaggaactcaatggttaaaagtcagcttaattaaaagctaacatccaagatgtgtgtgtgtgtgtgtgtatgtgtgcatgtgtgtgcatgtgtgcatgtgtgtatttaaaagaccttcatgttttgttttgttttttttctctcccaggaccttgtctttttttttttag

SEQ ID NO: 2629 - DNA, 300 bp, Homo sapiens
aatacctgagactgggtaatttataaagaaaagaggtttaatgattcacagttcagcatggctgggaaggtctcaggaaacttataatcatggcagaaggtgaaggggaagcaaggcaccttcttcacaaggtggcaggaaggagaatgaacgcaggaggaactaccaaacacttataaaaccatcagatcttgtgagaactcactatcacgagaacagcatgggggaaatcacccccatgattcagtttcctctacctggtctctctttcaacatgtggggattatggggattataatc

SEQ ID NO: 2630 - DNA, 300 bp, Homo sapiens
tgaagactaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaataagaggggaaagatgtaaaagtcaaagaagatgaataagagagagaagatggaaaagaagatgaaggtggaaatga

SEQ ID NO: 2631 - DNA, 175 bp, Homo sapiens
  misc_feature 157, 163, 169, 170, 171, 174: n = A,T,C or G
tctacttgtgtgtgtatgtgtgcacatgtgtgtatgtacaggtgtatgtatatatctatagatagatacaatacattctttagacacttttcaagattctttgctgtggtatattgtgctcaactcaggtgccaaaggagcttttttttttttttgnaaaggnattttnnnttng

SEQ ID NO: 2632 - DNA, 300 bp, Homo sapiens
gataatacttgtggatcttgatgctaaggagcctgctccttatgcatcaagaaacacataaccaggtacagaaactctgcagagtactcatgagtggcaggaggagctgtaccacaagaaggaagggctcagggaaggggacatgtcttactcacttgttagcttccacggatgggatgtggcagtgctcatgaaaggatcttggacaagtgtcgcagcagaacagccgtccccatttgttgcacacctcacatatatttgagttttccggctagaaggggagatgtagacatcaccggg

SEQ ID NO: 2633 - DNA, 300 bp, Homo sapiens
  misc_feature 18, 51, 53, 75, 86, 88, 107, 121, 124, 130, 184, 185, 197,205, 206, 208, 214, 219, 237, 242, 247, 261, 262, 264, 270,279: n = A,T,C or G
tattactttattttattntattttattattatttttttttgggacagagtntnactctgtcacccaggctggagngcagaggccgnanctcggctcactacaagctntgcctcctgggttnacnccattntcctgcctcaacctcccgagtagctgggactacaggcgcctgccactgtgcccnnctaattttttgnatttttannanacacanggttncaccatattagccagganggtcncgatntcctgaccttgatnncngcccgnctcgacctnccaaagtgctgggattacagg

SEQ ID NO: 2634 - DNA, 300 bp, Homo sapiens
cggtgctggtgcggcgggggactgcggggccagcctcaggtagcagcagcagcagcagcagcagcagcagcagcagcagcagcagcagcaatgtttcacttcttcagaaagcctccggaatctaaaaagccctcagtaccagagacagaagcagatggattcgtccttttagaagcatctcagaggctctccagtgacgtgctgttaaaagtgctgaccctgggtcagaccctttgggttggcttcgtggctccacgacttactctctacccttggcagtggcgtgatctcggctcactg

SEQ ID NO: 2635 - DNA, 300 bp, Homo sapiens
cttgaaaatgctgcaaatgaccctctaatgatccctgaagatcaaaacaggggtaaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcag

SEQ ID NO: 2636 - DNA, 300 bp, Homo sapiens
gcagcagctcccaggatgaactggttgcagtggctgctgctgctgcgggggcgctgagaggacacgagctctatgcctttccggctgctcatcccgctcggcctcctgtgtgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctg

SEQ ID NO: 2637 - DNA, 296 bp, Homo sapiens
  misc_feature 216, 217, 264: n = A,T,C or G
gtccattacaccgccagcagcaatgtcttcctcggccatggcagtgggtcacgggtgcagcagtgcaatgtcttcctcagccacggttgtgggtcatgggtgcagcagtgcaagaccttcctcagccatggcagtgggtcacaggtgtagcagtacaatgccttccttggctatggcggtgggtcacggacgcagctgaatcttgaacacacctgnncctctgcctccacctgactccgcggcggcaaggaatgaacacagttntctttttaaccaaaattttagatcatgatctt

SEQ ID NO: 2638 - DNA, 300 bp, Homo sapiens
ggaatgtcaggcctctgagcccaagccaagccatcgcatcccctgtgacttgcatgtatacgctcagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttgactaattttccattaccttcccaaatcct

SEQ ID NO: 2639 - DNA, 289 bp, Homo sapiens
  misc_feature 9, 23, 24, 30, 38, 43, 47, 48, 68, 77, 84, 87, 91, 93, 100,119, 127, 138: n = A,T,C or G
agttttcanttttggctgggcannatggtnagcgcctncagtnccannttcttgggagggtaagcccngttcaaggntgcagtnaantatnanggggccnctgcattccagcctgggtnacagaatnaaatcctggcncaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagac

SEQ ID NO: 2640 - DNA, 300 bp, Homo sapiens
ctgaattgtatccttgaaaaatgctatgttggaatcttaatccccaggacctcagaatgtgaccttacttattaaaaacagggtctttacagaggtgttgcagttacagtaaggtcattagggtgggccctaatccagcatgactgatgtccttaaaagggggactttggagagaaaaacatgctcaaggaagaggatgtgaaggctacgtgaagagactggagtgatgtgtctgctagctaaagaacaccaaaaatcgtcagccaccacctgaagctggaagaggaaaggaaagatctt

SEQ ID NO: 2641 - DNA, 300 bp, Homo sapiens
cacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggct

SEQ ID NO: 2642 - DNA, 300 bp, Homo sapiens
gtgacacccttgccctaaagcaggagtcccccctacctggggtccatggactccctgaaattgtatgcaaaatgttgtttgtacatgtgtgtctgtatgtctctgtggggaggttttatggcttttgtcagattttcaaggccttaacaaagttaaaggaccactgccctgaggttactgcactgaggccaagttaggatggcatcactctgtggcagctctccctggacttgccctgcctggaacagggtgatttgctggaatggagttaccactgagatgccaaaggttgctgggtct

SEQ ID NO: 2643 - DNA, 300 bp, Homo sapiens
ccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctg

SEQ ID NO: 2644 - DNA, 300 bp, Homo sapiens
atctgttcttgcatgtaatctactttttccatgagagcccttaacatattaatcatagttattctcagttccaaaatctgtgacacctagctgagtctggtctgatgcttgctttgttttttctcttgccttaaaacatagtatgccatgtgatttttgtgtagaaataggtgcattatttatcaggtaagaggaactgagataagtaagcagaggttttgtgttaatctggctaggagttggactgcgtttaaatttgttgctataggtgttggaggctataggtgttgctataggtgt

SEQ ID NO: 2645 - DNA, 284 bp, Homo sapiens
  misc_feature 104, 107, 110, 111, 112, 118, 125, 126, 128, 130, 132, 135,137, 144, 160, 162, 165, 176, 177, 186, 189, 192, 196, 200,207, 209, 214, 219, 220, 224, 229, 236, 237, 248, 254, 261,263, 268, 275, 278: n = A,T,C or G
gttttgcccctttttagcctcccagagcttcgaggactcaattcgaacccgaaatcctgccgtgggggaggggtggcagggagacctgtgcccggggaggttgntangcnnnaatctnggacttnntncngnccntncatgtanacagtgaaatgactgnanacntggtgacccgnngataccggnctnccnaggncatnatgaatngnatgcnctacnngcanacggnggacatnnggtctgtgggntgtatnatggcgnanatgancacaggnaanacgctg

SEQ ID NO: 2646 - DNA, 300 bp, Homo sapiens
aatacacaatttacatgtcagaggatggtagaggaattgtcacttatgcttcaatctgacttagtgaagcagtggggccgagaaagcaatcatatacgcatttgtctcacatgagcagaggaacagagggatgactttaagttctgtctgttttttgtccacaaggaattttcttgtgggcaaattgtgaggtctttgtagctatcttattttaggaataaaatgggaggcaggtttgcttgatgtagttcccagcttgacctcccttttccttagtgatttttggttcccaagatttat

SEQ ID NO: 2647 - DNA, 300 bp, Homo sapiens
ctgacaagtctgaaatacatattggagcctggtagactgaaaactcaagcaagagttgatgttaaagtcttcagtctgaaatttgtagggcaggagattaggctggaaactcaggcagaatttctgtgttacaatcttgaggcataattcttctccaaaaaaatctccatttttttctcttaaagccttggatgagccttggatgattggatgaggactacccacattatctagggtaatctcctttgcttaaagtaaactcactgtgttaatcacatcaacaaaataccttcacagcta

SEQ ID NO: 2648 - DNA, 300 bp, Homo sapiens
gcaaagttccattttgttgatctcgcaggatctgaaagactgaagcgtactggagctacgggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcga

SEQ ID NO: 2649 - DNA, 300 bp, Homo sapiens
gcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcga

SEQ ID NO: 2650 - DNA, 300 bp, Homo sapiens
agatgttcttatccccaagagctgtataattccagacagaggaggcaggcagacacctctatagaggacttagaaacgactgttgtgagacacattcagtgctcaggatggcaagtgtagtataccgttagaaagaacattcctttggggtgtggcctaggaagttttccagatttttcactagcgtacatctaaggaaaaccgtaaacacagagctgccctttattcctcccacaggaagaaatgtacatcttcatggagtactgcgatgaggggactttagaagaggtgtcaaggctg

SEQ ID NO: 2651 - DNA, 300 bp, Homo sapiens
caaggatggctcaacatacacaaatcaataaatgtggtacatcacattcacagaatcaaaaagaaaaaccacatgattatttgaatagatgctgaaaaagcatttgataaaattcaacatccgtttatgataaaaaccctcatcaaagtgggtatagaaggaacatacctctagataataaaggccatatatgacagacttacagctaacattgtactgagtggggaaaaattaaaggtattgtagggagaccccatgaaactattgctatggaataaaagatgaaatgctcctgattat

SEQ ID NO: 2652 - DNA, 300 bp, Homo sapiens
tttttttttcgtaaagacagcgtcttgataggttgcccaggctgctctgggactcttggcctcaagcaatcttcctacctccacctccccagttgttgcgccatggtgcctagccaagatgagactctcattcaaacagtcaaaaacccgacttaaagtagctcagacacacatagaatggattggctgctgttgtggactctccgagggtggctccatctgcaggcactgttggaaccagtacccaaggatgatgtcccagcatctgtctctccgggatctcacctttgtaccctgccc

SEQ ID NO: 2653 - DNA, 300 bp, Homo sapiens
ctgagactcagtttttcttggttcagggtcgtatttgaacagctctgttgtgaggaagggcttacaaaattgcaatataattgctttgttttgtttttcctttttgtggagaacggggtctcgccgtattgcccaggagttcgagaccagcgtggacaacataggtagaccccgtctcaacaaaattttttttaaaaagtagccaggcatgatggtgcacctctgtagtcctagctgcttgaaaggctgagtctggaggatcacttggacggacccacgagtttgaagctacagtgagct

SEQ ID NO: 2654 - DNA, 300 bp, Homo sapiens
actcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccat

SEQ ID NO: 2655 - DNA, 300 bp, Homo sapiens
gaacagaactaataggatagatgtatatatatgaaagggagttcattaaggagaattgactcacacgatcacgaggtgaagtcccacgataggccatctgcaagctgaggagcaaggaagccagtagtggctcagtttgagtcccacaacctcaaaagtagggaagcagacagtacaaccttcaatctgtggctgaaggcctgagagcccttggtaaaccactggtgtaagtccaagagtccaaaagctgaagaatccggagtctgatgttcaggggcaggaagcatccagcacaggaga

SEQ ID NO: 2656 - DNA, 300 bp, Homo sapiens
gggatcctcttaatacctctggtatctgatattcacacatcattttatttaatgattctagaggcttggaaggctgctaaaagtcattgttttcgcctttgagaataattaccatcctggaatccccagtttagcctgagaccacctaacttccccctactcaggattcaagccagttctgtccaaggacaaacccttgtgtcgaggcctctagaactatagtgagtcgtattacgtagatccagacatgataagatacattgatgagtttggacaaaccacaactagaatgcagtgaaa

SEQ ID NO: 2657 - DNA, 300 bp, Homo sapiens
ccgcgaggttttgttcctggaatggcattggtaagaagaggattggatttagaagaaataaaagcagttgttcacacctgtgctgtgtgctgaggccctgccctccccatgatgtcattcctcagaacagcctaagttggaggaattactaaactcatcatgacatgaggagctttcagaaaaccaacgccaagatccctcccagcgtccacatcgtcctctggcaggagctcctgcccctctgcctcccaccctgccccctacaccccctgcagacccatctccctccaccccctccca

SEQ ID NO: 2658 - DNA, 300 bp, Homo sapiens
  misc_feature 118, 123, 126, 129, 131, 141, 146, 171, 181, 188, 189, 191,204, 207, 226, 231, 238, 239, 243, 247, 256, 257, 258, 260,267, 272, 273, 278, 279, 282, 284, 285: n = A,T,C or G
ccagaatgggtccatggctgctgtgaatggacacaccaacagcttttcacccctggaaaacaatgtgaagccaaggaagctgcgaaaggattgaagtctaagaattgaaaccctccanaccangtnatntnattgtaagcncaatntgagttgtgccccaatgctcgttancagctgctgnaacatanncntggcctactatanatnttgattcatgtttgacttntttcntcttatnnttcntttnagtatgttnnntncatattntatannattannttntnnagctatatatgatcc

SEQ ID NO: 2659 - DNA, 181 bp, Homo sapiens
aggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatc

SEQ ID NO: 2660 - DNA, 300 bp, Homo sapiens
gctcttttcaagttcaagataaagagaaatttttcctcaatcttgctaaatgacagctactgccattcaatggagatgtggctaacatgtcccctgcattacctctactgtatatgtaatcacttcctattaacgtattaatctcctccaataaaaactgcagcctcttaaggtcttggactgctctatttcatgattggttagtagagcatttctttcctataatccacactggcccctctctgtgaagaatgccctgtatgcaataatctgactgatatcacagctttacattattct

SEQ ID NO: 2661 - DNA, 300 bp, Homo sapiens
gttccctgctctgatcattcacattctgtgattacacaggctgtcatttccacagagagccatgaaacagtgaggagccattaggacattcccatgggtgtagctcacagttacaaagcacaactacaccctggttctccaggcctcctctttcctggcaccgcagaccagatggggtcctggagaggctctgcgtgcccttctggagcttcccatcactcctttctgcagatgttcatcttaacagcccctctgtgccactcagcccagtacccggctgcccggctgactggagatggc

SEQ ID NO: 2662 - DNA, 300 bp, Homo sapiens
ggggcccccacgcaaactcaaattccctgagcctcaagaggtggaggaagagttgaagaagtacctgtcgtagggagatttgggtagaagccctcatgctgagctttgtgtccctggtgatgttggaacattaatgatggaacatggccaaacttcagtcatgatcctgaaaccatggcttcaggatcatgactgaagtcatggtttcttccctgccagaaatgaaggttcagttatgaggcaaccctctagtaaggcattgtaaaagttactggatttggtttaataaaagttgaaata

SEQ ID NO: 2663 - DNA, 300 bp, Homo sapiens
gatcacttgagcccaggagtttaagtctgtattactggaaaggggtcccaatccagatcccaaacaagggttcttagatctcacacaagaaataattcagggagcgtctataaagtgaaagtaagtttactaagaaagtagaagaataaaaaatggctactccacaggcagagcagctccttggggctgctggttgcccatttttatggttatttcttgattatgtgctgaagaaggggtgggttattcatacctcccctttttagatcattatagggtaacttcctggcattgccatgg

SEQ ID NO: 2664 - DNA, 300 bp, Homo sapiens; identical to SEQ ID NO: 1439

SEQ ID NO: 2665 - DNA, 300 bp, Homo sapiens
ctctcctgcatgggctttgcctacaggggtatgatgatgtatcttttcattcatcacccaggtggtatgactctccacttatgcctgggccttgatgaaacagaaattgtgacatatccctggacttggcacttaggtgatgtaactcacctttattgccagggcatggtatattatgagtattgtgacaaatctcttggcctgacacctaggggatgagagactcctgcctgggccctgcccacaggatgctttgtggcctgtcttctggttttattacctagaaagatgtgactttcc

SEQ ID NO: 2666 - DNA, 300 bp, Homo sapiens
gtggcacacacctgtggtcctagctactcaggaggctaaggagggaggatcacttgagcccaggaggtctaggctgcagtttttattgtctttaaattctcttcagataatttacccccgcattgcctacacagcacactgcagagtgctgggcaacttggtaattaaccctctaattgtgtaaactggaagcttcgtgaggttatggcttcattaccatggctacgtggctgtagccatgagtgtgcactccagtgtgggtgatggagtgagactctgtctcaaaaaggaagggaggga

SEQ ID NO: 2667 - DNA, 300 bp, Homo sapiens
gtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacct

SEQ ID NO: 2668 - DNA, 300 bp, Homo sapiens
gcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgct

SEQ ID NO: 2669 - DNA, 300 bp, Homo sapiens
gcttcgtgtgctactgcgaaggggaggaaagcggggagggggaccgcggcggcttcaacctctacgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctcttggggtcgggcaggtttcgggtgccccc

SEQ ID NO: 2670 - DNA, 300 bp, Homo sapiens
cacacacctgtggtcccagctactcgggaggctgaggtgggaaaatgcttgagcctggcatgtctagccttcagtgagccatgactgtgctactgcactccagcctgggcaacagagcaagactctgtctgaaaagaaaagaaaagaaaagagaaaaggaaaaagggcatttaagacatctcacctactgaacatcctagcttcgcctagcctaccttaaatatgctcagaacagttacactgcctacagtctgagaatatttacattaaatatgctcggaacacttacattggcctaca

SEQ ID NO: 2671 - DNA, 300 bp, Homo sapiens
cacacttggagctcatacaaactttttcccaggctattgtctgttcttcaagcccattcacctcccctaaaaatcatgtattcttcctcaaaaattgtctattatcttccacttccctttcccccatgaaaagtgttgaggcttattctgagccaatatgagtgaccatggcctgagaacccaatatgagtgaccatggcctgagaaccatctcaagagctccttcaacagttgtgactgagcttgtcaggttgcagtttggttttatatattctagggagacaggaattataggtaaaa

SEQ ID NO: 2672 - DNA, 300 bp, Homo sapiens
ggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagttttatcgaaacacaagcaatggaaatgcccatttccattgttgtctccagttgctctgctccgagggcag

SEQ ID NO: 2673 - DNA, 300 bp, Homo sapiens
gccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtca

SEQ ID NO: 2674 - DNA, 158 bp, Homo sapiens
  misc_feature 103, 106, 117, 122, 125, 130, 132, 133, 137, 148, 156: n = A,T,C or G
gatctatctcttctccctgcccattaaggaatcagagatcattgatttcttcctgggggcctctctcaaggatgaggttttgaagattatgccagtgcagaanctnaccctattctnttagntcnctagncnnagantctttctttanggattctnta

SEQ ID NO: 2675 - DNA, 300 bp, Homo sapiens
atagagaggaacaaagataagaatgacagcagatgtgtggtcagaaattattcaaggcagaagacagtagaactgaaaaagaaagtaggtcaatctagaattctatacccaacacaaatatccttcaaaaatgaaggtgaaataaacactttttgatggacaaactgaagttgagagaattcgtaaccagcagacctgtagtacaaaaaatgttgaggcaagttttttaggcagaagaaaaatgatactagatagaaatttgggctgcacaaaggagtgaagaggcttccaaatggtaaa

SEQ ID NO: 2676 - DNA, 283 bp, Homo sapiens
  misc_feature 209, 211, 231, 239, 240, 247, 259, 265, 267, 272: n = A,T,C or G
cccagctctttgggaagctgaggtgggaggatcactagatcccaggggttggagacttgcctgggcaacatagtgcaacctcgtctctaaaaatatatattttatagattagcccggcatgggtggtgcacgtctatagtcccagctactccagaggctgaggtgggaagatcccttaagcctaggaggcgaggtatcgataatctatnanagctccgttacactccaacntgggcttnngaggaangatcacgtaggntctaananatganggaggccattt

SEQ ID NO: 2677 - DNA, 300 bp, Homo sapiens
cctgcccctaggtgggggctgccttcagctccctgctgcgtgtgataacttgggtgtggccctcacagctgtgcagaagctattcccagagggttctggccccaggtaaacagattctgctctgggctcgccttgcctccatcccacagccctgtgtgctgtctgtggcacagcctagagcagcactgcctcgtggccctggcccttatgcggctggagctgatcctgaagtccagtgtcccagcggtcatggctggcatcatcaccatctacaacctggtgatggaagtccttatcccc

SEQ ID NO: 2678 - DNA, 300 bp, Homo sapiens
cccaaacctaatttaggagtaaattttttgtagcagatagccagatttcagccaatcacaggcttccagctaacaagactatgcccaaataaggcaaatgcctcatcacatgatgctcaaataaggcagccacctaggcgaggccaatcaggtaacttttctactttgcttaattgttcagcctgtacaaatttgctgcttatgactgctgagcagagctgtctaaacctcttctggtttggagtgctgccttatatatgaattgttctttggtcacataaaattggttaaatttaactt

SEQ ID NO: 2679 - DNA, 300 bp, Homo sapiens
tggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtccggg

SEQ ID NO: 2680 - DNA, 300 bp, Homo sapiens
ggccagtaggtgctaaggtgacaccaccccttcctccctctccagacccatcccaccaccgtgatttgcccatccccagcagcctcatcactgaccacctgtttttacttgcaggacccattccaacaatctcgtaaaacatggtggattactatgaagttctaggcgtgcagagacatgcctcacccgaggatattaaaaaggcgtaagtagttttatttctgtggtaatgcattttcacagtggtacattggtaattgagtagtataacttcttctattgcctatgaaaatggctttt

SEQ ID NO: 2681 - DNA, 300 bp, Homo sapiens
gagactccaggctgagctggctgaccgacccaatccccctacccgccctctgcccgctgacccggtggtgagaagcccgaaggtaacggtggggggagagaagggcacggcctctccccccacctagggctgtggtgctggtagccatgacggtggtggccgtggcgagatgccccctcagtgcatgagggcacatatcccggtggtgcctttaatggtgacagtctcaggggccagccaagcccccacccccaaggaagccactgtctgccgacccccagggccggtgcccatcgggtg

SEQ ID NO: 2682 - DNA, 300 bp, Homo sapiens
aaggcttagatcattgacttcagattttttgtcttttctaacaagtgttcaagactataatataaatttccctctaagcattgtttagccacatttcacaaatttggaaatgtttattcattttcatcttcattcagttgaaaatattttctaatttcccttttaatttcttcttttactcacttattatttggaaatgtgttatttcatttccaaatatttggggattttcaaatatctcctgttaacaatttctaaattagttgtagtcagagaacatattctgtgatttcaatgctg

SEQ ID NO: 2683 - DNA, 233 bp, Homo sapiens
ggaacgtcaggcacagggatgatgaaaggggaacaataagtgttaattacctacaggttgtgttggctccaggtttttggcattgtgcctagactgaataaaagcaagcagctccagcttcttggggctgctttctggccactagagccaggcagtcacctagttgctgttacactgaaaaaaaaaaaaaaaaaaaaaaaaaaaaaaaaaaaaaaaaaaaaaaaaaaaaaaaa

SEQ ID NO: 2684 - DNA, 212 bp, Homo sapiens
  misc_feature 197, 202, 205: n = A,T,C or G
ggaacgtcaggcacagggatgatgaaaggggaacaataagtgttaattacctacaggttgtgttggctccaggtttttggcattgtgcctagactgaataaaagcaagcagctccagcttcttggggctgctttctggccactagagccaggcagtcacctagttgctgttacactgaaaaaaaaaaaaaaaaaaanaaaanaanaaaaaaa

SEQ ID NO: 2685 - DNA, 300 bp, Homo sapiens
ggaacgtcaggcacagggatgatgaaaggggaacaataagtgttaattacctacaggttgtgttggctccaggtttttggcattgtgcctagactgaataaaagcaagcagctccagcttcttggggctgctttctggccactagagccaggcagtcacctagttgctgttacactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2686 - DNA, 300 bp, Homo sapiens
cccaagcaaggttccttggaagaagatgtctgcagaggagctggagaatcagtactgtcccagccgatgggttgtccgactgggagcagaggaagccttgaggacctactcacagataggaattgaagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccat

SEQ ID NO: 2687 - DNA, 300 bp, Homo sapiens
gctctcggaggctgtcttctgtcgccaagggtcccggaccgagtacacagtggcagctggcttagttggtggacggcctggggtaggggagggtggcaggtataagacttctgggggcaccccaagaccccagacacccaagtggcatcttgggggtgggtgggcagaggacggggtaatgtgaggacgaagcgggcacggagccagatggccagtctccaggcctggtccacggactggcagggaccccaggcacaagagctgccacccctctgcccggtttggaaaaaaacaataaag

SEQ ID NO: 2688 - DNA, 300 bp, Homo sapiens
gagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccc

SEQ ID NO: 2689 - DNA, 300 bp, Homo sapiens
ggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctga

SEQ ID NO: 2690 - DNA, 300 bp, Homo sapiens
  misc_feature 247, 249, 265, 279, 281, 289, 290, 297, 298, 299: n = A,T,C or G
aaaattaaaaacacacaggcccaacaaactcaacaaacgctaagcacaagaaacatgtaggaaactataccaaggagtattataatcaaattactcaaaaccagtgataaggtgaaaaccttaaaagcagccagaggaaaaaggacatgcaagaagaataaagacaaaggtaatggcagactttttgcctgaaagaatgcaagtgagaagacaatatattaacatctttaaactaatgaaagaagancnactgtcaacctagaantctgtatgaacgtngnccaaaggnnttcaaannnc

SEQ ID NO: 2691 - DNA, 299 bp, Homo sapiens
  misc_feature 132, 135, 146, 148, 153, 161, 164, 167, 171, 172, 176, 183,188, 193, 195, 197, 213, 219, 222, 225, 226, 229, 231, 245,250, 254, 256, 260, 272, 275, 282, 285, 287, 288: n = A,T,C or G
agacttttgaggaaattctttcttgacaaagacagagatcaaaccaaaaaacaaacaaaaaaacacacacagaaaaatgtgagtagggaagaaataggaaaaaggtaagaagcagaaatttttttttttttnaancggagtttcgntnttgtngcccaggntgnagngcannggcncagtctnggttnaccanancntccaccacccaggttnaagcanttntcnngcntnagcctcctgagtanctggnattntnggcncccaccaccacnccnggttaanttngnntttttagtaaa

SEQ ID NO: 2692 - DNA, 165 bp, Homo sapiens
gggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagct

SEQ ID NO: 2693 - DNA, 273 bp, Homo sapiens
  misc_feature 131, 138, 141, 148, 152, 156, 162, 168, 174, 175, 182, 183,193, 197, 199, 200, 201, 203, 204, 205, 207, 210, 215, 216,220, 223, 225, 230, 234, 237, 239, 242, 245, 248, 249, 252,253, 254, 256, 257, 260, 263, 266, 269, 270: n = A,T,C or G
cagcaatgttttgtggcttttattgtacaagcttttcacctccttggttaagttagttcttaagtgtcttattcttttacgtgctattataaatggaattattttcataatttccttttcatggtgttaancattatncgnactcacntgcnactnaataantgcacnttgacnnttccagnnacatgaaacnattnannntnnnantcntacannaagnacnancatcnattngcntnttnctnatnngannntnntgnatntanaannccg

SEQ ID NO: 2694 - DNA, 300 bp, Homo sapiens
gccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatggggaagggttctaggccagaatgttcacatttggaagactctttcaa

SEQ ID NO: 2695 - DNA, 206 bp, Homo sapiens
ctgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggagcatggctgggagccgtgaggtggtggccatggactgcgagatggtggggctggggcc

SEQ ID NO: 2696 - DNA, 295 bp, Homo sapiens
  misc_feature 154, 157, 162, 164, 176, 181, 195, 199, 207, 218, 224, 233,261, 273, 275, 279: n = A,T,C or G
ttttattttgtcacccaggctgaaatacagtggcaaaattatacctcaatgcagcctcaacccccctgggctcaagggatcctccaaattcagcctcctgagtagctgggagtataggcttgcaccaccatgcccagctaattttttttttttnganctttngnattttcagtagngacanagtttccccatgtngctnaggctggngtaaaactccngggctnaagcaatcntcccacctgggccttccaaagggctggnattacaaggggnanccantgtacccagcaaaata

SEQ ID NO: 2697 - DNA, 300 bp, Homo sapiens
aattacaggcttgagccactgcaccaggccctaagagctctaaactttcttatcacacagtgaattaaaatattttggatcttaactatcccatattaagcgatcctttcctcaaatgaaagaaaatacttaattagaacatatatgtttaaactgatacagtaagttgtttgtaagcctctagaactatagtgagtcgtattacgtagatccagacatgataagatacattgatgagtttggacaaaccacaactagaatgcaggtgaagaaaatgctttatttgtgaaatttgtgatg

SEQ ID NO: 2698 - DNA, 289 bp, Homo sapiens
  misc_feature 119, 120, 121, 126, 145, 146, 147, 149, 151, 152, 153, 160,166, 167, 171, 174, 176, 181, 182, 184, 186, 188, 189, 193,206, 209, 210, 211, 216, 219, 222, 223, 229, 231, 233, 235,236, 237, 241, 249, 250, 254, 262, 267, 268, 275, 280: n = A,T,C or G
gtggtaccttggctttaggttttcattcgcacggaacaccttttggcatgcttaacttcctggtaacaccttcacctgcattggttttctttttcttttttctttcttttttttttttnnngtggnggttggttttaaaaccccnnnancnnnaaaaccntttttnnaaanccntngaaanncnancnnggcnttttttccccccnttnnnccaanggnggnnttaaangnangnnnggcngggggaanntttngcaaccanggggnntgggggnctaancggtcaaaa

SEQ ID NO: 2699 - DNA, 300 bp, Homo sapiens
ggttaatttttgtttgaaatcatgcccagattcgacgtcaagcaattaaagaactgcctcaatttgccactggagaaaatcttcctcgagtggcagatatactaacgcaacttttgcagacaggtaagggattttattattacctttttctctaaatatatatcttctttctgaaatgttgactctgtttttaggttttaaatggggtgcaggagagctggaggtcctacctctgatagagattaaatttcctactttcattcagtagttaaagtgtaatgatttctggttatctaattc

SEQ ID NO: 2700 - DNA, 300 bp, Homo sapiens
aatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttat

SEQ ID NO: 2701 - DNA, 300 bp, Homo sapiens
tattggtttgtagaaatgctactgatttttgtacgttaatttttgtatcctgaaactttactaacgtcatttatcaggtcttttggagggattgttagggtttttttaggtttagaatcatattgtgagtgaacagagataatttgacttcctctttttctatttagatgccttttgtttctttttcttgcccgattgctctgggtaggacttcagtactatgttgaatagaggtggtgagagtgggcatccttgtcttgttcttaggggggatgctttcacctttgcccattcagtatg

SEQ ID NO: 2702 - DNA, 300 bp, Homo sapiens
ggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctg

SEQ ID NO: 2703 - DNA, 300 bp, Homo sapiens
gcataacgaacctaaccctcagaggtttaccaagattcaaaacacgaagctgaccatgaagcgggacggcattgggtcagtgcggtaccaggtcttggaggtgtctcggcaaccactcttcaccaatatcacagtggacattgggcggactccgtcgtggccccctcggggctgacactaatggacagaggctctcggtgccgaaaattgcctgccagaggactgaccacagcctggctggcagctgctctgtggaggacctccaggactgagactgggctctgttttccaagggtcttc

SEQ ID NO: 2704 - DNA, 300 bp, Homo sapiens
cctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgccc

SEQ ID NO: 2705 - DNA, 300 bp, Homo sapiens
gggaccactggcctgcctgacctcaccccactaatattttttattttttgcagagacaggatatggggaaaagaaatcagattgttactgtgtctatgtagaaaaggaagccataagaaactccattttgatctgtattaagaaaaattgttctgctttgagatgctgttaatctgtaactttagccccaaccctgtgctcacagaaacgtactgtattgaatcaaggtttaatggatttagggctgtgcagcatgtgccttgttaacaatatgtttgcaggcagtatgcttggtaaaag

SEQ ID NO: 2706 - DNA, 300 bp, Homo sapiens
gctgggtgtggtggcacacgcttataatcccagctactcgggaggctaaggcaggagaattgtttgaatctgggaggcagaggttgcagtgggccgagatcgcaccattgcgctccggcctgcgcaacaagagcgaaactctgtctccaaaaaagagatgatctcactgtgtcacccaggctgacgtgtagaggcatgatcatagctcactgtatcctcaaactcctcctgggttcaagtgattgtcctgccttgacctgctgagtagccaccaccatgcctggctcaaaatggatttga

SEQ ID NO: 2707 - DNA, 300 bp, Homo sapiens
agaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatgctgttctggag

SEQ ID NO: 2708 - DNA, 300 bp, Homo sapiens
cccaaaaccatttattgaagagacaaccctttcctcattgtttgcttttggcattcttgtcaaagatcagttgtccataaatatgtggctatatttctgggatctctcttttgttcccttggtctacatgtctgtttttaatgggagtatcatactgtttctattactgtaattttgatgtatattttgaaatcaaatagtatgatgctgctagctccattctttatgcttgagagtgctttggctatttagggtcttttctagttccatacaaattttaggtttatttttatgcttctg

SEQ ID NO: 2709 - DNA, 300 bp, Homo sapiens
cagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagat

SEQ ID NO: 2710 - DNA, 300 bp, Homo sapiens
agacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcg

SEQ ID NO: 2711 - DNA, 300 bp, Homo sapiens
agcgtgtgcagcggcagctgctggtgaggcccaaggggctctgtctccagggagcctgcctcgcttttggagcagacaggcttggggagggcagtgatgtgagccagccccacccagcacccctcttgcccttcctgttttcctaggggacgggccgggccatatggggaggaagggactagaccaatgctgcttaatgttacagacgctgagcagcgagctgtcccaggcccgagatgagaataagaggacccacaatgacatcatccacaacgagaacatgaggcaaggccgggacaa

SEQ ID NO: 2712 - DNA, 300 bp, Homo sapiens
ggatgacagagtgagattctgtcttaaacaaaaaaccccaaaagaccatccagagtgcttgtctcggtagcatatatactaaaattggaaggatatggagaagattagtatggtccctgcgcaaggatgacacgcaaatttgtgaattgtttcataattactatttaaaaaaaaaaacctctgtaggtatttctccaaagaagctaagcagatgcccaataaacatatggaaagatgttcagcatcactaataattagggaaatgcaaatcaaaaccacagtgagatgttattttgcgac

SEQ ID NO: 2713 - DNA, 290 bp, Homo sapiens
  misc_feature 154, 161, 173, 179, 193, 195, 196, 212, 213, 218, 223, 243,245, 252, 270, 283: n = A,T,C or G
gaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgatggnccttatnctattgatgatncttacngacgatgatggctncnncagatccattcatganntgatnctaanaaatattacttggtattcanancgagttntaactgaaatctccttgnggagctcctgatnctggggg

SEQ ID NO: 2714 - DNA, 300 bp, Homo sapiens
ctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaaca

SEQ ID NO: 2715 - DNA, 300 bp, Homo sapiens
  misc_feature 117, 131, 137, 153, 154, 179, 182, 189, 196, 229, 237, 239,240, 245, 257, 264, 265, 270: n = A,T,C or G
acaccctggactcctgcaggggaggacacacggaggtggacaactgcagatacacttactcggagtggcacagctttactcagccccgtcttggtgaagtgagttttcctaagtggnctacaaatctattntaattntctttagactttatanntaactaactggattctgactataanttncaattanctatgantctactacttctactaatagaaagctattattnttcctcantnntaatntagttatgttcngatttanntgganatttacttcccctcctatttttttaattga

SEQ ID NO: 2716 - DNA, 300 bp, Homo sapiens
gtttgatcatttatgtacttgggtaaggtggtaactgctagatctctccatttgaagttgcttttaaaaaatttgttatttttgctactcgggaggctgaggcgggagaatcgcttgaacccaggaggctgaggttgtggtgggccgagattatgccattggactccagcctgggcaacaagagccaaactccgtctcaaaataaacaaacaaactaactaaagaagcctaacagtaaatggcagctggtgtgtatgtgaccctgttgctctgcttcctccagggacacggccaacacgg

SEQ ID NO: 2717 - DNA, 300 bp, Homo sapiens
acgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagat

SEQ ID NO: 2718 - DNA, 156 bp, Homo sapiens
  misc_feature 140, 142, 144, 149: n = A,T,C or G
agctcgagtcaacgtccctgtcattggtggccatgctgggaagaccatcatccccctgatctctcagtgcacccccaaggtggactttccccaggaccagctgacagcactcactgggcgggatccaggaggacttaacnangntgtgnaggatat

SEQ ID NO: 2719 - DNA, 300 bp, Homo sapiens
gttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgcca

SEQ ID NO: 2720 - DNA, 157 bp, Homo sapiens
agcggccatggccaacttggaggtgaagaaagcattcatgggaccactgaagaaagaccgaattgcaaaggaagaaggagcttaatgccaggaacagattttgcagttggtggggtctcaataaaagttattttccactgaaaaaaaaaaaaaaaaa

SEQ ID NO: 2721 - DNA, 300 bp, Homo sapiens
aggacccaggcaaccctcaacaacctgcctgcgaagaaagctcccttggaaggggctgcgccagcacatttccctgcccctaatcacaaatgccctgggcccctccaccggagattcgcgttcagtaggtcagtgacggggccgggaatctgccatttgaaacgaatactcccagttatttgtttcatcaagcagatagaaaaacatggattccttagaaaggttctgcaactgaccattcattaactcctgagggcctcatgtcaggttccgtgcatgcactgagcacctactgtgtgc

SEQ ID NO: 2722 - DNA, 300 bp, Homo sapiens
gaaggggtttaaaaaggaaaaggtgtggaagagatgcaggagtggtgcaggtctgaatgtcttgttgtgatagttatattgagtaattgcccatctggaggtatggtttgtgtcatcttgacttcagctgggtaatgctaggctaactgttcgaaactccccccatgcaagaggagtctgcaactccatctctgcttggtttgtttcaaaactggcccctgaaatttctaagcaagtacgtaattagataagtgaacactgttcatggacatgcctggtgggaaagggagaaactaaggg

SEQ ID NO: 2723 - DNA, 300 bp, Homo sapiens
gccaattccaggccctcctccacgcagtgtgccaccaacagacttctctcaactgattgatagtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagttatgcctgacttggactcagaaccttggatagaagttaaaaaaagacatcatccagccccagtgaaattgagggaatcagtgtctgtccctgaag

SEQ ID NO: 2724 - DNA, 300 bp, Homo sapiens
agacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggag

SEQ ID NO: 2725 - DNA, 300 bp, Homo sapiens
gtggagcccaagagctctgggccgccaggaagcctccaatgctctggccacctggacccgccttttaaatgcgtattctgtctctttctaactcctttgtctccgcaggactcggggtatctgctgggtggtgtggggctggtttccccaatatctaagatcagtgcttggggcattttgcagatcctgcactggatggatcagcggacaacacacagaccggtaatctgggtcaatcagttctgccatcccacccagaacagaaaacagcatgaaaaactcactttaaccccctatgaa

SEQ ID NO: 2726 - DNA, 149 bp, Homo sapiens
gaggaagcatataccacagaacattggctggtcaggatatacaaggtaaaggacctttataatcgaggcttgtcaaggacataaatgtcacgtccagctctgatatgcttcgcactgagcacatcacatttaggacgttgaagattttt

SEQ ID NO: 2727 - DNA, 206 bp, Homo sapiens
gtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgg

SEQ ID NO: 2728 - DNA, 300 bp, Homo sapiens
gacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcagg

SEQ ID NO: 2729 - DNA, 300 bp, Homo sapiens
tgcagtagcatccatgagcatcagcagagatgcagtgggggtctgtttacttggtgataagttatatgctgttggggggtatgatggacaggcataccttaatactgtggaggcttatgatccccagacaaatgagtggacccaggtattttcacatacttttgaggacagcaaagatcacctggtggccatcaagcagaccatctggaggcaaaactccttatctgaggaattcagaagtcattagactgccctattatctaaagccggcatcttgtactaggcttctttaccaaaaat

SEQ ID NO: 2730 - DNA, 300 bp, Homo sapiens
aataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatagtatgtgatctgacttttcctttagcat

SEQ ID NO: 2731 - DNA, 300 bp, Homo sapiens
gctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttat

SEQ ID NO: 2732 - DNA, 300 bp, Homo sapiens
agtaatttttttagtttgtttttgagacagctctgtcacccaggctgagtacagtggcatgatcatggctcacagcagcctctcaacctccctgggctcaggtgatcctcccacctcagcctcctgagtagctggtaccacaggtgtgtacctggttaattttttggtgtttcttatagaggcaggatctccttatgttacccacaccggtctcaaacttctggactttaggaatcctcctgccccggcctctcaaagggctggacaggtgtgagccaccaggcctggccccaagcttgt

SEQ ID NO: 2733 - DNA, 190 bp, Homo sapiens
ccaaacttggaggtggccgcttccagaccatggaggagaagaaagcattcatgggaccactgaagaaagaccgaattgcaaaggaagaaggagcttaatgccaggaacagattttgcagttggtggggtctcaataaaagtttgtttcagtggaaaataacttttattgagacaaaaaaaaaaaaaaaaa

SEQ ID NO: 2734 - DNA, 187 bp, Homo sapiens
cagcctgcggccaggctttttatttaatgtaaatagtttttgtttgcctccgtggtttggtcaccgtgtgcatcgcaccgtgctgtaaatgtggcagtcgctgtgttgggagagccggccacgcccttggctttagagctgtgttgaaatccattttggtgatggcttttaacccaaactcattgca

SEQ ID NO: 2735 - DNA, 300 bp, Homo sapiens
agccaatgtgcttgcaagtgtacagatctgtgtagaggaatgtgtgtatatttacctcttcgtttgctcaaacatgagtgggtatttttttgtttggtttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtggagacagggttttacc

SEQ ID NO: 2736 - DNA, 300 bp, Homo sapiens
ggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggt

SEQ ID NO: 2737 - DNA, 300 bp, Homo sapiens
agaggccagatcacacaggaatgactgggattttaggcctggaatgtacctttaaaattatcttattacacaccatccttcatttttctcattttcctcttttgggattcatatattaagtattagggcattaaaacacaactgtatatataaagaaaaatataaagtaaccacacatgctcagggaaagacacaggctcagaaaatgcctgagaagaacttagtttcacaccccaggctgatcctaagcaccgagacagcctacaacaatccaaaaaacaaaaacaataaataaaaagt

SEQ ID NO: 2738 - DNA, 174 bp, Homo sapiens
ttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccgtttagtgagagaggtcagaaattg

SEQ ID NO: 2739 - DNA, 300 bp, Homo sapiens
aaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattg

SEQ ID NO: 2740 - DNA, 300 bp, Homo sapiens
gtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagatatatcatactttgttctggcctcttgaatggacagtagctggcagagagaacaacacttgttacgcaaagataatctgca

SEQ ID NO: 2741 - DNA, 300 bp, Homo sapiens
gcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccag

SEQ ID NO: 2742 - DNA, 274 bp, Homo sapiens
  misc_feature 177, 178, 179, 245, 253, 254, 259, 260, 262, 264, 266, 268: n = A,T,C or G
ctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgacagagtccgactccatctcagaaannnaaaaaaaaaaaaaaaaaaaaaaaaaaaaaaaaaaaaaaaaaaaaaaaaaaaaaaaaaaaaaaaaanaaaatttnntgaannananantngaaaaa

SEQ ID NO: 2743 - DNA, 209 bp, Homo sapiens
ggggcttcttagggccaatcttaccacaatgctcacgtggtcaggcaggggcttcttagggcccctgttaccagttgggtcccagggcatcattgtggaacccatagatgagatactgcccaccacccccatctcagaacagaagggtgggaagccagagccttctgccatgccccagccagttcccacagcataacaggttctccttg

SEQ ID NO: 2744 - DNA, 300 bp, Homo sapiens
gtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacacttt

SEQ ID NO: 2745 - DNA, 300 bp, Homo sapiens
aggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtga

SEQ ID NO: 2746 - DNA, 300 bp, Homo sapiens
cattagtatttttgtgatttcattttttacacttaaatattgattcatgtggaattcactttgatgcagggtgcagtagggctccagtttaatttttttttagattgctactcagttgtttcagtactgcttagtgaataagccatctttattatcttgagatgtcacttttattatgtactgaatttctctgtttatgttgggtctttagctgtactatgtggtctcttccattgatttgtcttttactgggctgtgtcatactgtttttaattattgtagtgttatattttagtattt

SEQ ID NO: 2747 - DNA, 300 bp, Homo sapiens
atctcatatgagtgagaaagcttaccagtgcagcgaatgtgggaaagccttccgagggcactcggacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggc

SEQ ID NO: 2748 - DNA, 300 bp, Homo sapiens
cacctgtgcttgcagccaggtcaggcccagctgcagcccaggcaggagcagtcgcctttcccacccacagcgctggccacagggctccctgcagggtcagggaccagaccacgcccagaggaggggaggcactggcccccgccacaggactggagacgcaagaacaaaaagaaccaagtagagagagtggagctgctttattgcccttggagcccgcgctctcggaggctgtcttctgtcgccaagggtcccggaccgagtacacagtggcagctggcttagttggtggacggcctgggg

SEQ ID NO: 2749 - DNA, 300 bp, Homo sapiens
ggggaaagttttcagttgtattatagttgattctgactatttgccataactgtattctatacacttgctgaaaacattgaattagggaatactgaatcatggctcctaagggaaagacagggttaggttcctggaagcctctggtcacaacattttcaccaactgatcaatagataaccttgttttgtttatgtttgtgtttagagacatttaatatatattgttgacttactaacatcgaactcatggccaatagcactataacttacggctgaacaaagcttatcaagtcttttctct

SEQ ID NO: 2750 - DNA, 148 bp, Homo sapiens
  misc_feature 105, 110, 112, 116, 123, 130, 140, 143, 146: n = A,T,C or G
ccggcttcctcatcaacctcattgactcccccgggcacgtcgacttctcctcggaggtgactgctgccctccgagtcaccgatggcgcattggtggtggaggacngtgtntnaagngcgtgcnagcaganggatacaganacntanca

SEQ ID NO: 2751 - DNA, 300 bp, Homo sapiens
gcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtga

SEQ ID NO: 2752 - DNA, 300 bp, Homo sapiens
caaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggtgttggatgtcaatgatgatttttctgaggaagtaaccaaacaagaagacctcatgagagaggtaaacacctttgtaaagaatctgtaaccaataccatgatgttcaggctgtga

SEQ ID NO: 2753 - DNA, 211 bp, Homo sapiens
  misc_feature 164, 167: n = A,T,C or G
ggactcagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttnggnccaaaataaaacctcagctagctctgccaatgtcaaaaaaaaaa

SEQ ID NO: 2754 - DNA, 300 bp, Homo sapiens
cttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaaggtgaatgaaataatggccatggatatattgttattgttctgatatgaaacaaagaatttagagtttcatgaagttatacgtgctctgtccccacaattctgattcagaccaaaatgtgttaagcttaatagcctttttacaagtttgct

SEQ ID NO: 2755 - DNA, 300 bp, Homo sapiens
gttagtaggtgcccataacttcggtggtggagatccaaaagtgaacaagacagtgttctggctgctaaattcttcttaactggttatgcctggagaccttcacttggttctgtgccagcactgcccatgaacttcatagactgtgatctttgctaaggcctaaatgaatgaaggtgcaggaccggaagcagaagacagaaagtggagaccagatgtttgaagctgggtaaaggcagggatggagcaggaaccgaggaacaaaccttggaactagagtctgatgcttggctgtctgaaacc

SEQ ID NO: 2756 - DNA, 300 bp, Homo sapiens
gttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagca

SEQ ID NO: 2757 - DNA, 300 bp, Homo sapiens
cccctttgccttccccatgattataagtttcctgaggcctcctgggacatgcggaattgtgactcaattaaacctgttttctttataaattacccagtccccagcagttctttatagaagtgtgaaaacagactaatacaatcctgaagcatttcatcaaagaattgtaacaggagatgaaacatggcttcaccagtatgatcctgaagaaaaagcacaatcaaagcagtggctatcaagaggaggaagtcaaagcaaagcagaccagtcaagagcaaaggtaatggcaacagttttttt

SEQ ID NO: 2758 - DNA, 300 bp, Homo sapiens
acccggcccacgcgggccaccagggccttccattccaggcccaccaggaccccgaggcccaccagggagggtttgccaggcccaccaggcccaccaggatcgttcctgtccaactcagaaaccttcctctccggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggaccc

SEQ ID NO: 2759 - DNA, 300 bp, Homo sapiens
gtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaag

SEQ ID NO: 2760 - DNA, 213 bp, Homo sapiens
gtgatgagatggggaaagtgggctcaggaggtctggatctgtgatgagatggggaaagtgggctcaggaggtctggatctgtgatgagatgggggaagtgggctcaggaggtctggatctgtgatgagatgggggaagtggtctcaggaggtctggatctgtgatgagatgggcggaagtgggctcatgaggtctggatctgtgatgatatgg

SEQ ID NO: 2761 - DNA, 300 bp, Homo sapiens
gcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcaga

SEQ ID NO: 2762 - DNA, 300 bp, Homo sapiens
agggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggt

SEQ ID NO: 2763 - DNA, 300 bp, Homo sapiens
cttccttgtataatactgatcattctattttagcggtaagaacccaagaaggagtatggatacctgtaaagctttctggtccttgggaagcctctccttctgtgcatattattactgaaattcttcaaaagattctgagatgctctcagtgtttcattgctactttaattttaatcattatgggattgattgctgtcacagctactgccgcggcagctggagttgctttgcatttcacagtacaaacagcagactatgtaaataattggcagaaaaattctactttgctgtggaattccc

SEQ ID NO: 2764 - DNA, 262 bp, Homo sapiens
cccaggctctggggcagcgcaggaggggtaggctgggaggggctgccgcagctgttcacttgggcaggaggccgctatgcagggtagcactgggaacaggagacccacctgaggctcagccctagccctcagcccacctggggagtttactacctggggaccccccttgcccatgcctccagctacaaaacaattcaattgctttttttttttggcccaaaataaaacctcagttagttttgccaaaaaaaaaaaaaaaaaa

SEQ ID NO: 2765 - DNA, 300 bp, Homo sapiens
ttgagacggagtttcaccatgttggccaggatggtcttcaacttctaacttcgtgatccacgctgctgggattacaggtgtgagccaccgcgtgtggcctctgggcaccttttgaagctgaagcagagagagaaggcggcaggcatcagcgttttcttctatgaacttataagatcaaagactttaagactttcactatttcttctaccgctatctactacgaacttcaaagaggaaccaggagtacggaaggagcatgaaagtggacaaggaacgtgaccattgaagcaccacagggag

SEQ ID NO: 2766 - DNA, 300 bp, Homo sapiens
gggggacacgttggctgcgttttcggcgggcttcccgggtacaaaaatggctgtggctagcgatttctacctgcgctactacgtagggcacaagggcaagtttgggcacgagtttctggagttcgaatttcggccggacggtgtttacgtgtaattgttcaccataggacgcatgaagagtaccaagcaagaggggagaggaaagcttagatatgccaacaacagcaattacaaaaatgatgtgatgatcagaaaagaggcttatgtgcacaagagtgtaatggaagaactgaagagaat

SEQ ID NO: 2767 - DNA, 300 bp, Homo sapiens
ctcccattcccggaaggaggagacagttactgtctatcccgcagacgtggtgctctttgaagggatcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccaggaggt

SEQ ID NO: 2768 - DNA, 300 bp, Homo sapiens
ctgggctcatgcaatccacctgccttggcctccaaagtgccgggattgcaggcataagccactgtacccggccccaactaatttttgtattttttgtatagatggggtttcaccatgtcggtcaggcttgtcttgaactcctgagctgaagcaatccacccgccttaccctcccaaaggtgctcatattacaggcttgaggcactgtgcctggccatgggtgccatctatctaaagagtgatgaacttggtgttaaaccagtaattgaaatcaccaagttcctaccatcatgagctcagt

SEQ ID NO: 2769 - DNA, 270 bp, Homo sapiens
  misc_feature 119, 122, 146, 153, 154, 159, 162, 179, 182, 183, 185, 193,194, 195, 202, 207, 212, 213, 218, 219, 221, 225, 228, 240,241, 244, 249, 251, 252, 254, 255, 257, 259: n = A,T,C or G
ccccagtgtcctcctccttctccggccagacccagccccgcgaagatggtggaccgcgagcaactggtgcagaaagcccggctggccgagcaggcggagcgctacgacgacatggccgnggncatgaagaacgtgacagagctgantgatccnntgtcnaangaggaaccgaaaccttntgnntngaggactnnngtaacgntgtgnggttnngctgnntntttnttnaattttatgtgnnggnctgtntnnanngntnctttttttagt

SEQ ID NO: 2770 - DNA, 188 bp, Homo sapiens
acagcttccacgcttctgtccacttctggttgccaggagacagcaagcaaagccagcaggacatgaagttgctattaaatggacttcgtgatttttgttttgcactaaagtttctgtgatttaacaataaaattctgttagccagaaaaaaaaaaaaaaaaaaaaaaaaaaaaaaaaaaaaaaaaaac

SEQ ID NO: 2771 - DNA, 300 bp, Homo sapiens
ggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacag

SEQ ID NO: 2772 - DNA, 284 bp, Homo sapiens
  misc_feature 272, 274, 279: n = A,T,C or G
aaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatccccttttatcatcctttcagtttttattaatctactgtatcataaattctgtaantngatgngagga

SEQ ID NO: 2773 - DNA, 291 bp, Homo sapiens
  misc_feature 220, 223, 224, 225, 230, 235, 236, 239, 240, 244, 246, 248,250, 251, 255, 263, 264, 265, 267, 268, 269, 276, 284, 285: n = A,T,C or G
ctcgagttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaaaaaaaaaaaaaaaaaanttnnnccttnaaaannaanngggngncnannaccnaaaacccnnncnnnaaaaaanccttggannatttgg

SEQ ID NO: 2774 - DNA, 300 bp, Homo sapiens
gctcagtgttgtaattccctattctagcactctcaaaagtaccccatctgttacacatgcagaaactgcagcagcatctgaaatgtccacttcttgattcattctgaactcccttaagcccagtgtttgttagttctcgttcaagtctaggaactctgccgagtaacaggtatctcaattttgccatcctttctttctgcatagacaggagtgttcttaaatcttctcctgtaaagcaagtcatctctgatttccctgaggatcattgctcccgtatactgttgttggggtgagccttct

SEQ ID NO: 2775 - DNA, 300 bp, Homo sapiens
cccactgccccatcagtatgggcatgaacctcactgctgccaccccgatgaaatgcttttgccagcaccccacatcagagtgatcttgccagcagactgggaacatctcaggccctcgagcacagcaggtgcttaaatttgaggtcccagataacaaagccgtgggtctggtaccaggccctgtgggttagagcatgcagcccacgagtgctgagagagccttggccccctgaaataatccaaaaacaaagccagtcatctgaacacaacttataccatagtcaaaccttcaatggcatc

SEQ ID NO: 2776 - DNA, 300 bp, Homo sapiens
attctctctccataccaccccccaaaaattttcgccgctccaacacttcaacactattttggtttatttgtcttattaatatcagaaggcaggaatgtcaggcctctgagcccaggccaggccatcgcatcccctgtgacttgcacgtatacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgt

SEQ ID NO: 2777 - DNA, 208 bp, Homo sapiens
  misc_feature 200: n = A,T,C or G
gctggtgttagggttctttgtttttggggtttggcagagatgtgtttaagtgctgtggccagaagcggggggagggggtttggtggaaattttttgttatgatgtctgtgtggaaagcggctgtgcagacattcaattgttattaaaaaaaaaaaaaaaaaaaaaaaaaaaaaaaaaaaaaaaaaaaaaaaaaaaaaaancccccccc

SEQ ID NO: 2778 - DNA, 300 bp, Homo sapiens
ccagcatggtggatgatgtcttctacattgttaagaagagcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgagaacatcatgcacagcagcctccagcaaggcaaatttgacacaaaaggcatcgagagtactgacgaggcgaagatgtccttcctggagactc

SEQ ID NO: 2779 - DNA, 300 bp, Homo sapiens
aattccaattccacattttcaagaaataaggaggcaaaaatgttcatatatgaattggaattatttgttttcttattaggccgagatgcgccgcgtgcggctgctggagatggcggacgcgatggatatgttctgccaagggttggtttgcgcattcacagttctccgcaagaattgattggctccaattcttggagtggtgaagaaagaaaaaagttgaactagatttggtctgatgcagttacagatttacaaactgtgcccccaccctcctgcagacaccttccactcctcattctt

SEQ ID NO: 2780 - DNA, 300 bp, Homo sapiens
cccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagccca

SEQ ID NO: 2781 - DNA, 300 bp, Homo sapiens
ggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctaca

SEQ ID NO: 2782 - DNA, 149 bp, Homo sapiens
  misc_feature 121, 127, 133, 135, 137: n = A,T,C or G
gcgagtcgtagtgtcgctgtttgcgggtctccgcgcgggaccggggcgcagcggggtcgctgaggcgagggtgtcatgtcagacaacgaggacaattttgatggcgacgactttgatgatntggagnaggatnangntctatatgactt

SEQ ID NO: 2783 - DNA, 300 bp, Homo sapiens; identical to SEQ ID NO: 371

SEQ ID NO: 2784 - DNA, 300 bp, Homo sapiens
ggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctggctcaccggcggtcagagtttaaggttatctctcttattccctgaacattgctgttatcctgttcttttttcaaggtgcctagatttcatattgtttaaacacacatgctctacaa

SEQ ID NO: 2785 - DNA, 300 bp, Homo sapiens
gcagcttgaaggaaagacttttaaaggtacatgatgaagaaaaccaaattaaataattggttaggtacagttcatagttacttgatttgtacaattaaggtggacatttcctggttatgtaatcagaggttaattggcagtttatgattggttaagcctaaatttttgtttccctcaattcagtaatttgcaaaaaaatgcatttgagttagagtttttaaaaaataggaacccagggactagagtaacctccgtctaattgcctgctacttagttattttcacactccacaggggactg

SEQ ID NO: 2786 - DNA, 300 bp, Homo sapiens
gggagggcacacctgggggacagcagcggcgggagtgtggtccgactggcctggaagatcttgggcagagctgacctcagagaacagtgcgggtctctcgccctcctggggcagtccccaggacgaggtgccaggtgcctggcccatgttgcagggggccgtggagcccatgcagatcgacgtggacccccaggaagacccgcagaatgcacctgacgtcaactacgtggtggagaaccccagcctggatctggaacagtacgcggccagctacagcggcctggccactgggtgccaccc

SEQ ID NO: 2787 - DNA, 300 bp, Homo sapiens
gcatatgcttgtctcaaagattaagccatgcatgtctaagtacgcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttaga

SEQ ID NO: 2788 - DNA, 300 bp, Homo sapiens
aaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctc

SEQ ID NO: 2789 - DNA, 230 bp, Homo sapiens
  misc_feature 113, 122, 124, 149, 155, 157, 160, 168, 169, 176, 185, 188,196, 199, 200, 203, 204, 208, 220, 222, 227, 229: n = A,T,C or G
gtcaacctctaccacgtgcgggaggatggctggatccgagtctccagtgacaatgtggctgatctacatgagaagtatagtggctctaccccctgaaagagggtggatgcagntgcttgtgntncatggggtgactgtcaatcggtatntactgnanacntatgactnnactcctncatccctantantagcgtanatnngtnntttnaggatctatttntngttgntnt

SEQ ID NO: 2790 - DNA, 300 bp, Homo sapiens
gcatattgtggagaggcacagttcaggaggaatagggttcgtcttgaagaggaggacactttcctgtgaatcatgagggacagaagatccatatagaagaagacaatagctttgatcttctattacaagaaaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctc

SEQ ID NO: 2791 - DNA, 300 bp, Homo sapiens
ttcaaatctgccactcccagagcccgtggaactctggcccaaggctctctgactgactccttcttggcttagcggctgaagactgacactgcccgatcgcctcagaaaccccgtagaccatcacggacgccgagctttagttaactctcacagtggaggaaggcaggaatgtcaggcctctgaacccaagccaagccatcacatcccctgtgacttgcacgtatgcacgtatgcacctagatggcctgaagttactgaagaatcacaaaagaagtgaaaaggccctgccccgccttaact

SEQ ID NO: 2792 - DNA, 300 bp, Homo sapiens
agtcaatgtcaattcctcaaagcagtctggttatatctgaaaatacatgattctagtcaaagccttggtgaaataaccagtgtttccaattgtgtcctgttacaaaacaaaacagattcttactgaatttatgcaaacaactacattgccataaagtaagaatactcatgaaaagtttccaaattctggagaactcaggtagaggggagaagtaaattttgctcacaaaagtatcctttacaatcagagtagcagtcttccaaacaggatgttgcccgttcatcatggaacggccatcca

SEQ ID NO: 2793 - DNA, 300 bp, Homo sapiens
atcaaacactacctgaaattattggcatgtggaccccggctcagaaacactgacataaagacttaaatgtaatgggatttgttttcaaaagatttgacttttctctgtaaaaaacacagcaacaaggcaacagggaatattaccaaagtttcccaaaggcttgtataggatttgaaaaagttgggggaagaatttaaccctaaaagcttaactgattttcaaacacctgcaaatacataattacagatcctgtgaagcttaaccttggtggtgttaaatgttagctagaatgtcacaagg

SEQ ID NO: 2794 - DNA, 300 bp, Homo sapiens
gtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcag

SEQ ID NO: 2795 - DNA, 300 bp, Homo sapiens
ccggcatgtctttctcccgcaagagctataggctgacctcagatgctgagaaatccagggtcacaggcattgggcaggagaagctgctgaatgactacctgaaccgcatcttttcctcttctgaacatgcacccccagcagccaccagcaggaaacccctgaacttccagaacctgccagaacatttggaccagttgctacaggtggacaatgaggaggaggaaagccagggacaggttgaagggcggcttggcccatccactgagggcctggaccacacaggcggctttgaggggcttc

SEQ ID NO: 2796 - DNA, 298 bp, Homo sapiens
  misc_feature 9, 15, 25, 33, 46, 58, 64, 65, 69, 75, 77, 82, 86, 93, 100,104, 125, 126, 137, 148, 149, 177, 186, 200, 208, 215, 225,237, 250, 255, 260, 272, 278, 283, 289, 292: n = A,T,C or G
gtgcgcttntatgtnctcatagacntttttttnaatcccttttaancacctactatgntctggnntgcnggatcngntcggntctntccatgngacaacnctcnccacacgccaaccccgttcannaacgccctaanggggaacttannggggtgaatcccctgccacagaccccgnacctggagnaggacttgaaggangtgctgcnttctgangctggcatcnaactcatcatcnaggactacatcangcccnagaancataataggaancctggnctgcngcgganccncatcaa

SEQ ID NO: 2797 - DNA, 300 bp, Homo sapiens
ggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaat

SEQ ID NO: 2798 - DNA, 300 bp, Homo sapiens
cccgcctgcgcccaggtgaaatacacagccatgttgctcacacaaagcctgtttggtgggctcttcacacgggcacgtatgcaatttggtgccgtgactcggatcgggggacctcccttgggagatcaatcccctgtcctcctgctctttgctccgtgggaaagatccacctatgacctcaggtcctcagaccgaccagcccaagaaacatctcaccaatttcaaatccgaaggcaggaatgtcaggcctctgagcccaggccaggccatcgcatcccgtgacttgcacgcatacatcca

SEQ ID NO: 2799 - DNA, 300 bp, Homo sapiens
agcaagtcagcaaatgtgggagatggaaaactggcttcctccacccacctaggttctttggctgggctacaaattaaatggacataaaatagattaacaggagaaaaaacacagtaattatgtgtatatgcctgggagtcccacaaaatatgagactcaaaagaagggtccgaagagggaagcttatatagccccctgagccacagaaaggaatagggacctggggcttctggtgggtggtggagacaagttatggaagagtgaggggaggaagtgtagggtgagtaaatgtggtcttgt

SEQ ID NO: 2800 - DNA, 202 bp, Homo sapiens
  misc_feature 196: n = A,T,C or G
ccccagtgtcctccttcttctccggccagacccagccccgcgaagatggtggaccgcgagcaactggtgcagaaagcccggctggccgagcaggcggagcgctacgacgacatggccgtggccatgaagaacgtgacagagctgaatgagccactgtcgaatgaggaaccgaatccttctgtctgtggcctacaanatcgtt

SEQ ID NO: 2801 - DNA, 218 bp, Homo sapiens
  misc_feature 191, 197, 203, 204, 209, 210, 211: n = A,T,C or G
ggcagctccaagtggaatccacgtgcagcttctagtctgggaaagtcacccaacctagcagttgtcatgtgggtaacctcaggcacctctaagcctgtcctggaagaaggaccagcagcccctccagaactctgcccaggacagcaggtgcctgctggctctgggtttggaagttggggtgggtaaggggngactgngctacnncatannntttttat

SEQ ID NO: 2802 - DNA, 300 bp, Homo sapiens
ggtatgtgtagcggcagtggccgccggcggagcagtctgagcccgacgatgaggccggggacgggagctgagcgtggaggcctcatggtgagtgaaatggagagccatcctccctcgcagggtcctggggacggggagcggagattgtccggctcaagcctctgctccggctcttgggtctctgctgacggcttcctgaggagacggccctcggtaagggatcagtggggcagggggaaggcggcacattgaaaaacggagtgagaaacaggaagctttctccgaaaggagaagaagata

SEQ ID NO: 2803 - DNA, 300 bp, Homo sapiens
  misc_feature 186, 187, 215, 228, 229, 238, 241, 246, 252, 267, 271, 293: n = A,T,C or G
ccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccaatggtgggtaattgtacaataaattttttttggacagatnnaaaagaaacaaaacttgctttacagatnctgaaaggcctgnnacaaggccnggnaattnggggantccgtcctgcattgngcangatgctcagcggcatccctggncacccac

SEQ ID NO: 2804 - DNA, 300 bp, Homo sapiens
agggggcgggcccgtacgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccagg

SEQ ID NO: 2805 - DNA, 208 bp, Homo sapiens
cagggccgtaggcagccatggcgcccagccggaatggcatggtcttgaagccccacttccacaaggactggcagcggcgcgtggccacgtggttcaaccagccggcccggaagatccgcagacgtaaggcccggcaagccaaggcgcgccgcatcgctccgcgccccgcgtcgggtcccatccggcccatttgcgtcattgccccagt

SEQ ID NO: 2806 - DNA, 300 bp, Homo sapiens
  misc_feature 234, 236, 239, 241, 244, 246, 250, 256, 258, 259, 264, 265,267, 271, 272, 273, 280, 281, 285, 290, 293, 294: n = A,T,C or G
agaaagattttctttattaatgaccccaaccgtatttctttagatacaggagttttgaacttccataattaggagaaaaccgttatgactgcattatcctgcaactcttacccgtaatatattgcaaagcgaaacagcttggaaaagagggtgggagaaaagggaagtgagggagggaagataaagaaaaggaattaagttgatcaagtggaattcttttttttttttaaattntnggnanctntnaagnttttgnanncccanntngttnnngcaaatnntttnccaancgnntccaaa

SEQ ID NO: 2807 - DNA, 300 bp, Homo sapiens
aggagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagca

SEQ ID NO: 2808 - DNA, 300 bp, Homo sapiens
gagaactagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatg

SEQ ID NO: 2809 - DNA, 300 bp, Homo sapiens
acaggttcccatagctacagaggtgcttttcaaacttacacagggaagtgtgaccttttaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttg

SEQ ID NO: 2810 - DNA, 216 bp, Homo sapiens
  misc_feature 160, 163, 170, 178, 183, 185, 195, 199, 206, 209: n = A,T,C or G
ggagaacggggctgaggaggaagaagaagaaactgccgaggatggagaggaggaagatgaaggggaagaagaagatgaggaagaagaagaagaggatgatgaagggcccgcgctgatgagagctgccgaagaggaggatgaagcggatcccaaacggcanaanacagaanatggggcntcggngngagcccctgncaanaggctgncgntgggagg

SEQ ID NO: 2811 - DNA, 300 bp, Homo sapiens
taggcgtgcctaatgggaggtctatataagcaatgctcgtttagggaaccgccattttgcctggggacgtcggagcaagcttgatttaggtgacactatagaatacaagctacttgttctttttgcaggatcccatcgattcgaattcggcacgagaccattttattttttgggccattaccccataccccttattgctgccaaaaccacatgggctgggggccagggctggatggacagacacctccccctacccatatccctcccgtgtgtggttggaaaacctttgttttttggggt

SEQ ID NO: 2812 - DNA, 300 bp, Homo sapiens
gcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcacc

SEQ ID NO: 2813 - DNA, 279 bp, Homo sapiens
gtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgtgggaaagt

SEQ ID NO: 2814 - DNA, 206 bp, Homo sapiens
ggagacttaattttccaaacagtaagccttgaaaaaagaagccaagtaaatttgtttttcaaaattgtataaaaaatctataaaattttcatcttgaccataatatataagtttcataagccttttataacctttataacctttattaaggagtcagttagtgcttcaagaaaaccttgttaatctgacacaggggcccatttgcg

SEQ ID NO: 2815 - DNA, 300 bp, Homo sapiens
caggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactctgtctgcgacctgcttcc

SEQ ID NO: 2816 - DNA, 300 bp, Homo sapiens
catgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataa

SEQ ID NO: 2817 - DNA, 300 bp, Homo sapiens
gaaatatacttccttaaatgatggacattcctaaatccatctaggaatgttggatgtatctatctatctatctatctatctatctactgtattaagccccttctcaaaattgtagtttcagaagtatggtttgataattcataatcaagttctttttctttatgcccagaagtctgtattctgcacagacttgcatacccctagctgcgctaaagttcagaagtttgagctgccactgaagtattgactgtggagaggcggggttttctgtctccaatgaggtgcctttggtgtcgggaa

SEQ ID NO: 2818 - DNA, 181 bp, Homo sapiens
gttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggcccac

SEQ ID NO: 2819 - DNA, 300 bp, Homo sapiens
gcagtctcctgagccagagtgtgctcagacagagtccagctggtggaaagggacttatggagagaaaaagaaaagcgatgtagaaaaattgaaaagaggtacagaaacagctggattggttacagctcggtgtttgccttattttgaacagggtttgaacagttggccacctttggttgctcaaaacttggtgattggcacaagagtaggttacagtctgtttgcacatccatttaggttgcagttcactgtgtacagagaaacctttaggctgaacttaaaacgtgtaaggagacagct

SEQ ID NO: 2820 - DNA, 189 bp, Homo sapiens
  misc_feature 150, 156, 163, 164, 171, 180: n = A,T,C or G
gtgggttaggggagccgcattcgcaaccacaagtaccgcagcctcaacgacctagagaaggacgtcatgctcctgtgccagaacgcacagaccttcaacctggagggcttcctgatctatgaagactccatcgtcttgcagtcggtcttnaccagnttgcggnntaaaatntagaaggangatgacagt

SEQ ID NO: 2821 - DNA, 300 bp, Homo sapiens
gtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatg

SEQ ID NO: 2822 - DNA, 244 bp, Homo sapiens
  misc_feature 109, 116, 130, 139, 140, 145, 146, 147, 149, 159, 161, 163,169, 178, 182, 183, 185, 188, 190, 191, 195, 198, 202, 203,208, 209, 213, 214, 215, 219, 220, 224, 226, 231, 232, 233,238: n = A,T,C or G
ggggactctgccactctacccccagccctacccaccagcccccaggtgaggcttccagctgggacctgcccagacaggctgagcctgggcgtggtgggtggggtgatgnctctggngagcggctgtcatnctacaaacnncaccnnntnctttgagctntnantatggnacccagtgncttnntntgnannacanggngaanntgccnntcgnnnaccnncatncngggannnccccntttttg

SEQ ID NO: 2823 - DNA, 300 bp, Homo sapiens
aatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacg

SEQ ID NO: 2824 - DNA, 187 bp, Homo sapiens
  misc_feature 154, 157, 161, 164, 166, 170, 175, 176, 180, 181, 182, 186: n = A,T,C or G
atgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggnggntganggntngctncctgnnctgnnngacng

SEQ ID NO: 2825 - DNA, 300 bp, Homo sapiens
ctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggtgggacatggacacagctcaaaaaggcagtgcctgccttactcctctggcttggaccactcagccttaagcgggacaataaccccctgacacttaaccctgtgttgagctatggggccatctctagcagagtcaagtcaa

SEQ ID NO: 2826 - DNA, 300 bp, Homo sapiens
ggggttgggggtgggaccctgggatggggggagaagcagctgtttctggagagagaaggggtcatggtggccccagactgtagagatttttatgtgtttggatacatctgctgtgtggaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgaaaaa

SEQ ID NO: 2827 - DNA, 300 bp, Homo sapiens
caatgaactactctgcagcctcattttttaaaaaatgagataggtaagtgtggatataaataactgtccaacatatatagctgagtaacaaaaatagcaaactagaaaacaatgtattattccatttgtgctgaaatatgtatgttggtatgtgtaaatatgtatggttgtatagacagttcttttctaaaattttttcatttttaatttttgtgggtacatactaggtatatatatttgtggggtacctgaggtattttgatacaggcatgcaatgtgaaataatcacatcagcataaa

SEQ ID NO: 2828 - DNA, 296 bp, Homo sapiens
gcctcatctcccactgagcaggtgccatcccaggagatgccactgttggcgagaccttcccctcctgtgcagtctgtgtcccctgctgtgcccacacctccctcgatgtctgctgccctgcctttccctgcaggtggtatgggaggtggcatgttctaactcctagactagtgctttacctttattaatgaactgtgacaggaagcccaaggcagtgttcctcaccaataacttcatagaagtcagttggagaaaatgaagaaaaaggctggctgaaaatcactataaccatcaat

SEQ ID NO: 2829 - DNA, 246 bp, Homo sapiens
cacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggag

SEQ ID NO: 2830 - DNA, 175 bp, Homo sapiens
ccgtcttcgccaaggccccgcccgagcctagttgttctccccctgaatgtgtagaaccttcctttgaaatttcttaatcggtgcattgaggtttccacatctttttccaagcagtgccccacttcatggatttatagctatagtctatgcagtcgttacctcttttttttttttt

SEQ ID NO: 2831 - DNA, 208 bp, Homo sapiens
agccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccagcctctagaactatagtgagtcgtattacgtagatccagacatgata

SEQ ID NO: 2832 - DNA, 300 bp, Homo sapiens
cccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgca

SEQ ID NO: 2833 - DNA, 300 bp, Homo sapiens
  misc_feature 9, 13, 16, 25, 32, 37, 43, 44, 53, 56, 57, 58, 60, 64, 75,79, 101, 121, 122, 123, 126, 131, 132, 135, 138, 144, 147,152, 156, 183, 184, 185, 186: n = A,T,C or G
aatcagtcntttntancagtaacanaggacangtccntcgctnngctgtagtngtnnnantgtnggtaatactcnttgntcatcatgaaatgcagtgtaanggttgtgttcgcctattgannnttnaaacnncangtngtttangtnaaagnttancagatcttaaagataatcactgtgagnnnnttagagtaaaaattcgaaaactgaaaaataaggctagtgtactacaaaagagactatctgaaaaagaagaaataaaatcgcagttaaagcatgcaacacttgaattggaaaaag

SEQ ID NO: 2834 - DNA, 300 bp, Homo sapiens
gtgagccgagccgagatcgcggcacggcactccagcctgggtgacagagtgagactccgtctcaataaataaataaataaataaataaataaaataaagcaaggtaatgaaggtgaatgtgcttagtatgtggccagatacagagtaggtgctctgtaatattagttacagtgattgcctgctaggagtgtaggctggtgctaaaacatgacccaggtctagaaagacacacaatccacccctaactcctttcctcgtctgccactccttatccccaggattacttgttcttttatgact

SEQ ID NO: 2835 - DNA, 300 bp, Homo sapiens
gtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcatatctgccaagaaccttcgaattcatgaaaggacacaaacacacgtaagaatgcactctgtataaagaccttataaatgtaagatatgtgggaaaggcttttattctg

SEQ ID NO: 2836 - DNA, 300 bp, Homo sapiens
gtgacacagagacagagaaacctcccccacccagggaagcagctctgcagagttggcaggatcaggggctagtctgaacccctagcacagaacactcacctcacggaagagtggccagaatgttttccacataggtcctggtcctcacttctcctcactgagcagggctgcccaacgtgggacttctgcacaaccatcctgcccctgcctgaccacttcaatcagaggcagcctggcagttaaaggaacacccacacacagaggtgaaaaagaaccaattcaagaactccagcaacacaa

SEQ ID NO: 2837 - DNA, 300 bp, Homo sapiens
gccaccaccaccaccagccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgc

SEQ ID NO: 2838 - DNA, 300 bp, Homo sapiens
gttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccct

SEQ ID NO: 2839 - DNA, 300 bp, Homo sapiens
gggcacccagcgaagccaatcagagatggaagtagtgctctgagggtgggcgccgcttggtaccaccctcctcgccctcggtgtcctggagaaaggcggaaggaatgcggacctttttgaagtgacggacgcgccagcctatcaggggcgagctcaagagggcggggcggaagactgcaggaatgaaatggattgacagaccaaataactaatgagaggcttgattgagaacctacccgactatcagaggacctgtccgggaagagaaatggggctacgtccagacagaatctcgctctg

SEQ ID NO: 2840 - DNA, 300 bp, Homo sapiens
ttatagctgtgtcggtctagcattttctttgaagcatatggaacatgttctgctactcgagataatgaacatttccttctgcctcaaggtacaatcagtttatgatcctgggagagcaagaagcaaggagccagcaagtctggacacattccagaggccacgaggggttttatgtcctgagtcctggattccatccaagccatgaggggttttatgccctaggcttaggttgtagtgcggcggggcagccttccacccttaagcacagaacctggtgttccataggccacaagaagtttt

SEQ ID NO: 2841 - DNA, 300 bp, Homo sapiens
aagggagaggcagtaggactaggagttaaattgtcatgccgaggtctctgagcatgggtgggcctgtcagaattgtcatcgctcactctgttgacttccagcagctgacaggcaaggccctaggaagctcttcagcctcctttccttgctagaggtgctgttttccctggaaatgttcaagccctgcaaatcgtttctatagtaacaggtctctgtcttttttcttatgatgcagatttttgaaaaggtttcttatctaaatgttcttgggatctatggtcttcctacctgtagctcctt

SEQ ID NO: 2842 - DNA, 300 bp, Homo sapiens
aagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcat

SEQ ID NO: 2843 - DNA, 290 bp, Homo sapiens
  misc_feature 235, 238, 241, 245, 246, 248, 254, 258, 262, 263, 269, 270,275, 278, 279, 280: n = A,T,C or G
gggggacatcatagacaaagaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaaaaaaaaaaaaaaaaaacctggnccnttnaaanntntggggngccntttnncgaaannccaanctnnntaaaaccctt

SEQ ID NO: 2844 - DNA, 300 bp, Homo sapiens
gcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtactttttttttgagacggagttttgctcttgtagcccaggctggagtgcaatggcaggatctcagatcactgcaacctctgcctcctgggttcaagcgattttcctgctt

SEQ ID NO: 2845 - DNA, 300 bp, Homo sapiens
gcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtactt

SEQ ID NO: 2846 - DNA, 300 bp, Homo sapiens
ccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgt

SEQ ID NO: 2847 - DNA, 300 bp, Homo sapiens
caccagtggctttagggcctgtcgcttacgcgatgcgggtagtattgttcccgttgcgcagttgaggacacctaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcg

SEQ ID NO: 2848 - DNA, 300 bp, Homo sapiens
tttttttttagaacgtggtcttgtctctatcctctggacactgcagcgtacgagtaacaacaggtcttgcaggctaaataacttataaacaaaatttccttcctgaggagctaggtattccgatgtatcttcaacatagtcctgaagttcatatggcaatcgtccttttggcttctgaaatgcagaaggccatccagatttcggccaactagaggagtctgaaggaccagacaattgctcagaaacagaaggctgtttagaattttctaaattcattaagggcaattctggtacttttct

SEQ ID NO: 2849 - DNA, 300 bp, Homo sapiens
  misc_feature 199, 205, 223, 245, 248, 249: n = A,T,C or G
gcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgnatctgncactcattccactacatnaagcacccggaataaagcccgnctnncccaatcggaaaaaaaaaaaaaaaaaaaaaaaaaaaaaaaaaaaaaaaaac

SEQ ID NO: 2850 - DNA, 299 bp, Homo sapiens
gcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcacccggaataaagcccgcctgccccagtcggaaaaaaaaaaaaaaaaaaaaaaaaaaaaaaaaaaaaaaaaa

SEQ ID NO: 2851 - DNA, 300 bp, Homo sapiens
gttcgacgctttgaaagatgatgacagtggggaccatgatcagaatgaagaaaacagcacacagaaagatggtgagaaggaaaaaacggaacgagacaagaatcagagcagtagcaagagaaaggtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctggga

SEQ ID NO: 2852 - DNA, 300 bp, Homo sapiens
cccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgttt

SEQ ID NO: 2853 - DNA, 300 bp, Homo sapiens
ctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactccgggc

SEQ ID NO: 2854 - DNA, 300 bp, Homo sapiens
gctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgatgcgtgctggcccccgcacaggctcctgtgtgcagggactgattcctcagcacac

SEQ ID NO: 2855 - DNA, 300 bp, Homo sapiens
ggccgctgcttctttcccgagcttggaacttcgttatccgcgatgcgtttcctggcagctacattcctgctcctggcgctcagcaccgctgcccatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatc

SEQ ID NO: 2856 - DNA, 300 bp, Homo sapiens
gcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagtt

SEQ ID NO: 2857 - DNA, 300 bp, Homo sapiens
gcccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctgcaggagccaccaggtcctttcgttccggaggccgcccgggcccggatgcgg

SEQ ID NO: 2858 - DNA, 300 bp, Homo sapiens
gcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccattt

SEQ ID NO: 2859 - DNA, 300 bp, Homo sapiens
gccgccactcgtatcccccggccctgggcagccctggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctcggggattgagccgtcgggtctgcaggagccaccaggtcctttcgttccggaggccgcccgggcccggatgcggg

SEQ ID NO: 2860 - DNA, 300 bp, Homo sapiens
gctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccatagaagaattgatggctcctacccttcttccagaactccatcttttaaagcacgattaaagtaaaaggcccaagatactgggaactgctcatagatttaagcaa

SEQ ID NO: 2861 - DNA, 300 bp, Homo sapiens
atgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaag

SEQ ID NO: 2862 - DNA, 300 bp, Homo sapiens
aagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttg

SEQ ID NO: 2863 - DNA, 300 bp, Homo sapiens; identical to SEQ ID NO: 1595

SEQ ID NO: 2864 - DNA, 300 bp, Homo sapiens
attgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggc

SEQ ID NO: 2865 - DNA, 300 bp, Homo sapiens
aactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagggcagaatttttggaacagcattatgatagatttttcagtga

SEQ ID NO: 2866 - DNA, 300 bp, Homo sapiens
tccaaaaacaatgggcccaaggcaaaccagagccaaagagttttaacttgaaccccttcagtcaggatgaacataaagctctcaagttcttgaaaggatgagacacaagaataagatggggtaccagtgaccagctcctctacctggggtcatggaggaccgaagaccctccaaccttgatgcctgtaaggacaggcgctcctgtaagggatcaggtgtaaagaatctggccatagctcctgtacaaagcctctttgtctgaagtacttgggtgctctttgacggcaggagggaacacaa

SEQ ID NO: 2867 - DNA, 296 bp, Homo sapiens
  misc_feature 113, 118, 128, 129, 132, 142, 144, 146, 153, 155, 157, 158,161, 167, 171, 176, 179, 184, 186, 191, 192, 196, 197, 198,204, 211, 212, 213, 219, 225, 227, 228, 232, 233, 238, 240,243, 247, 248, 251, 254, 257, 260, 270, 272, 277, 279: n = A,T,C or G
  misc_feature 281: n = A,T,C or G
ctgaggcaggagaatcacttgagcccaggaggtggaggtttcagcgagctgagatcacaccactgcactccagccttggtgacagagtgagactctgtctcaaaaaaaaaaangggantcatttgggnnttnggcaaaaatnancntagggantntnncangacccnaganggaanccntgagngntcagnnccannntggggnctttttnnnggtttnttaaangnnccgnnccttnanggngggnnccncgnttngcnttggggggtntnagggnangnctgctttctttttta

SEQ ID NO: 2868 - DNA, 253 bp, Homo sapiens
  misc_feature 101, 104, 113, 115, 116, 118, 120, 126, 127, 130, 132, 135,137, 143, 144, 148, 150, 151, 169, 171, 172, 176, 180, 189,191, 195, 199, 204, 207, 215, 219, 222, 225, 235, 236, 243: n = A,T,C or G
cacttgaacccgggaagtggaggttgcagtgagccaagagtacaccactgcactccagcctgggcaacagagcgagactccgtcttaaaaaaaaaaaaaanaanccccttttnanngncntaatannccnanttngnggcagnnttgnanngggaaaggccgtttaaancnntaanggtngaaaaaccntnaaanattntccanccnaccccttngatnttncanaccaaaaaannaatcccnaaacgggaaa

SEQ ID NO: 2869 - DNA, 294 bp, Homo sapiens
  misc_feature 121, 127, 128, 131, 132, 136, 142, 146, 155, 158, 167, 174,177, 178, 181, 182, 190, 195, 202, 207, 208, 212, 214, 228,229, 230, 232, 239, 244, 245, 247, 248, 252, 253, 261, 262,263, 268, 269, 270, 272, 275, 279, 280: n = A,T,C or G
gctacttgggaggctgagacaggagaatcgcttgaacccaggaggccgaggttgcagtgatctgagatcgtgcactccagcctgggggacagagtgacactccgtctcaaaaaaaaaaaanaaaagnnccnntttngggttnttanttttttccnaanaactgaacntatttgnacnnttnnatttttanaatgnttttttngtaanntaancnccaaaataattaannncntttaaangcctnnannaatnncctgattnnntggcnnnanccntttnntaaggggggatttt

SEQ ID NO: 2870 - DNA, 300 bp, Homo sapiens
  misc_feature 134, 143, 146, 147, 150, 154, 155, 158, 163, 166, 168, 171,175, 182, 188, 191, 201, 203, 207, 208, 215, 217, 219, 223,226, 231, 234, 235, 240, 243, 245, 247, 257, 262, 267, 270,272, 279, 284, 286, 287, 291, 293: n = A,T,C or G
gctactcgaaaggctaagactggaggatcgcttgagccaatgagttggaggctgcagtgagctataatcacgccactgcactccagcctgggctgcagggtgaggtcctgtctctggaaaaaaaaaaaagggantaggtaaanggnncanaggnnaanttttnagngnctngagncttttgnagcccntgnttacccaaancntttnnggcctantngnaccntcncaaanagnntttcntgnantnaccaaatttnaggtnttcanaantngactccntaagngnncaantnggaaata

SEQ ID NO: 2871 - DNA, 293 bp, Homo sapiens
  misc_feature 140, 142, 149, 153, 154, 156, 158, 165, 171, 174, 175, 178,179, 181, 184, 185, 192, 203, 204, 208, 209, 211, 215, 222,225, 228, 229, 238, 239, 247, 249, 250, 253, 260, 264, 267,269, 271, 275, 283, 285: n = A,T,C or G
ctcagctcttccggaggctgaggcaggagaatcgcttgaacccaggaggcagaggttgcagtgagccgaggttgcgccactgcactccagcctgggtgaccgagtaagactgtctcaaaaaaaaaaaaaaaaaaaaaaantngcctttnggtnncntnatttccnaaattnaannaanngnccnnttttggnaaggggggggnnaaanngnaaanccctttnttngtnngttcctttnnaaaagggncnntcnccttttnaaanggncntnaagncctttttnanaaatggtt

SEQ ID NO: 2872 - DNA, 300 bp, Homo sapiens
atctgttactacttcagaattgctggttgatgttaggcccctcctatctgtgctctctcagctacagtttcccgtttgagcatattcattcttttttatttttgctctgaacaaaaatattagagttacaatattactatattccaggccttgctagaaactggggataaatctatgaatatggtcgcttccctggaagacctcacagtccagggaagccaaaccctgcagacatgcagtagacttagtggtctctcttaaggttgcttgttgagttttgacattggagattatgtacag

SEQ ID NO: 2873 - DNA, 300 bp, Homo sapiens
gtgagaacggagatacgggaaaacccttggctcatggaagcatagccaacataaaccttttaagcaaaccagcgcagagttccgtcatagtgcaccatcatcagaaaccagggctcctggtgttccagaagttgccagagtttatgttacttcagccacttggtggggaaagcttttgaaatagatcatacatgcatttgtttttaatcagagtgcgttggccatgatggggttaatttatactgagcacatggcacccatatctggggtttccctcttggtcagggcccccattggcca

SEQ ID NO: 2874 - DNA, 297 bp, Homo sapiens
  misc_feature 256, 260, 269, 277, 282, 283, 284: n = A,T,C or G
gctcattccagctggtctatcgtgggcctcagaaggtgaagagggaccgtattctggggcccacgatagaccagctgtaactcattccagcctgtaccttggatgaggggtagcctcccactgcatcccatcctgaatatcctttgcaactccccaagagtgcttatttaagtgctaatacttttaagagaactgcgacgattaattgtggatctccccctgcccattgcctgattgaggggcaccactactccancccntaaggaaangggggcanttcannngccccaagaggga

SEQ ID NO: 2875 - DNA, 300 bp, Homo sapiens
gcgggaatcaatctgcactgacaccgcggcaggaactgaagctgcccaggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggacctgagacccgcttttccttttcccttcattcccttgagagtcagccataaacggaatacctgctaggttccaggaatgagctcacc

SEQ ID NO: 2876 - DNA, 300 bp, Homo sapiens
gccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcga

SEQ ID NO: 2877 - DNA, 300 bp, Homo sapiens
ggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgc

SEQ ID NO: 2878 - DNA, 300 bp, Homo sapiens
  misc_feature 264, 271: n = A,T,C or G
gtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcgtnattcccnacagtcatccccatagccctctgaggagg

SEQ ID NO: 2879 - DNA, 300 bp, Homo sapiens
aattttgccatcttttatcaggctttctgtgtcgaggacgctacccacatagagtagaagctaaagggaagggatgtgaagtgacctcaccctcagcttctagctcatggtgtcaaggcttgtgtgatcttagacacgtctgcctcttctgagcctgtttcttcatctgtaaaacagggatgggaggttgtggtaaagattccacagcaacactgcacacgcatgaagtacctgggccagggatgactcggcagacctcagtttccctctgcctcctgcctagagctgttagcaagcatc

SEQ ID NO: 2880 - DNA, 300 bp, Homo sapiens
aatgtctctttcaaagacactcagggctgaatcagccttaggatgctaagcaaatcattccgtaggataggacacagtcacatagaagctacagctgggaaaggcagaattcatagtagagagtgctggtccacctagaggccagcccaagaggccagaggtggccatccccaaaagagagatggagagagtatttgctttttttcctcagatgttttcccaaatccccaggaagcccagtatctctgccttttcagtgaagcctctgtcttctagagtatgcctttcccttcatttgaa

SEQ ID NO: 2881 - DNA, 300 bp, Homo sapiens
tcttcattcaagttgtagatgaaaaggcagaatggagtggattcagagccgtgtgacgtgccgtcagaggcttcctgttcttcctcctcacttcagcgcaaagtgccagacccaaaaaacaggatttctacctgtctgtgtgtgtcgtccggggctgtttcttcatcttcccatgtcttgattttcaccaaaaaaggaggctgttaatacttgccttcttcacttttacatagagatatcataaagattatgaactaaagcagcaaagtacattgccttccaaggagaaagtgttccttg

SEQ ID NO: 2882 - DNA, 300 bp, Homo sapiens
gtaaaacaccccctacagttccaattctgggcctgtcttctatctatctttgcccttctggtccgttccctgttctgagccccagggaacttagggctgaaagtcacccccgaagcctcagaccagatcgggaggccacacgcagctcatggggacagagggcccagggtgacggtccactcatgagaagtgctatgtgactccagggagtctgtccctctccgggctccaatccccagcccaagctcagatgacccagcctgtgtccctttagcggccgaggagccaccacctgttcgg

SEQ ID NO: 2883 - DNA, 196 bp, Homo sapiens
  misc_feature 62, 63, 70, 73, 82, 83, 84, 89, 90, 94, 101, 102, 111, 118,133, 142, 144, 147, 151, 156, 157, 163, 164, 168, 179, 182,187, 189, 192: n = A,T,C or G
gccaccttctaagcaagtgatggcctggctggttcagtaccctttgcaccctgctttacaanngaacttngtncactgtttnnnaggtnnatanctgagtnnacacacttntgcattngataaatggtactgngattttctngnaangaanaattnntgttgnnaggnaatggcatcanaancttgnanaanaggt

SEQ ID NO: 2884 - DNA, 286 bp, Homo sapiens
  misc_feature 94, 103, 109, 110, 118, 120, 122, 125, 126, 129, 131, 137,139, 140, 142, 150, 159, 164, 166, 174, 175, 176, 178, 179,182, 185, 186, 188, 190, 193, 211, 219, 221, 223, 224, 239,240, 242, 250, 258, 259, 262, 280: n = A,T,C or G
ggaaggcactggtccgagaacaccggattcactgcgtgctgtcctcacttgttctacaatgagtgccaaatctgctatcagcatggaaattttngcacctctngatgannggatgctngnanccnnccnanagacgnanncnatctcaanagctccctngaatngntttgcctnnncnngtncannantnccnctaacagaggacctggcncaccttancngnnacattcaaatgactnnangacatcancatcacannctncagttggcacttatctgngtaact

SEQ ID NO: 2885 - DNA, 300 bp, Homo sapiens
ctcagccaccgtctccttacctgactcctctgggaaagagtttccctaggttaagccatacagggatagggtaggagatgccatttggatctaggagcagagggcagagcctcagcaggaagagtgtctctttgagaaggagacacagtggagcaggtgtgtaggttcacagggccagctatgggtagagtcgggtgtacatttttagaagccacaattcccaaaaatctcctgactataacatcagtgcacagagccagtcaaatggaggaggagtgggtccaggcaattcaggaagaa

SEQ ID NO: 2886 - DNA, 300 bp, Homo sapiens
gcatccgtggcctcggcctggagagaaaccaaccagctttgctgtctggcttgcggttccgctcctctgtgaggggggcgagattgcccgttctcctcgaagaatgccgttacttgaggcccaaaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctgga

SEQ ID NO: 2887 - DNA, 300 bp, Homo sapiens
gcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtca

SEQ ID NO: 2888 - DNA, 300 bp, Homo sapiens
gtgcatcagagccaggaggttccagacttgtcactgtcacgtcaatcttgtaactttccaacaggtcctccttcccagaaaccaaatcagattttctacttgaagcagtaccaagcctctggatagagcttcgagggaaggattttggggtcatgggttttttccagggaggctcgaaaaaagcttcccttgcagtttgagtttgaaggctgtagctcagtggcagatcaggacacctaggaacatttccaaggaagtagccatttctctcccagccttgaaccctgatctctgggttct

SEQ ID NO: 2889 - DNA, 300 bp, Homo sapiens
gcaacctaaagtaaatctcacatcttggcaatcgtttttaaatatgatcgtcccatcttgatgtgctgctcctgctgtggaaggtatccctgggttttaggcaagcatatgtgttctttactatggctccagatcccagcatatttgaagtcctgagtcaacctgctctcctagacaagcagacattaagtatgtcgcttgggctcttaagtgcgttctcctgacttttacccatctttgtggcagtaaatgcatacgtgtcactgtatatgcggactagatacctcaggtcccagcgcc

SEQ ID NO: 2890 - DNA, 300 bp, Homo sapiens
ctgatagcgacgcccgttgtattcagcgctctcccccggctgcaccttggaattgccgaagaagctttttttaaactccaaatgggccgggttggcgctgcagctctgggattcattcattcatatagctcgtatttattgagcacctaccatatgcctggaacggtgctagggaaacagcagtgttaaacaggtgaagtcctgcccgcatgaagttttacattgtagttcaggacacaataagcaggttgcagagcctgaggcctgtgatcagatgtacgagagcttaacgcgactcca

SEQ ID NO: 2891 - DNA, 300 bp, Homo sapiens
gcggagcttgcagtgagcagagatcgcaccactgcactccagcctgggtgacagagcgagactccatctcgaaacaaacacaaaaaaaagtatcaaagacagaaagtggaagttacaaggctttttaaggccttatcttggaagtcacagcaacatttattttgcattccattggtcaaactcaagtcctaacaggcctaagggggtcaagtaaaaggtgggactcacaggaagttccatatacattacagcttcacttgcagtacagaggggaagggaaatcctactgggacagaacct

SEQ ID NO: 2892 - DNA, 300 bp, Homo sapiens
aaacgaccacctttacgagaattctttgtcgatgactttgaagaattattagaaggtgagagaactctttaccacacgtttcttccagatgctcctatggtcccgtaaacaatgatatttttttctgcaaggctattttactttttaagagcagtaatcgtggcatttgccgcatgatgggaacccaggtagggagcgggtgatgttcccaggcagccttggtgtcggcaggtctctaaacctggttgttagtcgtcctctgtgggagttgattttgttctgtgacccaggtcaggtctc

SEQ ID NO: 2893 - DNA, 246 bp, Homo sapiens
ggcacatcttctactagctaacttggtccttttttatgaaaaaataaaacccttgcgtagttctccctcaggggatgcctaggattttggatgagaacgtattggctcaatgtgagtggggcagtggcaggcatccatttcccttccccccattctgtcacaggtgcccatctgcctggcagttcaatccagggctcatgttggagactccagagccccttccttgctggtgcctgcctgaggcat

SEQ ID NO: 2894 - DNA, 300 bp, Homo sapiens
acactgggctcaggggctgagccattgttgggtgctattacttgtgttgggaaccaataaggaacagaaaacaaacaaaaacactaaaccagagaagcgggcttattgaatactttgcacctaagaagaattaagaggaaaaggaggaggttagagttggtgcatctgctcctccggtgtctgagtgtgataagaaagatagatgttagaggtagcagaattgtgttgcaagaattaaagccaccagcagatgagacttggaccctaaacaattccccaggagaaacctgtgaaaaattt

SEQ ID NO: 2895 - DNA, 300 bp, Homo sapiens
gaaaaggccccagaatgggctggcttgaactggaaaaacacactttctcatcccttttggaccacgagcttcttgagagcaaagcatgtgtttgatattcctttgctcaccctcaggccttgtttggcaaattgcctgggatacagaaaataaggacaaggtctgggtgtagtggcttatgcctgtaatcccagcactttgggtgaccaaggcaggaggatctcttgaggccaggagttgcagaccagcctgggtaacatagtgagaccttgtctctgcaacaaaatttaaaaattagcc

SEQ ID NO: 2896 - DNA, 300 bp, Homo sapiens
ctacgatgaccccctcttcaggctgccatttggtagagggcaagggagtggctagccatcgagtaagaccatgctttgcacccaccatcagcaaggctcaagatagtgcctgcgtcctcagaataagccttcccttctgcaggtatctcatctccatctgtgggaaccaggtatgaggctctgaacagttcctgctctggcaagacacctccacatctttctccctcaaacattcatagcctctctgccattttatgcttctggtacaccagaaataatatcacaatgccctgcatcact

SEQ ID NO: 2897 - DNA, 300 bp, Homo sapiens
gggaaggtctggctccagcttgagcccactcacaggatgtcagggggaagtgtgactaaggtcacggccacgccacgtggtgggccagctggatccagagcaggggccgttgtggccacacatcctgagtttccatggtctaatgcagtgggcttgaaaaaaaagggtggatgcaggatgctggctgggactgtggagtgcgtgggcagtaagtcttaagtgacagtgggtggagattacagcatttcatctgcttttcctttgacaccttttaaagatacaacccacagttttcaaggg

SEQ ID NO: 2898 - DNA, 293 bp, Homo sapiens
  misc_feature 211, 214, 217, 220, 231, 234, 242, 245, 247, 253, 254, 260,266, 278, 284, 286: n = A,T,C or G
cacaaagccacagacacgcgaacgtccaagaagttcaaatgtgacaaaggacatcttgtgaagtcagaattacagaagcttgtccctaagaatgacagcgcttctttgccaaaagtgacacctgagaccccttgtgaaaatgagtttgctgaaggcagtgccttgcttccaggcagcgaggctggcgtttctgtgcagcagggggctgcangtnttnctnttggttgctgnatnagttgttngtntnttcatnnttttanttctanattagctttttntcttgntntagtgtt

SEQ ID NO: 2899 - DNA, 300 bp, Homo sapiens
caaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggtta

SEQ ID NO: 2900 - DNA, 300 bp, Homo sapiens
ccttgctcaggaggaggcgtttggcaaggacatttcacatggtttgtgggtgaatagtttcacaccagagtgggatcctctattgcatgtactcgactagcttttcattcttatcacacttcccttcctataaagttacgtatcttttaaagggaaatttaatacccaccttcgctttctgtgcggccttgtgaaaatcaggcaataacaaggacagccttattgccagtgtatgaccagagcatctagatggcactactagtggaatgtcatcttgtctaccattcattcattcattca

SEQ ID NO: 2901 - DNA, 300 bp, Homo sapiens
cctacctcaccaggttgtcgtggggagtgaacaaggtgagtggccctcacctacagactcaacatatggcctttggctcttcccacttccaagagtcttggaagggatgggtcgagcaagcagaggaaaggaagatgtgagttcccaaaatgctcctcacctttttcttctgagtgggctccttctcactggcattggagggcttgcggcgcagcatggtcctccaccctgggagactccgtccctgctctcctaggtgtcaagatgcagaggcctcttgcttagcctcaccagaactgc

SEQ ID NO: 2902 - DNA, 300 bp, Homo sapiens; identical to SEQ ID NO: 1697

SEQ ID NO: 2903 - DNA, 296 bp, Homo sapiens
  misc_feature 212, 213, 215, 251, 256: n = A,T,C or G
attcaaagtacatttgacaacccactgcaagttgtggcatacatgggtgccatgaaccatgacaccaactacagctttcaggttcaatgtggcttaattgtggtggcctacaaagatggatcacctgcccacccacatttcatggatgcagagctctgttcccagtactggaccaagtggcttcttcgactagaagaatatacggaaaagannangaaccagaatattcagaaaccagaatattcagaatngggancaagttgctatttgggaacattcagcaccttctcacagtt

SEQ ID NO: 2904 - DNA, 300 bp, Homo sapiens
aagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcaca

SEQ ID NO: 2905 - DNA, 300 bp, Homo sapiens
agtgactacttagaagatgctgtccccaccttcgccccctccctctagttgcccaaatgtcttacctcccccagcttcactcgggctagtggaggtcttcttagacttctttcaaggcggaggatttagagtctggggtgaagtggcggtgatggatggctggggacgtggggctgctgactcaatggtgatacatcaagcagttaattaagggacaagttatcttctaagtgggaggtaaaggattttctggtcctttgttcttaatgctcatattaatgccattttccctcatggaga

SEQ ID NO: 2906 - DNA, 300 bp, Homo sapiens
gtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggatatatctgtaacttgccactgccccgaaatgaaactgatgccacatttgccacgacgtcacctataaatcagactaatgggcacccacgctgtattgtcagtgatag

SEQ ID NO: 2907 - DNA, 300 bp, Homo sapiens
gctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtt

SEQ ID NO: 2908 - DNA, 300 bp, Homo sapiens
gagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctaga

SEQ ID NO: 2909 - DNA, 300 bp, Homo sapiens
ccgtgcctcgctttccctgtcccccgccctatggacacccctggctcaggccagtgtgcttgtcccagcatcgcgctcatctcctgtttttatttgatgttacagatttcatttcattaggaatgagtgtttcctccccgacttttgcctgcattcttttccagctcctccctggaaaagggcaggggcggacactttcccagcctcccaccgtgctctgttcctagtggcacctgccccagggtctgggcccctagggatgcgtcctctaccctggagactgggatcttcttaaatccc

SEQ ID NO: 2910 - DNA, 300 bp, Homo sapiens
tgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgca

SEQ ID NO: 2911 - DNA, 300 bp, Homo sapiens
acattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcc

SEQ ID NO: 2912 - DNA, 300 bp, Homo sapiens
gtgcaggctggttacttacagttcactttccctctttgaagccccatttacaataggggttggtatccttgagaccccacctgcttaggctccagatgtcaccagaatttcacatcagctttatttcctggattggtaaatataaccccatgataaaagtggctctgagtgttgggtttacctcttggacttcctgtcctcaccaatttttgaccgaaaattcaaccctatgttgttagctctttgaattacctattctgtcctcattagaagagtgcctccagcatttattgcctaaac

SEQ ID NO: 2913 - DNA, 300 bp, Homo sapiens
agctgggggtgactacagctcacctgcagctggtgagcaactcaaagcagagacccaggtgagccgggcctggacccctgagccaaggaaactgtgagataacaaatgtgtgttgtaagcagctgactgttaacggaaattttctaggcagccataggtaaccagtacaccatgctaggtcagattaaatgtcctcagattagcatcccttccattccctggttcctgaatgtggccatgatttttaatgcatgaaagagccatggcagggagattatctgtaggtcaataaaatcatac

SEQ ID NO: 2914 - DNA, 300 bp, Homo sapiens
aattcataaaaggagttagttgcagtcatgtgtggccttgtctagaagcaaaaattataatatcaaaagctctacgtatgaattgggccttaatgtctttgtactcatttattcttttattgaaaaaaagctctaaatgcctattttgtgtcacataattgagatttgctttgaaatgtctgattctttactatagtactatctgagttgttcacagtggtatggtgatccatactctgaactgttccattatctggaattaaaggcatataataaaaagaaatagactgtatttagttt

SEQ ID NO: 2915 - DNA, 300 bp, Homo sapiens
acagatcctccctctgcagatggtgagcagtttcccactcggctcttttgattgttctgcaattttcaatgaccatggcacaaatttatttaaagctgaaatacttcacttctattaaagcagttggctgggtatattgtttttgctgaaattattactctaggaggtaaatctaggctttatttactactttgggaaagtacatttaaaggccatgaatcagaaactaggttacaaacgttaagactcaaaggatctgtatactgaggcctatatttccatgaagtggttctctactct

SEQ ID NO: 2916 - DNA, 300 bp, Homo sapiens
cactgtggagtccctgcaagtcagcaggaccagggctgtcttcctgcaccatctggatttggttagctctctctgggcagtggggccgagtctcatttcctccaacaataatgttatataggcaatgatcctgggctgccctaacataattgaaaattatgtgtattgtaggcttggagtgctgaaatgtgggctcataaaaatatgtggtgcaggtagcctatggagattggatgtggcacacaatgaagctttatgtaaagtaagaactataagtctccatgttaatattgtattatg

SEQ ID NO: 2917 - DNA, 300 bp, Homo sapiens
gtgacccttcctgcccttcttgagcagcttgtgaaccagaagatgtgcctggagagaaagcctcatttggggaagtgcagtagtcgaagttctttattttgaaaatggagaacaacccttctcacaatcctgtctccccttccccctttccaactagaatatcagctcccctgaacatgagtcagtcacatttcagggaaaactggctgatgttgaagaaatcacttgagggcaaactttgtccttcaagctgtgggtctctgaagtgtagagccagcagatcccccagtgtagggactg

SEQ ID NO: 2918 - DNA, 300 bp, Homo sapiens
aaagacttataagccctctgattgagctcctttgttgttgacttcttgatcctctttaattcaggaatcacagttagatttcttagaatccttctttgtgctccaagtatcaaagaccttatggggctccccagccataatggaaaaagtaatttctttaacaggggagacaccagagcaagagcggagatgggggtacgagggggtcctcatttatgcagctggccagagctcctcatccaacccggggcttagtgaggtgacagatgtgatgttggccaatgtagtcttccttttctt

SEQ ID NO: 2919 - DNA, 300 bp, Homo sapiens
attttctgaaaatctcagttgggccagtctctgagccagatatgctaacttttgcctgtgggattatgtgatttactggggtcagaatagtcaggtatttttatagtaggcagttttactatatgctatgtggacaaattgaaaatgaaggactgagttttttttttcccttaaatctaattggagatacaatacatgaacctacaagggaacatttactcagcagcatattaattagtgccaatttaaatatttgatgattgctaggtagcaaagaattctctagatcctgaagaattt

SEQ ID NO: 2920 - DNA, 300 bp, Homo sapiens
cccgcctgtctcagacatccccagctgggctcaaggctgtcctgcagctgctggttgaaggagccttacatcgaggcaacacagaactgtttggtgggcaagtagatggggacaatgagactctctcagttgtttcagcttctttggcttctgcctccctgttggacactaaccggaggcacactgcagctgtgccaggtcctggagggatttggtcagttttccatgctggagtcatcggccgtggcttaaagccacccaagtttgtccagtcacgaaatcagcaggaagtgatctata

SEQ ID NO: 2921 - DNA, 300 bp, Homo sapiens
aagacacttcctctccggaaagccagtcatattcatcccagcgtctttcttggtgtctgtgcatggataaagcctccccattcccccgtgccccccaccactttgtgtcctttcactttgcttcacttatgtgcccaccactccagggctccctgaggtccaggaattccatgccattccctttcacatggctgagagccccagccctgtggatgagctgtcctgagtgggcactcagtaatgtgggcgtaactgaaccaagctgaagagggaaggagcaaaaaacaaccagaagccctc

SEQ ID NO: 2922 - DNA, 300 bp, Homo sapiens
atcatctagaatcccagcagtttccttaagttgcctactgtcaattttccatttctctcgtccaaattcacatggagacatcatttttacacacttgtaatcaattgtaggcggagtctggggtcctagcacttcccctaacatcatctcatgatacttagacttttaaagaacccttgagtaggccctgtgataaaggatgttagtgaaaaaaataatgagaaacagggacttggcttagagaaagaagcctgcgtcagatcagtaggcccccctggggctgtggaagcatgcagaagg

SEQ ID NO: 2923 - DNA, 300 bp, Homo sapiens
agtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagact

SEQ ID NO: 2924 - DNA, 300 bp, Homo sapiens
aggaggcgcaggcgcagcacaggtggcaattgaagccggaagaacatctaccaagagcagagaacccaggaagaaaattctgcctctttaatacgttccaatatggacgttttccatatagatacctatctatatagatagatgctctgggatctgacggtcctggacacctgtatggctgtgtgctgtggtctttgcctagcctgcggttcacttttgctctggccaccacctcccctcatgtacaaaccgcgtctctgctctgccagtcttggcccccgtcaggcagcggttcactcc

SEQ ID NO: 2925 - DNA, 300 bp, Homo sapiens
gcttgtgcttccacctagagctgcaaagggcagcgggcagaaaccgggctggggctggcattagctttccctcctcccagtttctctccagcgcagcagggcacctctagcccagaaaaagaaaactgactttctcttatttctgttttctgctgctgctaatctcctcctgaagggttgtgtggcttcttgggactctggaaagaaactgcaggggacgaggacaaaggaaacagctactgtagtcactgcagctatgcaggctctgtgctagccctggaaaggcctggacgttcaggt

SEQ ID NO: 2926 - DNA, 300 bp, Homo sapiens
ctttttcaaagtgttgatggtaatctgaggcaatctaagggagtcattttttaagtgactttatacagaaagattggtaagagccaaggggtagaagtggcataaatgtctaaagcagggaagtgacaggactttcattgttcttggctgaggagaagcgggagtggctgatggaagcacctaaatgatgcctttgtctgtgggaaggcaaatgatgccccagagctctaaccaaaggttttgcagccgccgaaaaacaggaaagttgggaagcgggggtaggactacactgaatcatta

SEQ ID NO: 2927 - DNA, 300 bp, Homo sapiens
caagaattgctgctgctgttttttttttaattttattttttatttttaaagactttcctaccttctcattgagagagagaaagatgcccagagttaaaataggaggtgcttgggtattttgttgaacttcacaagttaaactggcgaatggcgtccatcagctgttattcagtccttgaacagagcagatatgtttgtgcgaggacaaagaagatgcctcaaagacaaagaagaagatgcctcgtcgtcccctgagctcccacacggcatctgcacatcaccagctcagcatttagcaca

SEQ ID NO: 2928 - DNA, 300 bp, Homo sapiens
gcctggcgaattttttttgtatttttggtagagtttcgtcatgttgcttaggatggtctcaaactcctgagctcaagtgatccacctgcctcggcctcccagagtgctgggattacagtgtgagccaccatgcctcacctagggtgtttggtttttaagtgaaacatgcacatggtaaacattaaaaccgtctaaaaggctggaccatgaaaagcaaggctcccttctcccacccaatccctgaattctccctggagagtatccctcctaagtgcacgcacttccactctgttccatttc

SEQ ID NO: 2929 - DNA, 300 bp, Homo sapiens
gtgcacctttcaaatagtagggaaaacaagcatcgcctaatatgttgtgagacctagcaaaaggaaccctaggaaaggaggcaggagacctaccctctgatttcagtagtagaacactgatttgctctgtgatccttgaataactctggtcctcaatttccattaccctgactggtattttaactgtaataattcttccatgaatctggaagtcctttctttctttaagaaacagggtcttgctctgtcatccaggctggagtacaatggcgtgatcacagctcactgcagcctcaaatt

SEQ ID NO: 2930 - DNA, 300 bp, Homo sapiens
gcctaaagtaactgaagatccatctggacgtatacgtgcaagtcacaagggatgcgatggcttggcttgggctcagaggcctgacactagttattataaaatgtactttcagcagtcttctgggacttgactaccttgtggattgtactagaaatgtcaggtatggtgactgctctgcccaccactctaaatgaaactgtccccccacagtctctgttgcccaggtgtcctatgtccctcgtcacagctgaatggaccaaggcagatgtgctatcaaggacagccaatcacaagtgagca

SEQ ID NO: 2931 - DNA, 300 bp, Homo sapiens
agacagtgtactgggagaggctgatgaaagctaagacgtgtaggatgtaccacatgccaagttatggtcatttcatcctcacagccctatagctttagtactatgactgtctcccttttacagatgaggaaactgaggctgagagatgttcagtaagttgcacaaagtcatacaagtgggggcagagttgggattcagatcttgccattgtgcagaaggggtgaacaggtgggttctagagtccttaaaaggtattgaagggttttgaagcaaggggacgaaatccttggaccaacattc

SEQ ID NO: 2932 - DNA, 300 bp, Homo sapiens
accatcttcactctctgggaagaaataaggtgggttaccatttacatcccagtgataagggccagtttgatcattccaaagatggttggttaggccccggccctatgccagctgtacacaaagcggcaaatggacactcaagaaccaagatgatatcaacctccatcaagacagctcggaaaagtaaaagggcatcagggctgaggataaatgattatgataaccagtgtgatgttgtttatatcagtcaaccagtattaaaggcctgcctgatatacaaccctcgaatgcaacacagtg

SEQ ID NO: 2933 - DNA, 300 bp, Homo sapiens
gtgagccgaggttgcgccattgtactccagcctgggcaacaagagcaaaactctgtttcaaaaaaaaagaaagaaagaaaattacctggaattcaatattgccatcggctgatttaatttctaatatgaagaaaggggcagtgtgatgtgccatggagcatccacaacctgccatttcagcccagccaaccttagaaagccattgaaaagagttgtttttaatggtgtttttacatccagcttcccacacctcaaatacttggggtggaattgttaatctcacattgcagtacaatgaaa

SEQ ID NO: 2934 - DNA, 300 bp, Homo sapiens
attatagctctatccatacaatattgtgattgtctctggtcttgttgctttcctgcactagattgtgagcaccatgacattagggatcatatcttttcattgtactgttagctacacataacagactgcatgctatacgttggtaaatgttaattaaatgaatatcttctcaggctagcttttttgatcgccccaacgccttggctagttttctctcatcctgcctcagattgctgtggtgatgcgtcccgctagcacctgcagagacagccctgttggtaatgttggccacagtgccag

SEQ ID NO: 2935 - DNA, 300 bp, Homo sapiens
cagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaa

SEQ ID NO: 2936 - DNA, 279 bp, Homo sapiens
  misc_feature 84, 85, 87, 94, 95, 99, 108, 109, 136, 162, 189, 193, 198,201, 212, 214, 217, 223, 231, 236, 237, 240, 244, 247, 254,261, 268, 270, 272, 273: n = A,T,C or G
gttagactgaagaagattaaagaggaaagcagagactggttaggttattatagtgtcctaggtaacagttttggacacttgtgnntnatgtcgnngtgntatcttcanncactgggccggagctgcagccctggangagggggcgggtcgaggctgtgtggngattggggtctccgcccccacgccctncccnggcanggnctggagctggncngangccaantgcctttnagtcnnttntgcnaanccctctngggtccngacgctntncnnttggcc

SEQ ID NO: 2937 - DNA, 300 bp, Homo sapiens
  misc_feature 292: n = A,T,C or G
cccatgtccagcttggtcccgcatatgtgggagtgtgtgtccgtccaggcctgtgcctcggcccacagcaactgcttcgtgtgctggagacgcccagaccgacaggcgaatggttcgagtgcacctcgatccgagtctcagcacctagactaattaggatgacctcagagatgctgaagagtacctttggtcagcctcagtctttttgtttttggttttttttgagactgtgtctcactccgtcacccaggctggagagcagtggtgcgatctcagctcactgcagcctcancctctcag

SEQ ID NO: 2938 - DNA, 300 bp, Homo sapiens
ggccaatgggacccagtgtaagaaattgcacctgtcctggcagatagagaaggtggaagcagtgaatggtagagcatcctcactcttctctctgccagcaagcacctttggggaagtcctcacggacaggaatgtcgtgtgtcttggcttgagatgtcaaagaaacatgttggacacaccatggtgacagagcaggagtctcttaaccccggcgtggttgaggctgccgttctggtgggatctggggtcagtcaggggttaacagtcgctcctgcttgcctgattgacacagtaataaag

SEQ ID NO: 2939 - DNA, 221 bp, Homo sapiens
  misc_feature 206, 208, 214, 218: n = A,T,C or G
cttttctccaccttgccctgtctcagggaagaaggaactgcccttctccccgtggggacctggctgcctgctctgacaggtacctgtcatctgcccaccatgggcttctgggacctgctgtagcccctgccacccactgctgcagacccacccactctcagcttagctcaaaggctgttctctaactcatttctgagaataattgnanggctgnagtngca

SEQ ID NO: 2940 - DNA, 300 bp, Homo sapiens
ggtgggcaggcagctgcacctcattcctgagaccatccggggcagggcttttctgactgagacacacgaccctgacaccagagagaattctgtatttccccacccttgcaggggctgcccctagagaatcccatcgggtgagcccaggaacccacaagttctgcacccctcggatgggtaggcattttgagggcatgaggtaggcgttacagtgataagatacacagggctctaaaccacagaggccccggttcaaatcctgcctcttctaagtacaaattagttggctttgggaagtga

SEQ ID NO: 2941 - DNA, 300 bp, Homo sapiens
cagccatgcacaccagccctgcacggaagggcttcctgatcctggctcatggatatagatacccttgagtgcaaaactgtcctgtccgaagtagaatcaaatcacttttctctggtcagctctggtgttcaacaaacactacttgtggttgaaaaagtgctggatttggaaaccagagaacccctagctgggtgaccttgagaacaaggagatgatagtcctcattccttgcaaggtgtattggagacgggtgaagggtgtggctgtgctggaagctcctactgctggcctttgccccag

SEQ ID NO: 2942 - DNA, 300 bp, Homo sapiens
ctccctctgcttcctcaaacccaggcttcgctgcctctgcggagttcttacctgtctctcctttccacccgggttccctggaggaagctaaactcagaccaaggccctgggctccccaggagttaaaagggaatacgctgtcccaagattctagaatgaagagtcaacgtagcccgagtggcttaaacctcctgtccttaaatgcaagaaatgttttctatcgagccctggacaggtgtctctgctggcctggggttttcaacaggtcatgcctgcctcagaccccagggacaaatgttc

SEQ ID NO: 2943 - DNA, 300 bp, Homo sapiens
ctctgttggagattgggagggggcctatgcatcatgctttctgtagtgcaaacccctaaccatgtgccagcactagctagtgagatctacagatcatcgcctcgcctcattaagtcaaaggcttcaacttctgcttccacaagtcatctttttgttcactctctgtaaaataatcaactcacgccctcaagtttctgctgtggagttgaggtgacaatatttcaacagaattgatgccatatggaaaatcccaagctagcttttgtacaagtacaaaatcaaatattcaaaacagatgag

SEQ ID NO: 2944 - DNA, 300 bp, Homo sapiens
aattgcttaggatacgagtctgtgctgggtgaccagaacttgacacatacacaatattaaatttaaaaggacatttaaattactcattagtcagggccagtgttaaccactacccatttggccagtgtcctctaaatattatcatttattgtgttattgcagctggggagggagaaaatgacagcatcccaggggtaagatttaatcttgaattcatcaggaaaatgacccctgaacatccccgagtctagccctcatttgagaactagtcctgctaattatataccttccccgtaaagt

SEQ ID NO: 2945 - DNA, 300 bp, Homo sapiens
cactgtcctcctggagcctccatttcagtcatttacagaggattgcgccctccaggactccattctcttgtgctgcctgccattggagcattgtattcagtggcctcccacagagagtatcaaaactaacccagtatgtggagacctatgtcagtctatttatttttctatctctgtggggctggagaaggaaataaacataaaactaaagatttaaagattacttttgatttcacttagtttttttataacatccttgtgttatgggtagtttcagaatctcaagaatgagcagagaat

SEQ ID NO: 2946 - DNA, 300 bp, Homo sapiens
gctatctaaacctaatcagacccatgctcttgtcccctcaagagcactgttatctccattagcctcctcatagaaaatttaagcagccctctctaggacatcaccagttcatttccaacctcagctgccagcagggagtactcctacactgtgtaacttcagcctctcgccgttctgtttgaggaaacttcctcccctcagggacccacacttggggttcctcgagtgtgtagtccagagggtcccagcctttatcaggagccttgcctgtaagagaagccttgcctattgccccctatg

SEQ ID NO: 2947 - DNA, 300 bp, Homo sapiens
caaaaaccttcagccatggccaggctgcatccctttggtcctggagtttcatctacttactgccatcttccacggtctttgcactgtcccgtgtcccatccccctgggaggcagaagagattgcctcggagtggccttatttttctcgcaacttgtgaaatgatgtagtgctctatgtaatatggccgagtttccaagctgtcatccaatggaagtagaatcttctctttgaatcatatggtacaggtgccaatatgactgctgctatttagagtcagagaggtggaagtcactgggtcc

SEQ ID NO: 2948 - DNA, 300 bp, Homo sapiens
gaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtg

SEQ ID NO: 2949 - DNA, 300 bp, Homo sapiens
gaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacaga

SEQ ID NO: 2950 - DNA, 300 bp, Homo sapiens
ctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgtgaaaatgaa

SEQ ID NO: 2951 - DNA, 300 bp, Homo sapiens
atctttaaagaaagcatccacagtttctgtgccatttcattgacaggttttattttaaatgtagacatccacagaggataggagctgcagcgtgtgctgctagactcaagagagaagtctcgctgactcatgcaggttgaggttttgtctcattcccaggaatgcttggactcccagaggcagtgaagccacacattttagcagaattacctcagcagtgtggtgcatgatcatgaacttcaagtttacctacaaggaagatttcattgtccttctgtcactagccaaacacttcacagc

SEQ ID NO: 2952 - DNA, 300 bp, Homo sapiens
ggacgttgtaggaggaagaggctgtaggggtaattggtagaggcaggtctagaagggaaggtcaagaagggaaactgggttcttccagaatacttttgaaaagttctagggaatttttcaaaggctattttgttaaggatattgagtagtgcttagaagatacagtctccactttgagggcgcatgaaccctctaggctgttgatgagagagtctgagcacttcccaggtttttctgcatctagacatgagtaaatggtgaagaacacttggttttgttttcaggttatatctgtgtcct

SEQ ID NO: 2953 - DNA, 300 bp, Homo sapiens
actgactcttccccctagagtttctccttgagaaacaaagtccctgtgatactttcctggaatgttgtatacatgaccttccccgaagggacacaagtgtttctggtgctttccaatgggaatgtgggaagggacccaggtgggccttgccactttgggattgctgtccctgaagaaatcccttagcctgatagaaacgtaattgttgggagcaatgaactgtgttgggggagaaaacataacttggcctttcttaagctgtatggctcagtggtctgagtttctgtagatctcttattg

SEQ ID NO: 2954 - DNA, 300 bp, Homo sapiens
gcagtagctgtggggatggagaaaagtggacaaattaattagagagatttagaggcagattggtgattgaattgagcagggcagtgagaggattcccaggtttctgactgaggtgtctaagtggggatggtgatgaaagggggaatattgggagaggatcacgtttggagggagactaaggcaccatcagtattctagagattagagggctgtgagagaattgtgataggagggatttactctttggcagatatccaagcgtggaaggcctgtttgatggactgtccttgataatcacag

SEQ ID NO: 2955 - DNA, 300 bp, Homo sapiens
ggcaagtgagatcttaaatgagagcgtgcaatgctcagtgtaatcacacggaggcctaactagatgaaatcagtaagaaagaatgtggtgtgtcagttcaagagttctgttatcttgagagccctggtgaccttagcttgctattcaattgagccaaatctgtattttctgaaggcagaagatgaaagcaaatgatagatgcttagatttgaggaggttatttggtgctgttgatatttttaaactttaaaaaggcattaaaagatctaatttaaattgcacatgtaaatgtggctgtgc

SEQ ID NO: 2956 - DNA, 300 bp, Homo sapiens
ggatgtttggcatcactagcctctcatggtaaatgccagtcatgctcctcagtcatcagaaccagcaaaaatactcctcacatgtccttagatagttgcaaatgctccagagaggggtaatggcactgctcctacttgagaaccactggctcctgtaactgcttggcctagttctaacttctaaaatgttctcctttcctgagagtataatgaagagccagatactttgtgatctttctatcattcctctggcttcttggacttccttaatgattgagctcagatgctggagtcacatcg

SEQ ID NO: 2957 - DNA, 300 bp, Homo sapiens
ccccacccattagttaggtgggcctgcccaacaccttcctgggttcacatccggccagacaagaaagaagccaaaaaactttccgtctaccactgcgcctcctcatgcccaccccatcctattagcctaaaatggaacgggctaattagtttatttgtatagggaggggtttcagctgcctggacaaaaccaggagtccactgtccaagcttcttctgttttcctgagctcagaagaaaaaaagtgtgttagactaagataataccgccttttgaatatctcggcttcatatttgcctcc

SEQ ID NO: 2958 - DNA, 300 bp, Homo sapiens
gtctcttggtgcgctttcatctgtcctctaaagcacaccctgcccctccctcctctgtcctcatgccgcccttgtgcgtggtccccagctgttggtgtcagggcaaggacaaagacccgggacacctcaagtctgagtcctggtgattgccaggccctggggaatgggggaagatgtggtcagaggctcttcttgtgaccggggcaggatgtgtcttctgctggaccggcaccttttgtttgtcccattggtggcagatgtgagcgacatcaggcgcttcctcagtgcatttcacgagcc

SEQ ID NO: 2959 - DNA, 300 bp, Homo sapiens
gctggaggctgtcagaaggatgctgggggtgaagacaccctggggtcctgacaaccattgggagtgtctggtgctcctgggtgagagagagggccagttggaaaagcctgcaggcccagccctggggcagaactgagtgtggcgggtgctgggcacaggatattcccccaggggcttagcttcatgcattcaggcttaccttgaggctccaagcttattggtggcataagctctgcagatccctcacctgccatcagcctcatctgaatctttgtctttcctcagataagcccttaggca

SEQ ID NO: 2960 - DNA, 300 bp, Homo sapiens
tccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatgg

SEQ ID NO: 2961 - DNA, 300 bp, Homo sapiens
atataaaagcgtttagaagaagaagcaaaagagacccgcacattccacccagggagggcatggagaaagaacagtgagtggaaggaaaacaggtctgtgctgtcctcaagcatagaggtctttctatggcaggcacccggggcagccaaaaggacactgtccacagccaggccagagtctagctgtcacacacataggcaggtgtgttgcatacctcaggcatgcgttcaggagttgtaatacttaagtgaatttgtttttttacagcaacaacctatagttccatttaaaaagggatag

SEQ ID NO: 2962 - DNA, 300 bp, Homo sapiens
gggaaagaaaataactttgtgaagccagtgtattctgtttttaaaactgtgcctgcagtgcaatactccttctggtgtattttatccattatttcacttgctggtcgtcatttcacagccagctttgacatgcccgtgaggacaggagccgccgcttcagttgtcactgcagagccatcgtatgtcagttgcaatttccatctgaagctatgtctttgacttcactttaagcagaaaattttgtaccctggtggtcgagtcttcccttaaaaattgttaaatcatttggctttaatggtt

SEQ ID NO: 2963 - DNA, 300 bp, Homo sapiens
gcacaggccacggagagagagaggccgggcctggatgaagccgtgggcgttggtgccgtgcgaggcccaggcatgcttggaggaaaggtcaccgtggctgtaaagtgctagccagggcgggagccgggcttgtgtttctcgcacagtctcagccatctgtcagctgcttcaaagggcattcaaaagtccaggttttgattgtttcttggattagtctgagtcgtgtggcctgccttatccaccctggaaagttctaggcaattaatatttatgtggcatttctgaggttttgatgccccg

SEQ ID NO: 2964 - DNA, 300 bp, Homo sapiens
gaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttcc

SEQ ID NO: 2965 - DNA, 300 bp, Homo sapiens
gaaacccccagctttagttaggtctactttcatgatttttcctggcatactgaaaaataggctttctctaaacataaggaagaatcgaggtgaaatgtgaacctctgccagtatagttattggtgatgctcttgcatttagtcataatttggaagatggcaggctgacccaaatgagcatttcatcactctgcttaatttacttagagtgatttgtgaatcctgtccttgtacacaggcgtacctcagataattcgagttctaatccagaccaccgcagtaaaataagtattgcagtaaa

SEQ ID NO: 2966 - DNA, 300 bp, Homo sapiens
gttcagcccaagacgttccattgatccagatggtgttagagcacatttggtcaggttgccttcatgggatatttgacaagctgcaaacccgagggcatgctggtgcccgagggcgcctccgtgctgacctcagcatgtgcagcaagagccagggcacaggggcggcctggcccatttcaggcaggtgctctgtgggagggtggctgtctccactgacaacccagggaggtcagcaaggaggagccctgaggtggactcgaaagctgtgggagctgatggccctcctggtctctgccacag

SEQ ID NO: 2967 - DNA, 300 bp, Homo sapiens
ccaagcagagccttggcattatagatacaggtttctaaaagctgatagcttggctgccagcctcatgggctggatcacccacaacttcatgggcctcttctagtggaagctggagcatttccttggtgaattcttttccctgaggggcaagatccatgccacacagctctctgaccctgtgtgtcacaacccttatggtccatgagcaaaatggttgctagtagtcatttgggcatttctcttctgttttcttatgtgtgtaataagatatacaaagtcgggcttgaagattagaaattg

SEQ ID NO: 2968 - DNA, 283 bp, Homo sapiens
  misc_feature 223, 225, 241, 254, 262: n = A,T,C or G
actgactcttccccctagagtttctccttgagaaacaaagtccctgtgatactttcctggaatgttgtatacatgaccttccccgaagggacacaagtgtttctggtgctttccaatgggaatgtgggaagggacccaggtgggccttgccactttgggattgctgtccctgaagaaatcccttagcctgatagaaacgtaattgttgggagcaatgaactgngntgggggagaaaacatnacttgggctttcntaagctgnactggctcaccgtgctgaggt

SEQ ID NO: 2969 - DNA, 300 bp, Homo sapiens
gaagaaactcccatgaagttcaaaggagcagcagatatgcagggtgcatctagaaatgaaaatctgaccctttgtccctctccttttcatctctcttttgtacaggccttctttccttctgtgcaaacagacccttgtcatagtcatagtccatcacgctgttaaatgatttccagcactgctctatgatgtgctgtaatttcagggagtagttttattttctacaacatgttgctctgtagcacgtgtatttcactactgagtggtagttctaatggacatattcttaacaaaatagtc

SEQ ID NO: 2970 - DNA, 300 bp, Homo sapiens
gtgacctgccagctaccagtgtttccgaaaatgagggtgggatgggcccatttgcgtagttggccaacagtcatccccatagccctctgaggaggggagggatgcttagagcaggcagttctgtcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttg

SEQ ID NO: 2971 - DNA, 300 bp, Homo sapiens
gctcattccagctggtctatcgtgggcctcagaaggtgaagagggaccgtattctggggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagct

SEQ ID NO: 2972 - DNA, 300 bp, Homo sapiens
cttgaggacttctttttaatgactttttcagacttgaggactcctttttaaagttgtagactgttccacctagatccttctggtcattctctactttgttgtggataaaaattttataataaattaggtaatgtttaaaagtggctttgtattttgtacatttgcaacaatgtgtgtattaacctctcctaattccatctactggcaaagcttgatttgatgagaattgggtcccctgcagtaatgtgactctgaagctgacggattagagagcttgtggttcaggcatgaaccttgtct

SEQ ID NO: 2973 - DNA, 300 bp, Homo sapiens
tgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatc

SEQ ID NO: 2974 - DNA, 300 bp, Homo sapiens
gtgatgctggtgatcaatggactggaagccaacagcagagacttagacccaagaagggagcttgaggtacaagaaaacttcagggtagacaggaaggaggcgtggtgaaagtgatgaaaggggagagtagaagggtggtccagggtcagacagggagttagatttaatccttcagggcactttcattacatcatagctgccattttgtcttttatctgactcaataataagtcagtaataagtaatgttttaattaaaggtaaatgcttggcaggtaggttaaacttcattgagtcccaa

SEQ ID NO: 2975 - DNA, 300 bp, Homo sapiens
accaaatgcacttgtgtatattttaagtgaaaagaagagaggactcggatgaccatgcttagttaagggggagggtgaccttttatatgcaagttgggaaatacagagaaagtgaaaggggaccaaaatgaaaacacatgaaataagataagcagagatgaaaggtggcactagaactgtaagaagcatttgaacaggcagaacagtgctggagactttaggagagggctcaagctgccatgtggccggtcctcaaatagttctagaatgactagcatatctttttacaaaactataagc

(The sequence listing continues in the following parts.)

That which is claimed is:

1. A method for assessing the risk that a human patient has colon cancer comprising:
   a) determining a level of a nucleic acid and a level of at least one molecular marker gene in a patient sample comprising human colon cells, said nucleic acid comprising the nucleotide sequence of SEQ ID NO: 23702;
   b) comparing said level of the nucleic acid in (a) to a control level of the nucleic acid; and
   c) comparing said level of the at least one molecular marker gene in (a) to a control level of the at least one molecular marker gene;
   wherein at least a two-fold increase between the level of the nucleic acid in (a) and the control level of the nucleic acid, and a change in levels of expression between the level of the at least one molecular marker gene in (a) and the control level of the at least one molecular marker gene indicate that there is an increased risk that the patient has colon cancer.

2. The method of claim 1 wherein the at least a two-fold increase is at least a five-fold increase compared with the control level of the nucleic acid.

3. The method of claim 1, wherein said determining step uses a polymerase chain reaction.

4. The method of claim 1, wherein said determining step uses hybridization.

5. The method of claim 1, wherein said patient sample is a sample of tissue suspected of having cancerous cells.

6. A method for assessing the risk that a human patient has breast cancer comprising:
   a) determining a level of a nucleic acid and a level of at least one molecular marker gene in a patient sample comprising human breast cells, said nucleic acid comprising the nucleotide sequence of SEQ ID NO: 23702;
   b) comparing said level of the nucleic acid in (a) to a control level of the nucleic acid; and
   c) comparing said level of the at least one molecular marker gene in (a) to a control level of the at least one molecular marker gene;
   wherein at least a two-fold increase between the level of the nucleic acid in (a) and the control level of the nucleic acid, and a change in levels of expression between the level of the at least one molecular marker gene in (a) and the control level of the at least one molecular marker gene indicate that there is an increased risk that the patient has breast cancer.

7. The method of claim 6 wherein the at least a two-fold increase is at least a five-fold increase compared with the control level of the nucleic acid.

8. The method of claim 6, wherein said determining step uses a polymerase chain reaction.

9. The method of claim 6, wherein said determining step uses hybridization.

10. The method of claim 6, wherein said patient sample is a sample of tissue suspected of having cancerous cells.

* * * * *